United States Patent 6,812,339 (POLYMORPHISMS IN KNOWN GENES ASSOCIATED WITH HUMAN DISEASE, METHODS OF DETECTION AND USES THEREOF) - sequence listing, part 43

SEQ ID NO: 14207 - DNA, 670690 bp, Human
  misc_feature (1)...(670690): n = A,T,C or G
ttctggttctggcatgcagtggaaggccctctgattctgtttccttacctattttaatagtaacttatatttgtgttccttcattaaatgtacaataaataataaatgtttgcttacggcatgcttgttaagtataaaacaaataatcaaaatgaatgtgtaatgaccctttggatagaccaagtagaagctgcttttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgagaggagttgttttgagactcacctgccatcataggaaccatagcttaaattcttgtgaccttttcaggtgcatctcccaaaatatctcccctccaccaaattaatgatttatttcataaatttagttgcattctggatggtctcattcttaagatgagcttaaagcctttcagaccagtcacttccttgtttggggtggaggaggttttttcctggaataggacagtgtatggaagggttgagaatccacttctttagcggttaataatttactccgagtaaggaattctttgttaaagtggggcatgttcttcaagtgccagagaagagagaagggtgatttttctgacatcctccagcctgcttctccatatttggaaatgtttacccaccaggctgatctattggaagagagggaggtgactcagggtttaggagaagcaggatttgaattcttgtttccagaaacaaagtcgtccccccaccctgcccccacccttcccccttcattcctctgtcccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgagtacatcattactgccatttctgctcacagacctggggcttacagcctgtgggctggctcacttgcatggtgatgggacacgttgctgggagtgctggtcacttttatttgggggtgtggacagctgctttcccaggggagtacttcttacagtgggatttcaagacaagatcggcctgaagaaaaattatatttgtatattttttaaaaagtaggtatttcctctcatctgaggcctaacttgagttgggtagaaagacaatttgggagtgctgttgtctgatgattaaggctaaagcaacaagctggaagggatgtcgggatgtctgtggacatgtagggaggggtagttttagcttgaaaacagttatggtgggatttaagagtatgcaaaatgttgatgtgtagcatttgcacagcatccacggtctggaataccttgtgtgcaggtcactgtgtagatttgatgagttgtcagagttggaagagtcctgcagagttttcagcacatctgtctaatttcacagtgtgagataatgggcagcagagacccaggccctgaagacagatggctcattatgtgggattagaacccagatcttctctctcagttcgttctccttcccctagacttaagctgccccctctattgcgagatgaggaaattgggagatgttagaactgtccacacttactaatctagttggtgggaaattgaggactagaacctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcagaggaagtgctctgagacctatgtttgttctggccagttttaaagagaggggaagcgactctctaatctgctttgaagcaagtgggaggagggaagttgcacaggactcccaggaacctgtacacaatctgtctccttctgtgaccagctgaggctgggtggtgactgtaagccctgttcatgagacaggaggagagagccttgaagaaggaaagcctggggtgtttttctgtggtgctgagggacagggacagtaagaggttggagtaaataataccagtatgaatactaatactctgaataaggacagctgacaagcattggttgcttaatgggtgccaagcacagggctaaacactttacctaaattattgtggcactatagctgcctttgagtaggaactattttttaaaatattatttttaattttggtgtaatacatataaaatttgccatcttgatggtttttaagagtacagttcaagcctgggcatggtggctcacgcctgtaatcccagcactttgagaggccgaggtgggcagatcacttgagcccaggaattcaagtccagcttggccaacgtgatgaatccccacctctactaaaaatacaaacattagctgggcctggttgcatgcacctgtggtcccagctactcagaaggtggggatgggaggattgcttgaatccagggagtggaggttgcagtgagccaagattgccccactgcactttaacctggatgacagatcgagaccctgtctcagaaaaagaaaaaaaaaaaagagtacagttcagcagtgttaaatacattcatattgctgtgtaatcagtctccaggcctctttcatcttgcaatctgaaactttgtacctataagcaacagctacccattttcctctcctccagcccctggcatcctccattctactttctttctctatgaatgtgactactctaggttctgtatctaagtggaatcataccgtatttgtctttttgtgactggcttatttcactaagcgtagtgtccttaaggttcatccatgttgtagcatgggtcagaatttctcctttttaagggtgaattatattctgtggtaatgaatataccacattttgtctatccatttaggtactattttttaacctccatgttatagaagaacagcaaccagagacttcaaagggttaattaagtaagtggcccaaagtcacatagtcagtagtggagactaattttacctaagaatggcatgtgatcaggagtaagcagatattggattctaattggcaagagtgtgacaaatcagggtgcttctcaactggatggtgacacctccttacaccttgctatggcatttcaataaagcaagtgttccaaagggctgtacgcagctatgcttcctttcttttgtattgggctctaggaagcccatagctaaatttaaagctcacctctagcaaatggtatgagacatccagctcttattttttgtatccctttctcctttctttgctttattttctcctctccttacccactttctcacttaaatcatgaactattagcatcttttgtcaggtacctcagatcatttctggaacaaggcagaatatatagatatgtggcatgatatctaatattttagtaattattaagtctgtggaatagtaggccaaaactggccatgatttttctgacttgactctgctcgtcttcttcttcttccttttttttttttttttttgatggagtctcactctcttgcctagactggagtgcagggcgtgatcttggctcactgcaacctctgcttcatgggttcaagccattctcctgcctcagcctcccgagtagctaggactacaggcacttgccactacaccccactaatttttgtatttttagtagagacggggtttcaccatgttgaccaggctggttttcaactcctgacctcaggtgatctgcctgcttcagcctcccaaagtgatgggattacaggcatgagccaccacaccccacctaactctgctcataatgcaatgtttcatctgggcaatgccctgcccctttctgagtctcacttttctcacctgaaagaggaggttactgttgatgacagtgaacatttaggctgtgctgagttttacactaagcatcctgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatctaattttattaaatctttattgagtttccacttaggtgccttgcactgttctgggcattatcccagtactcgatttagagcaaagagtaagacacacacaacaacgatctcttggtgcttacacgctgctgcaggtgtgtgaaggaggcagataaaggaacacttaaacaagagggactgataagtaacccaagggaggagtcacaaagggcattctgactgtgagtgagtggggaaggactctgggaggttatgtttaagctgagatctgagtgacaaggaggccaccttgtagaagttgggggaagagcactgcaggcagtggagacggtcaatgcaaaggtcaaggctgtgaagtgggaaggagtttgtgtttgaggaacagaaggagactgatgtgctggcaggatgtgggctgcaggggaagaagcaggagaaaagaatagggtctagcaggtggtggtaagtgagagacctgagcttcttagacctgagtccagatgtgatgggttatgtgttacaggcatctttccagctgctgtggagggaacctgatagtaaaagggagtcaagggtagaagcaagaaggttaggctagacttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggatggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggggtttgaaagcctctccttgtcttgaggactggactgcggtccaagggcacctaccagccctcttttttcatttacatttgaattcacagttgctgccctttggcagttccctgtaattccttttaacaggctgggctttcctgcagatacttcatttttcaggtcttggagaagttaggtagtggctgaatcaggtagagaatccaaaattctgaccaagccccatcctctagccaccaggccaaagcaacttagcttgtgacctcatcctcctgtgtatcccctggcaatcttatactataatcagcctaagcccagagatgctcagaaatcatacactaagtcatctaaaactcatttctgaggctttctcatgcgcccctcttgcagtctgtagttaccaggttttcaaataattagcataatctcttaaaaacagtgttttgttattgctcattcaagtttcttctaaaatttcttttatattacctattcattgagttgacaaacatttattgagttcttactgtatgccaggcattgtgctaggtgctggggattgattcaaagataatttggaggcgtatggaaggggagtggataattacagcacagtgagataagtgctataatagggggatatataaagagccagaaatagcactatgaataacatctttgaacaaattgccttcttttttccttttggattattcccttatgtatattgcccaaagtgggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattaccgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatattgacctgaaaggacccaagggcgcattattcctgaccctggctcaggtgctgaaaggctatttgcatagccctactgttagagcacagaatcccaagtaaagctgaaaccatgccacagttttgctgtgaaacatttattacttttctagtacttaacagtattaagtaaaaactcctgcccctggtatccaggacctgtcataaatggacaccaacatcggtccactgtgggtccatgtgggtccttgatgctcctgcttacatatctttaaatcaaacacatttcctaccaacccccagatatatcttgcactttctcaccttcatgccttagcacatgcctttcctttagcctgagataacctctccaatcttcattcatagaactcccaatcctcctgtaaacttctgcacagacgccatcttgggaagggaataatccttgatcaccacctgctctcccatccattagaagtgatctctgtgttctctgttctgctaactcaaccacagttagctgtgaggcaatagagtacaaatgtatgctgcatatgagcatgggatatggatttgaatcccggctgtgatacttcctcactgtcagttaacttgcttgagcctgagttttcccatctgccagatgggtgtgatacaataggtgctccccctgaaacccaccatgttgacaggagtagtataaaaatggtctgattctcccggtgaggtcacgtaaatctggaatcgtcaacaattttcctttcctttgttgtcatgacttttttttatgacatcacctcatgtcaccgtgtggtatgaaaatttgcattgttacctgtgcttcttctgtggcacttgtcctcccttacttgatgtcttatctctccttctagactgggagctcttcaagggcagggagggcattgcatctttgaaggccttgacatatggatactgctacaaagtttcctttaagggaaaggaggattccatacaacctaagtggtgacatcagcacaggctcattactaatctcatgtcacgaggtttcaggcctggctgagaactctgtgagctctgtgatgttgagcttcaggcacatagagtacaagctgggtaggcctctggctcctgcttaagagacagcagaaaggctggatggagcctgtctccagaccagcttcttctgattcaaggagttgggtgggactggcagttcactgaaggcagagtggtagtcctgcttggaacgtgaaactttgtttctttcctgggccttccagtgggtctgttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaacgcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacagtcaggagacatacagtatctaacaaacttagggaatatgcttggcttacaagacgtggttttagtccacataaattagaatcacagaactataggctttgagaaattataaaagccttggaaggggtgaacgtgaattagtgcatattgtgtgcaggctttgtgccatacgtgctagatatgggatcccaggaaatggttgcatacaccttgttgggtagatgatattaaccctgttttgcagacagagaaacctgagctttgagaaaatcctttacacaagtccaatatcaaagtctggaacttcaaactgcactcctgatggcttctagaaatcctttccatttacagatatgacaagacttgctttcacattgttgattttttttttatcctctctttctctgtctctgggggcagcactaattcagggccagatagaactgtgaaaatctgcagtgttgatgtcacataacttgtttaatgaatctagattagtgtcttgacttttcctgccaagaatctgctcataaagtgtcttgttttgagctcctttaactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcggtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaaattgagaagcactttaacaactggtaatttaaattgcgtttgaactctgctaatggtttgtttgcatgggaacttcaatcatttcacagtggttctttagcaaagctgcttgttctctttatggaaaataagaaaaaattattaaaagagaagttggctatggaaaatggagaccactttcatttgtgcctggagggaagctggagagtgtgagtgagactccctcagggccaagggtggagagctcttcctttcagtgaagtttaaaaatctgggaagtcagatgccctttgctgctgttgtagaaactgttgtgatttgtatctctctctgcaaggagaagctttggttttatgcagcttgcgggtgagggtagggacaacctttttcgtttgttttatgaaattgcattgttcacaggtctaatgttggcttcctaacaacccatttctcagtaagtttgaaattatgcctctctctcctttcagtggaaatggctttcagaattccaatgtccttgaagaccactaggtctcaggaaactccttgcttttctgggctgatagtgattatactccattttgcctacttaatttctgtctgctgttgaggttactgggagagcgttgaaataggtgttcgaggcctggatttgtaagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactcgtgatcgtgaggacagcaccaagaggatggtgctaaaccattcatgagaaatccgcccccatcatccaatcacctctgcaggccccacctccaacagcaggtattacaactcaacatgaaattcagaggggacacatatccaaatgatatcaaggacggcttactgggaaatgtcaagattgtttatccctctgctgctcactgattctcacttttcaggcaaggaaactaaagttcaaagaacattaggtcctatagttagaaatttgtctccaaactcatattccttttctttttttatttggtatagtttaggtttatctgttaatttttttcttccctacaatttgagtatctaactgacttgcctctttcacctccattattaagatgaagctgttttcccaggagaactaggagagctgagatatgaacactgaggcatcagcattctctttccccatcattctgagtcaaattagtgaaataagagtgccaggatctgactaggagtttaggaggtatagaagtaaaccacggcccagtcagagactttataagcctgggaatttctgaagctggttaagaccctagagatacataagcaacacccttctgtttttcataggtgggaactttgaggctcagagacagagcagaagacagaacctggtcttctgattccctgtgttctgcttttttcattgttccactggacgctcatcagagggaagatctttttcctcaattggtgagtcccgcacacaaaaagaacacatttgccttttaaaatcaatgtatatgttttaatgagttttaaacatcagtgttttccacttaaagtatgggcatcagtaactaggatgcattaagaataagagaagaactgaaatgcccttccttctttcttgagttgcttttatggcaatagacaatatataaccatgctaataaaatgtgtggcaaagcaaaggcagagctcagctcttggaaggtggtagcattgaacttggaggaaaatttggagtaacgatgatttcaggttgccagcaattgtattgcctccttctttctcatttggcatggaagaaagtgttcatgaaatggaaagaccaaaatgaaaatgtcactgaacagtgtttgggcatttacaaggaaagaaagcagtattattgagtgtctcttgtttgcccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcccaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtggaataccctgggctctaaggaaagctgaggaaattagtaagggaattctgggtgcgacttccacttaggatcctgattcgatggtccccattggctgaggccaattcatatatgcccccagcattggctttgtactgagtaattaatacaccttgacatatttgtggtgtagttttccaaaacagagatgatgccattgtgattgaaaaaaaactaacttcatttaaaagtgtgactgagtttatagatgtgttttgtctctctgtcttttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacaagagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagtcttagaagtttttgttgttcataagctaaatatgagccaacagtggcttttgttgggagtggcttccgaaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtacttacacagtggagaagaggtggccccgcaaaggaatatctgggtgctgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagctacagtctagcccatttggcttcttactttgttagattagataatcatacctgctgctccaggcgtgactagcccagtgggagtcaggaaggaaattatttccctctgttgataccggtttacaattgccgactgtcgccaagggctttcagttttaatatttcctctttggtcctcagaagtatcaggtattagtctctgccggaagcaaagcattggtcacttccgtcagaggtgaatgtcttggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggattacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatacctgtaatcccagcactttgggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcgtggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacattagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatacgagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgagggtgagtgaggtcacttttcacctctttgtcttctttgcttcctaggagttannnnnnnnnnnnnnnnnnnnnnnnnnnnnnnnnnnnnnnnnnnnnnnnnnnnnnnnnnnnnnnnnnnnnnnnnnnnnnnnnnccccactattcaaatttatgtcaaagttggcagttcaaggtcaaggtcagaaaggcaggtgatcctgccagggtcttaattggatcagccttaccccatgaatccattagatctcctgttccccttcttccaactccagacaaaatgcttagctctctgcaaaaagcccaattgcatgagcagtaggtcagctcagcaaccaggtgattgaacactgggacaagaataaaggaaggaaaggaagagggcattttaggatggctgaaggtgctggaaacttgaaccctagaggaatgaagaaggaactggaagtgcttagtgtaaagaagaaataaaggggcaggaggaggagagagcagagcaggtggtgctgtcctgggtctctgctgtggaacgggtgcaaactcactttttgggacctctggaagagttctggcagcagtgggttggaagcaagagatagatagtgtgagaatgttgatgttttctcaatgtttatggaaaatgcttaatgttttaatattaagagcaaaccacagatggaatgtgtgtttcaggaggtcgaagttcacaatcactgcagatgtctaggtggggttgatgcagttaggtattttctattttaggtattttgtggtggggataaaatgttatacatgatgacttttaaggtcctccctgtcttaagagtctagagtttttttagacatgtttttgtgtacatttaaataatttccattttaaaatgaaggctctttggagtaaagtgattgttcctttctccataatcttggcacatgtaagtgctgacttaccttgggcaatctcttctccacttagcattattgaaggaaaggagactaactgaggatgtcttagaattttttgtactgaatgtatttttgaagatgatttgtacgtttcttttcagggtagttccagggaagtctcttctttaggcctcctccaaccaccatcccctattgtcaatgattggctgtttttgtactaccagaatgctttgtgtatacatccaataaagcattcatgccacttcagtctgctgtataagcctgttttcacaatctttcttctcctctagattgtagaagctccttgagggcatgaattatgtctttttccataggaagtcccatgtcatctagtataatagtttgcaaatagtaataatgatgactcattaactcgagcgtttactgaacacctactatttgctagacactattccaggtgatgggactagaacaaatgttaaaaaaaagacagaaaaattaatgagtaaatatgtaatatttacattgtgatctattaggttggtgcaaaagtaattgtgatttctgccattacttttaatggcaaaagccgcaattacatttacaccaacctaaatatattaagaagaaaaataattgaggttaaaggcatgaagagtagggaggacacaaatgtaaattcactggcctgagaaggtcttgatggtaagagtatatgtgaatggagacctgaatgaaacgaggtagcaagccagagatgtgtgggtgggatggactggaggaagagtgtgtagaactgactgaaagcaaatgcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattcttggttcccagtgcatatgaaatttatgtttacactatactgtagtctcttaagtgtgaaatagcattatgtctaaaaatacagtatacctaccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtcaggcctctcaaactttggatctgctttatccattaagtttatgaaatatttgatatacttttttttttgttgtcattcaacgatgctcacagcatcttcaccaggggtaatttccatctcaggaaaccattttctctgttcatccataagaagcccctccttatccattcaagtttaaacaaaggattacagcaacacagttgcatcttcattccacttctaattctagttctcttgctattttcaccacatcctcagttatttcctccactggtcttgaaccactcaaagtcacccatgaggattggaataaatttcttccaatctcctgttaatgctgatattttgaccttctcttatgaatcacaaatgttcttaatggcatctagaatggtgaatcctttttagaaagttttcaatttactttgtccgcattcatctgaggaatcattatctatggcagctagagccatatgaaatgtatttttttaaataatcagacttgaaagttgaaattactccttgatccatgggctgcagaatggatgttgtgttagcagacaagaaaacaacattaatctctttgtatatctccatcagagatcttgtgtgaccaggtatgagaagaaatattttgaaaggaatcttttttttttccctcttttctgagcagtaggtaacagtgggcttaaaatattctgtaaaccatgctggaaacagagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaatgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaactttcttcatctcagcaataaggttgtttcactttcttatcattcatgtgttcactggaatagcacttttaatttcctttatgaacttttttttttttggtatgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgactgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtaccggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccggatctgggaagggcctttgaaaagcttgcacggaaagctgcgaaataaatcgtttctttttctctttctttacgttctaaaatctcgtgatctgtttctacaatacacaggctaattgatgttatccttttggcatgattcttgctgtcctggggtctatcacttgcaggctatgagaatgaggccatagaccaccacactggcagcactgagcaaaaggtgctagacccttctgagttcaggtgctgtgtaactggtgctgtgattggacagggtgactaacctcagtctctctgggtgtaatttcttcactgtggaaagaggaggctaactagaaagttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcctgcttctgctactaaccccatgagaccttggaatgcccatctctaaggtttctttcagagctgaatcactgtttggtctgtgattcatcaaagcaattagaagactatgcctctccttcaagaccaagactttggtcagaatactccctagggactttctcactgtgtgtggcactcttctctattagacgctttattcattctccattgtattagagtcaaaagtatgattgtttgttgtagaggtgccttttccgtgtcatctctgataatctacccctctctctctgagtaacctaggcttttaaaacacatctcctttggcttaatcacactgcctggtgtctactcagcattatgtgtttgttgtctgccctgaactgtgaactcagccatgtcctgctcatttctgaagcctcagcatgtacatcggtatctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtggcacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacctttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgcttcttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatactcgtgtatgcaaagactttaacatttattaataattttttctatagattggtgaaattggtttgtaatttttgtcatttcacttttgtggaaattgagcaaaggtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatctcagaaaaaaaaaaaaaaaaagatgtgatcaatatcaatctaaggacactgtaaagcagcagaggattgacgattttcctaagacttagtggatgtagaagagtttaaaatattctagcctagtggtttgcaaacttggccacatattaaaatcttcagaggaactttatgctacaatgctcatctcagtcacagtgtctgtgggtgagacccaagctcagttacattttaaagctcccgagagtttagaactattgatctagtcttgatttcgtatcaatttctctgatggtatcttgcttgacatcttacttactgggctgcatttttgtgctgtgtctccctgacacccaagtgaaaactgctggatgaaccgaaaattcacccaaacaacgtgaatgtaatggaaactcttgaaaaggcttacaagccttgaagtaaatgttgggcgaagggagcgaaagggttagcgtttttttgcattgggacctgccttctttttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaataacactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctatccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttctttctttctctctttctttctttctttctttctttctttctttctttctttctttctttctttctttctttctgtctgctttctctttctttctttctctttctttctttctttttctttctttcttttctttttctctttctctctttcttttctttttctttcactctctctctctttctttcttctgtttcccctcccttccttcctcccttcccttcccttcccttcccttaccttgccttcccttcccttccctccccgtgcctgcggtccgggccccccctttttgtgggggccgcgggtcgggggcccgggcgggggggggggggggggggggggggggggggcgggggcgcggcgtgggcgtgcggggggggcggggggcgggggcgcgggtcgggggtgctggccggggggtgcgggcggggggcgggggtgggtggggcgtcgcgggggccggggggggcggcgcgggcgcgcggcggcggcgggggcgcgggcggtcttcgggggccgggggccccgcgggggggggcggtgccgcggtgggccgggggcggggcggcggggtggtggggggcgcgtgccgcggcgcgccggcggggggccgcggcgcgcgcgcgcccggcgggcggcgcgccgcggccggtggtgggtggcgctggcgggggcggcggcgtggggtccgcgcgcggcggctcggccgggccgtcggcggggcaaaaaaaagaaaaaaaaaaaaannnnnnnnnnnnnnnnnnnncgccccgagtagagaagatgcaaattatagtgcgagaacgtaggagtgagtagtgagaaaggaagcggactaaagaaattgtttcgtttcagctaattctcttatatttctttctttgtatcctcactcgttttctcgagttatttcgttggtgtataaatagaattgtcttgcgtttgagctatttttcatatgacgtagccatgtaagctaacatattctcatatcttacttgagacatcgctccatagtttcattatatatctcatcagtcttcttaaattgttatgtaaaataaggaagtaaaggaaaaaaagaggagccttcccgtgccctccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcaattgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttctttcttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctctctggtatttctttttaatcctgatatatatatatatatatatatatatatatatatatatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcctctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacgtgtcctattaggagtaaagttaagcatcttaatgtatttaatgtccatatgtattcattttgtgagttttttgtgagttacctgttcatgtcttttgcccattttaaaattttattttattttttttgggacagagtctctctctgttgcccaggctggagtgcagtggcacgatctcaactcactgcgatctccgcctcccaggttcaagtgattcccctgcctcaacctcccaagtagctgggattgcaggtgcatgtcaccataccaagctaattttttgtatttttcacggagatggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttacagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctggtgtctcaacaccatttagtatgaaaatatcttctcatacttcccgtgtgatttgagattggtggttactttttaacctacaccatgactaggtgtgaaggagaatgatggtaaacagtggaacagggtagttagaggaaaatgaggtcccaggtagataatgactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggataggattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagtattactcctgccatggcttcttgacatgccttgatggagctgtggaaagcatcttggttgcttcaacacaaggctgtgagttgtttcatagggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaaagctaataatgtatgggttaaataattaagaactttcaaatagttaaacaagtagggaaattagttggtaattaatataaaaattagattaattaaaccttagttaatgaatattagctaattgaggttattaaatcttagttattacagtttgttagctagataactttgggttgaccaacacatcttttttcagctaacaagcatttataaaaatataaattgtaatctaagtattgttatagaactagattatacaataattataattgttactgggttgtttgtggaatgcatttatgacaccaaacagaatgaccattaagaaccatttttaacttttagttatttaattacacttaaggtcatcagtctttcaagaaaaagcctatttaagattttttttcacattttctgaagataaattaaaagtagagtgtctacactgtctctcaacatttcctgatcaggaaaacctcccaaattacgtatagcaacatcaatgataaatgatttttaacacagagaaatttcatgtgtattcttatatcacaaaaattcagacgatgataatgagagatttcagtctcagctttggcttactattgattttaacattcagtcatttggcacttggcccaagtgggtaatgggtgcatatctatcagtggctcttcatacatttgtgcagggaggtacacatgcatacgtgtgggtgtttcaaagtctaactggaataggcctctcacatttatctcctattaatttgcagattgtttccatggtcaccatccagaaatttcccagtaatccttgaggaagttagggagtgtgataccattagggagagggaatatgtggcatagagacgtgatgggcattagttgtctgaggttatgaggtcgtggtgaagcctgatcatgtgaccccatctccatactctatgtccagtgctccagatcccatagacctgaatcttagttctggtgctagaactgtccctgatgcacatatagtaagactttaatttccattttccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaaaggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttgcaaataaggaactggggctcaaagagattaaaagacttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccaaccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgcagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtgctgtggcttttgctgtcttcccttgtaatctcttcccctcaccagattttcaacacagaaggggtgtattttctagttatggggtattcacaatcacatctaataattttactccagaacatactatggcttgtttatactagcttgaatatttgtagtctctttgatttttgtttgctaatttaatttactattgcatataaaagaatggcttccatggagataatcaccgtggctcccagagtgcatccagagacatttgccttgcttctgtggaaatacacccaaattccccagcatgacattgagtgttcaccccacacctgacaccagtctctcttgctctaattaaggccactctttaccattcttgggcaccagccagatgaactataccctggtgtgggatctgcccgatcctgctgagacattaactctgtcctgaagctgtttgtccttccagcagctagaaataatctttcctttcctagaacttccacactgcattgagcaggaacacttgtagaacttctcacattgtacctcaaggtattcttatttatgcatgtatataatttctccccttctactactgtaagcttctgcagggtggggcagcctcttcttaattttgatatctactgctgtgccaagaatattgtaggcatttcctaaattatttttcccccagtgtatgtgttactttgttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacactatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttctctcagacttaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgctacatgctggggttgacgaatgcatgggattcggctctctcccaggctggtgggaagaggacacatctagaagccagggtatataccccgaaggggtttgaggcagtgcagagttgatgatgatggtctccagcctgcctttcctttacaaaaatgaggagactgcatctcacattgccaacgagctgcttgactctaccgatattccctaccaagcacgattatgggtagtcttaaaattcttaataataaaatagatattgaaaatagtgtttttttttttaacagtgaaagtaatatgtactcatgtataggttttcaatatacaggaaactataaaatgaaaaggattgtacctgtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctctctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagctatttttgtgactattcagtacatgtacaatgctgcctcttggagtgttccggctagactaagaggccattcactgctgactgcagccatgccatccctccatggaatcctcggcccggaaatcagatgggaacaaactattccaatatacaaatcaaatttcagagtctgagtgtacacagaaaaattactggatatcctgttggactatgtacataacaatgacacagtgatttatgagggtatgatggggcagagggtagcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtgtgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggatttggagaagagagaaaagcagcttttaagaactgactttagaggtttagcacgaattaaattcctggtcttttctttctgcagatttttcagctattgttgttgtttgttttgttttgttttgttttatgtttcttgagtttatcgctaaagatgcttttccgtggatggcacaaaagttcagctatggccatgtgcttactgaaggcctgtatatggaggcatcacagtggctggccttgaagaaattaagatagtgaaagaggacccctgtctgcgaagaaagagctcatgtttgtgtgtgtgctcatgctttgggtgctacaaggagactggtgtctggggaagggaggaagggtgatggttacaggtataggtaaataagttttccaacagttaacaatacttggagacaagctacagagtgatcaatgctagagttaggaacgctgtgagaaggcaaggtgttctgtttgtgccattggggagggctttgctgtggggattgggggaaggatattgttttaggctttgctagatggctaggactttaacaaataagaaagaaagagctgagtctttaagacagagggaatagcagagacatgaaaatatctagagagattgggagtgggaggctgagtctggaggtgagatatctgtatccaatcagagaagtttcctatgccttcctgtaatgttggaggcttcttttttttttggtaatcagtaaggagctgtcatgggctttgtaaaagggctgtgataggattactctggtgtgtgtgtgtgtgtgtgtgtgtgtgtgtgtgtgtgtatgtgttctgcttttactttatacatttcagagtctttttaggaactcttaggcaaccttaactctggggagtgtgnnnnnnnnnnnnnnnnnnnnttttaaagctctatagtactctggtgtgtgtgtgtgtgtgagcgtgtgtgtgtgtgtatgtgttttgcttttactttatacatttcagagtctttttaggaactcttaggcaaccttaactctggggagtgtgcattgcctgtctttatatgtctttacttctctgttgctgcctggttctgctccttctcatgcttctgtaacaaagtgcggcaatgcaggcttctagaaggtgatgtgagatctctgagcagaccatgtgtgtgttcttcccatccttttttcccctccctttctcttcctcctcctctttctatatcaccaccctcaccagcagcagcagcagcactcccctccctaaaataaataaaccagtcactccaaaggttccaagcacattagtcacatatcccagaagtttaatacagaattattttgacagcgagaacaagaagtgttttctagttgaacgcacagaacttgcttattccaactgggctttctgccgcacagacagatgatacgttttttagatggattggccgcacagcgcaggagactgtcgcttcccttggatacacagcaaactgctcactaccaaaagtggctggggagaagatgtgaaaggagagagagagagcgcgagagagacagaagagaagaggagaggggaggggaggggaggagaggagagacggggaagacagagagagagagagagagagaaaggaaatcaagttcttattatgtacataactttctcattaatggcttccataagtcactgagagatttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaaggtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagctgacctcgctcactgctgtgcatgctctctggagctttcttgtcctcttttggttgtttcttactagcccctcattcccaggactttttctgaggaatctctgttagttcaggtaataactggctgtgaaacctacaatagtaagttctttggatgtcggtgttttcagatgtttcttcttcatggaaactctttataaatccctcacaaaatgggatgtcaaatctcaatatgtaaaataatcaaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgatggaattccaactatttttaaggattttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaaacaaaaacacaaaaccaaaacaaaaaacaacccccaaaaaccttagacaaatctaattccacagtttaattaagcaaagaacaattcgtgaattgggcaggccccaaaccagataatctggcactgccatttggttgaagaacatttgtggacagaacaaagaaggtgacggacagaaaacacaagtgaggtacagaaacagctggactggttacagcttggtgttttccttatttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaaccgcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatatactatagtaaatacgacatactgttaagggttaataggtggctgttttctgtgtttgttcctggagatcgtaatatctttatgctgttccttctacttcctttttcaattttatgagctccatgttgaaattatgagtccttaaccctattgaactgtgtgccattgggcaagttgtttctatttctggggtattgatttccccgtctcaaaataaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttctttttctttctaatgcttgtataagaacaaccttcgttcccaaacacacagacgtgtgtgtgtggacacacacacacacacaaacaattcttcagaaagaaagcctcttacgtgtgttaaacttgccacttttttctcaaaatgtgctttgtatttctttgggtgagcaaaagaagaatcttcctcttctcaagttcagagtttgaatcaattcttcctgtcttttgcatttcagtaaatgtttcctagatggattcatcggttttccagtaaagacaaacagctcagaagccagattacattcatacccaaggcctgagttctgtgacccaggcatcagagctcagtgccatatatggcgaaaagaggaacaggagcaggagtggagggagaatgccagacatgcaatgcattcctcagaaatgtgcattcataactggcaaaacaggacccttgctggtttccatcttatgcagaacatgaactgtgaagttttgagaaagaagctaatgttccaagcatctgccacagggaacagtttattttcccttttctttttggtcacatgtcggtttaatttggagtcagtgtttaagtcaatgctggcatggggtgaagactaagaaattgttcttgcagtcagcagacatgggttctcagcccaactccactgccacccagctgcaaaactctccttggcttgtttttaatcaatggcaaagtagcagggttgaatttgatgatcttcgagatttctactatttctgttttctttggttctaattttgcccgagattttccagttcctgtggaattccccagtgaaagcattttctaattcttccaaatactttttgtggcttgaacttaaaaagacaaaaacaaaaatcccagtcttgaatttttctttgtgatttcctgaagtatgttttggatgcattatgaatcttcaattgacagattatttcttgctcggggtagagaagaatgcatttcctgcatcttcatggtcttctttcacttgcccctcttattgttggagaagaaatgtaggtatgttcaacacatagttgcagggacagctgtgcactaagcaaatgcagacttttaatgaccttgatagttgtctgcttctctcatgcattgaagccttttctgtggaagaagtgggagcagcagaaggcagattccacagcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgacctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaggaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctggcaagtggacatgctagtggaccttgaaggcctcttctagctcttaaaagcatgaatttaatatatttccagattgtctgtttatgtttcctattgcatgtacttggtatgcccggtgacactgagctcatcaacttgtaaaaagaccgtgccattatcttctttaacggcaaacagaacaaaaacagaatcctctttgtgggtgcctgctcaccgtaatattaggaccaaattcttttgtgtaacattcacctcctttcccagtctagttccacctaacggttctagtttttgggaagcgtttgcttccatgtgtgacattcatctttactttgagctctctgtgagccttttgctactgcagaggtatgtgtctgttgaaagagaggaagctgtacacgatgacacggcagagtcattgggtcaggagtggtgttgagaagaatgaatcaggatgctggggttctgtgatagactctacaaatagtttacaagaagatttagggacagtaagcacaatacatcttttgcttcagtcaaaagcataaattttaatggttacaaatgcctggtgctattatgagaaaaccacaggaaagaccattatataaacagtaataatttgttgactatgactaatcctttggggagtatgatatgtgacataggcgtataagggctttatgtagactaacccctttaacacctattaacttgttagaccctgctaatgggtccacgagggtggcaggctaaggaatgctaccctctatttactaacgagcaaagcgatgctgaaatacagtgaagaagctgtccagtgtcacatggtgaagagatggcataacagagactcgttcagtgcttttatgcctgcgtcgtgttttctgcctttccaggcttcagcctacccagtaaagcaggataaaaacacacaataactgcccccaccacccacagccagaagatggtagaggatgggattgaattagtcatgaatcatgtgaaccatagtatttggtgaatcagtcttggtaattggtggggtgatatgtcagtcagtttactttcacaactgaattatcaactagggcaccacgatggaaaacagaattgaggatttctactttcttattattcatttgtacgtgtgtactttcacttatttaaggcaatgaagaactaataatacctaatatggtgccaggctttgtagtaggtgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatcttttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctctgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaacgattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaattgacagtcaagctttctaggtaagcctaattcagtgcttaaatttagttctaaatcctgtccccttctccaactgttatttctttaaaggaatcagcagtcacctctattttagttctacagcatgtggtggtcttaagaggtggaaactggcaccttttcccaaaggagagactggaatggccagagcccatcctgactttgggtcatcactttcagattaaaacataactgtacagagtacatttcccttgattctctgtttccacagagaggcttttctgctttagggtttcattgatgggatgacttcttttcctttgtcctagagtgcgggtcaatctaattcaagtttggtgaataaatggagccataaactgtgttacccactttatttatttatttatttacaaatgaggtctcccctccctctgttgcccagcctggagtacagtggtgtgatcatagctcatctcagcctggaactcctgggctcaagcaattctgccgtatcagtcccctgagtagctgggacggtgggtgtgcaccactgtgcctggctctccaccttattaaagtgagttaagagaagcataaacagtgttttgctattcttcttggtaactttaaatgatgctttcttctcagcaatgatggtccagtctaactgggcatcattcatttagctattatttattgagcacctgctgtattccaggaacttttttttttctttgaaacctagtctctgttgcccagactggagtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgtagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggccggaccccaacttcgtattccttcttagctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcacctcccaccctccaactctgtctctctctctctctctctctctctctctctgtctgtcctcctctcctgctgttgccatgtgaagtgcctcctcccttttgtcttctgccacgttgggaagcttcctgagcctccacagaaggagatgctgctatgtttcctctatagcctgtagaactgtgagccaataattcaacaactcaaccacttcttttcttttttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgcatttttagtagagatggggttttgcccctttggccaggctggtctcgaactcctgacctcaagtgatccacccgcctccacctcacaacgtgctgggattacaggcatgagccacctcacctggccaacctcttttcttttaaattacccaatctcgggtatttctttatagcagggcaagaatggtttaatacaggggcccatccagcagcactgcattaccaggattctgctgaagaaatggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacctatttcttaatctctctaagagacatggactgtgttaaagtgtgtttatgaactggtggtcgagggtgcatttccctcctaagaaaactcattccttgttttgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttcttctccattcccatgatttagccctctgacttcatgcatttctttttgccctttttcttgtgctggattttaacccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctcccatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacatgccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggagatcaagtggacttaacttcagctcctaaagtctccaaggcacagccatggaatgactgcagctatttaaggaaatggcgtagaagccattatccaaagagctggattccagtcctgactctgctgctgaccagcttcactggccttgagtagttgctttgcctacctatgcctcagactcaccctctataaaacaaaggtaacctctcaagtccctttagaccccccattgtattaaatataattctgtgactttggactccttctctggaaccccttgggtagccaatgaattatatgacagggaacatgggtatagatataacccattaggggacttgaattgagaaggtgctcaccttcctttctctaggattcaaggaccaactgacaatgatatgctttcagattcattttaagaagcacacaatcctcattcactataaaagtaagatagcgagtggagctgttagaggaaagtcagactggagccaagaccatcatttctgtatcttctgggtgttgtagaaagtaattagcaggcttgattatctcactggttcaacacacattttagggatgtgatgtaatgtgaggaaacatttagttgtcagattttagggctgtatcaaatttattcttgcaggaaaagtctagttgtcctggcaacctaaaattgatttctttttgctcttgtcagctgaaactggtcccctttgaatcattcctctaatttaatatagagagctgtgtgtctccacctggtgaccgaatcatttttaatgacaggtaactccagcaaatggctcctctttcctacctgagccagaagctatagtttattactaccttcaccctgtgttgttctctttgtgtttatttatttgtctgtggagtgaggtgtgtaagtaaagtggcattcaattaattaagagtttaatcaggcctgtagagcagtgatgtaattggcagccaatcactgcctttcgttttcagtgacctcctagacatgagtgggattcgaatgggctctggaagagggagtccttttgtgtggatgtctagcatttttgtaacctgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaattcgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagcgcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaattttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacaaaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagataagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttacatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggttggagaagaggggcttacgggaaggatgggcaggagaaatgggatgggacccaggaggcccaagggggaggtggaggattcaagtcagagcttcagatgctgggtctggagacactttctgaatgcctaggcaggtagctgtggtgttttgcaggataagaaagacagaggctttctgtagctaccatcctgctaggtgaaatgaagggatggtctgggatgtgtgtgtatgtgtgtatgtgtacccacatacgtgcatgtgtgcatgagtgtgtattggtaacagaaccaaggagatcagggacttacccaaggccatacagctgggaaacagctttcatttgattacggtgctaagtttagtaatgactgcgagagacaaaaacgggcagggggagcatgtagggaaagggcctcggccccatttcctgccctctcaggcaggtagtgagtaggagttttaggtttcactgtttgatagcatcacctcctctgctttcccagaaattattcctcgaagtatgactcgaatcattcctctgttgggagatgtatcggttcagagctgactttctgctctggttgtttactgaaaaatggtagcactggcaattcagagggggcataagcaagtgaagaaaaaaaaaatgaacaaacagggcatgtgaggtcaggggccctggttgtgagtcccggccctgcttttagagacccatgtgaattgggcagatcaatcaacttcttagtgcctcagctttttcctctgtaaattagaagatagtgatttctgcttgataaatttattgtgatagtgctttgcaagttgtattgttggtcgtaggataataaagataaaggggtatacagacttggattctgtttctatatatgtgaagcgttagagagaggtggtaaattgtttctctcccgtgggttgtgcacatctctgatattatggtaatccccatatcttctccttttgcagggtggggtgtcttggatagtatggttactgaatgtagaatctactaactcctcttttttatttcctgagactgggtctcactgtgctgtccagggtggagtgcagtggtgtgatcatggctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcactttggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctggaatgaattggattctgagatctgtgcccgtccttgtcacaacgtgtcagattccattatttagtgtgggcctgatttgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcagatcctctatttcctaattcatggcaacttctggagaacagtattttctctgttactgctttatggggtttagtgtggaaattaaagaagagaacttcttattttttgtaaataataatgcaatattcagatactgttagtttctgaaatttaaaatgggcatctcacttctgtgttccctccccaaataaatgtattgatactaaaaaagaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttgtttacctgtttattttttatatttttgagatgggatttctctcttgttgcccaggctggagtgcgatggtgctgtcttggctcactgcaacctcctcctcccagcttcaagcaattctcctgtctcagcctcccaagtagctgggattacaggcacccatcaccacacctggctaatttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctctatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttcattctttatgtagtagtgatggccaataagttctttttttctctggcaagaagctaagtaaaggcaaggagtaatcgtcaccttgaatttagagcacatagaggcctagaaatggcaggctgtattaggagacaacattgatttcatatatattcatctctgaaaaaacatgtttaagatgccatattcataaatactaataaggctgtctgattccaattttcaggtgagattagcattttattgagtattttatctgtcagattcaatgctggatgtaccatcctcccaggcttattagcataattgctgtgcttaagcaacaataaaaaaatcagcagtaaaatagcatttagtgcaggcaatttgttatcaaaagcttttacttaaggacagctccagcctgcatttattagcaagttagggttataatttatttttattttgaaaaacaaaagtgggagaaagatttggcttttttgttttggaaataatagagaaattagaaagcattgcctctttggaaaattgtccacatcccttcttcctttgccgaaagcaggctgtgatgggaatagattccacttgtgagcgacattggctcagacaaaaagttgctctccttggcattggaacaaacgggtagtaacgtccctttatgcttgtacacacatttccaaaacactttcagatctcgtttgttgctcaaacctcacaccagtcccgtgaggtctccattcttagaaatagaaaaccaagttgaaatgacttgttccagatgaggcagttgagtggcaaagcggaggtgtaaaaactagtcttccagcctccagtcctgtctcagcattgctcccccttcacgtcgttgtccagagctcctggtggagccttggccttttccatatgtacacgtgcacacacacacacacacacacacacagatctgtgtatctacacctgtctatacacatacgtgcacacctatgcacacacatctatgcatacatacatactttttcttttcctaaaagttaattatgtactcttgcatttgtttttcatttgatgtccgggttgaaatacttctgccacatgaacttctcttgatgccaaatagcctcttaaaatcaatctctctctnnnnnnnnnnnnnnnnnnnnnnnnnnnnnnacccccaccccccccgcccctctagctagcaactgtatcaggaaagcacttgtgattaccatctgttaaggacctggaacaaaataaatgatgttataagtttttgtagggaagatagagataagattttaaaatatggagattgggaaatcatttttcttccttatttcttaggaaatgtatcagaaataaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaacgatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaactgctgtggtctccctgtaaacacatgtttttttcatggtaccacttggcaaaaaacgaataagcaggtacatacgtagacagatagtgctaatgatgattagagaacctcagaactcatgcagaacctggatgtttagagagaaaatggaacttgaaatcagacaggtgttcaaaccctactatgcttcttagtgtttgtaaaatcctcaatttaaggacctcttaggatttcggtgtcttcctgtgaataaaggattataaaatctttctctcaatatcataatgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggggaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcgagactctgtctcaaaaaaaaaaaaaaaaaaaagagaaaggacattaagatgataccttaccttgtgtggggggcttgtagctttcaaaacacttaagtacccattttcttatgtgtgctttatgacatctctatgatgtaggcaaggcagggtttatcattatttcccttttagaaatggtggatctgtggttcagagaagtgaaataagttttcttaaagcagttctggatgcaaacccagaacatttgactctagggtgctttctgctccaccaccctgatttgattgtaaggaggtaattcttaccaagtactgtcagattatatagagttgtaatatatcttaaaaatgcccattttaattttctttaaacagatcagttaaaaagttaactgtgatttgataccatcttgtttctccccaagtttaaacagcaatgagtctctaggaccttcggttaaaccagcatgtgtttttcaaaaatcaaatgtcaaagcatttcgtgaaccttgctttaatgaacaagagaagtgaaggtacaattccttttttgcatgaggtaattaggaaacaggatgtgcaaacttgctatatgaatttaaagaggagcacttctactgatgtacaaactggatgggcatattacagagggtttcatgctggtagaaattttaagtgaaataagttctcattaagcatatcaattatttttggactgtgtgaaaacttaatctgtttcatgagttggatctaaggtggtcaatacctctacactccaaaaaacagaagcatgactcaaacatctagttctgattgcagagtgcctttatctggaagactggacatgtcgtcagaatatagagcaagagggatggaatatgctcttaagtttcctgatgacttaagggtctgcactatacttgcttgggaggtgggaaggattgaattctctttggaaaatgcctttgaatctcttacacacatggtacccaataagcctagtgctgtattattagcatcatgtactagagtatggtttacctgacataggttttggaaatctatttcttttatttacactacatggtttcttaggtggcaattctcagtgaattaccagcttcctgatagtgtcttgaaaagcatgctttataaggaggcagaaagtgtttctcttttgacagatgacctccttgaccccttgactttccatttttgatggtttcttttgaggtctacgtcatctggtaattttattggtgtgatttatgcccccagtaaggatcaacttgtatagattctacattctcatggaagtctatgtactgtctctactgtgtaataattagctccaactctacaaacaaggttagaaatgaaatcaccagcattacaagtgagacataacaaatggaagattcccttctctgagtttctctcataccgttaattttatttgagctggcattgactcattctatatgtctcttctgctagattttgaactctggaggactggtctcatatcttattaattataatggtggcgcacagcacattataggtatttattactaagtggttgggtttaatatcttaagaagcagaaaatgtggtttttcttgagagagagatggttttggatgttgttcctctagtatattctaagcctgcccgcctggggctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggagattattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatcagttgggcgtagtagtgtgtgcctgtaatcccagctactcaggatggtgaggcaggagaatggcttgaacccgggaggtggaggttgcagtgagccgagatctgccctccagcctgggtgacagagccaaactctgtcaaaaaaaaaaaaaaaaaaaaaaaaaagccagttatgaaagaccacatattatatgattccatttatgtgaaaagcccacaataggcaaatctatagagtctgtagcgatagaaagtagtggttgccggcagggttggggtagaggataggtagtgattgctaataactgtgagtttctttttgggatgctgaaaatgctctttatatggtggtgatgattgcacaacactgtgaaatactaaaaacagaaccgtaaactttaaatgggtgaattgtatgtaaattatatctcaataaacctgttttaaaaagtggatttccctttaatctattctctgaggattgcttcagggattcaaaatagtgcatagtgccaagttttaaactcatattgatttgtttttggtaaataagtcatgcatgcttaacaatggtgaacacacttaaggaaaaagtggtaacacaactagagccaccaaaccgaagcaagtatatttccacctaacttcatgcacgtttttttctcagaagctttaaaaatttatactttctcaaatgttgattaatgagatatctgataagaaataacagggtactgacagtcctgattgtataaataggcattagggattgtgttcatggtttgcttgtcagcacaagagaaatgtgtgattatgttgaatgatagttaattttcttatccacccattttaaaaataaagatgtacagctagaaaacaggtgcccagggaatagaggagacctgcagctttgataatgagccccagaaagaaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttttctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaagagttttgttcacattgagcaattaggcccttcgttgagcagtgaccatttggacttttattttcctcatcttcccatttttgtttttttgttattttattttttagagacagggtctcactctgtagcccaggctggagtgcagtggtgtgatcacagctcactgcagcctcagcctcttgggctcaagcaatcctcccgcctcagcctcccgagtaacctggaacaacaggcatgcaccactgtgcccacctacaaaatttctgtagagatggggtcttgctatgtcgcccagcttggtgttgaactcctgagctgaagtgagcctcagcctcccaaagcgcttggattatagatatgagccccgtgcccagcctttattttgtttttaagtgagaattatttttttcttaaacccaggggcagtgtaggtgaaggttaaggcagtgaagatagaacagtcagttttgaaatgcacatagccttcctgagcctcactttcaccacatctgccagtctgcctcaagtctttaagtttccctacaccagaggcagcaaggtgtgcctggaatgatgaattcctttgagcacagaccctgttccatctagagactgatgactgtacctatttcctaggaaaggttaagcaagatcgtgaatataatgctcttcgtttcatgccggcacataataagttcccactaaatgtttaacttggtccactgggggaaggatgagaaggaggatttggagataaatgagacttggcccttgacaattcaggagcttggagtcttatagagatttgacttaaaaatgtctgtgtaactccagagtgataaagacaaaaatgcttgaaaaagataagtgaggattcgggggatggaggaatcccagaggttggccccgtctgagaaggctggaggttagggtaggaagaggtaagggtttgggaaggtagttctaggctgactgaagagtgtgagcaaaagcagaggcagggatgtatccaggtatcagatagtgcacatttagtgtggttacagtaggtgataatttaggaggctgattgaaactgaatttagcctctgccttagtcaccaagtcctttcccagctccacttgctgttctctctctcattctctcctacctatattgaaaccagttgaaaataatggagtcacacagaggcagatggcaataatgtccaggttgtggaacattagctcattgggcttgctaatgcagcacccatgaatgaaatttaccctcttcctctcagatagctcctgcactcaataactcccatttagggcacactgtgcataaagctcccaaccatgaagagcagggaggatctgcctctaacagtcaggtaactcacaaagactggaaggaagtgactgggttacacatggccagtttcttctccaaactcaataattgggtaactctctgcctcctcatctgagaacaagggagtgggagggaggcaaacaagaaaagagaagaagcagtggagaaaggagacgttctgcagtgccaggcttcttgccccacactcttcccaaatgtcaacatagttcctttaggggaaaaaagtgggaggctagaatggtaggacagggccacaatatggaagtgaaaaaccaggggcagtttcctgagcagggaatgatgtcattcgatctataattcagtctggttaatctacttatgcaacaccaattgaaggacacacttagataactcagccttgagtcaacaaatcttgtgtaacactgccaaggtccatagtgcaagaatcagcccccacttcggaaataacaaccacccctcagtgccaaattttggacattgcttgtaaatttcagactccttccctccaagatactgttttagagaatgtcgtagggtaaaaaattccaaggggtaaagacataaattccgtaatactacaatagatgggaggctctaatcaagtagataaattctatttttggaattgtgaataaagcagaaaagattcttggaaatcaggaattgaatagattgatggtacaaatgagagactatatgttgcttaaagaaaacaaaagattgcctatcaggttttaaaatgtgagtcagtagtttatatagtgattcaagctgaacagctatcttggttattaactaaaatcttttctttccccttccattttatatatgaagaaactattaatacaaaagtcattatcaaaggacactggggctaggtttcattacccagcttaatccttaatttcatattgagcatttcatattgaagtgaaacaataaggatatgtttctagagactgatgagacaactgaattggacttggttttgacattcaaagggatcaggtagaggtacttagttgagctcactacttcattttggcaaaagacatatgtcatagaaatgtagtagccatgatggattatgtatctttgaattgggagcctatgacaaattttctccaatgggaagtttcttcagagcctatcattgtttcaacaataattaaagtaatttacagagaatgtgctcatctacttttacctactgttatcttttttccaagttaataaactgaatatattgtatagattggttgatagccttcctgaaatgaacatcctttgcaaacctatctctccaaacccaaatcctgcccaaatttcccaattgtggtagcaagcccaatgagctcctgatacgatcctaataggatcctcttctctggaaatcctcgacagatcacacttctcttttcttgggaacagctttctgtttccttgtccagaatggatgccgttctgttatcctggtcactctctgggccccctccctttgtccaccatgagcacaggctactggccactgatcctcctgggggcactagcctggctaccccattgcttattttacctttgcttctcttaaataccattgttggtgattgctccacacagcaattgttctcacctaagtctgtggataagactcacttagggaggttttaccagaattcagctcatctccctaaatgtttgggtctggactagggcacacacttctcgtgaggcgcttctcatgagtaccccttctcaaactttacgggtatcaatttacttatggcctgcagtgcataaagtgaaagctttctgaaaagacatttaatccatcggtatgaggatgaaaaagacacactcagggcatgaaaagagtgagaaggtcacaaaaagggtgtggtctcagctggagaggaagctgaacaatcctataaaggaacaaaagctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttattctataggcttcagcctttttatgaagacctagcttctactcttgccccaggccctaagcaggcccagacttttcccatatacacacactctctctctaacttatgtgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccattaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtcacatttcgagttatgagcttcaccgctctgctgtctgtctctggagatcatcatcaaacccctttctctgagttgttgaatggctcagatgagttaatgcctatgaaagtactctgtaaacagaaaaataccttcctatttgtaatctcaacaaagggacttttatcatccctaaaacagaacagacatttctttttcaattatgaaagttacatagactctttttaaaaagttaaatgcacaaaagtatgatgaaaattaaaataaccctaatgagtccatcatccagggacatcattgttctaatttaaacatttgggtaatctgttctctttttttaagaagggttgtgtgtgtttattttttttctttttttgtgtgtgtttgtgtatatctatgtgtatttttattctgttttctttacataacactgtattgtaaacattcccaaaatgtaaattttaatcattgcataatattgcattatctgatatatgcacatgcattttgagattttgtgacgaacgattgtgactattgtttccataattaagggttagctgcttaccaagaaaggaacttactttaaaacatggcaggcacacttggccattttttttttttttttttttttggcagtaaaggaatttgaagtatccagttttttaaataaattaatatgtattgaattggagtttagcagtacttttagttaagatctcagttaaggtaaaaaggtcagacctgtagagttattaatttgtagaaaattctgactacagcaaaacatattagcccaagttctctttattaataaaacattagttacagaaatactaaaaaatagattggttggtctcctgaatgtcctgcgttaggtaagttgccttatgccatctggaagacttttttattttctcttcatagaaggatacaatagatttgttttgctcaaagagttcattttctgttgctgggcacatatataatactgtaaacacatttctggatatgacgacataatgatgaagagagacctttgaatattttcttaaatgaagattgaaggagtagtaagctgtgagaggagatttttctactatttcagtcctaagattgatcttttttgtcatggatttatccctttgtctctatgcatttctatgtgtctgctcagcatcttatcttctacatttgccctagttccatccttccttttttccatgcttgtttttccatacacctgcccatccaccctcctgcctctctatccagtcgtccgtctaaccatttctggcaattcttacctccctgtttcatgtatatctctccatttttacctgtcatttatatttatctatttgcctatccatatctacacctgcttgtctgctcactgtctatctataaagttaatggagatgattttgatgaaaacttatgaatttctttattgcattttacactgtgggttacaggggccaaaggccatggggaccagaaagtggaaataaccagagctcggccatttttgtttcatttcaaaatcaggagggaaggtcagaactaacctgattatcctttctgtgatgctaatcaggatgttcttagtataatgccttttggagactgttattttaaggaatgttttgctaagaatcagttgccaggacatagaatgaagagctattgtatagcttcagagtagttctcttttaagaaggatataataaattaaaaataattttcttgaggtcagactaaggaaaagtcaaagatatacaattgccatctctccaaatttattgattttatttatttattatttattattattattatttgagacagagtctcactttgttacccaggctggagtgcagtggcacgatcataattcactgcagcctcaatgtcctggagtcactgaagcctctcaagtaccttggactacagttgtgtgccacaatgcccagctaattttttttgtactttttttaaagacagtattttgccatgttgcccaggctggtgttgaactcccgggctcaaactatctgcttgccttggcctcccaaagtgctgggattataagtgttagccactgtacccagcccaatttactgacttaaaaaaaaagaaaaaaaaaacaacaacccagaacatattgtaacattcttcagggagtttagagacaacataatgaaggtattttcaaggtttggggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctttactgaaaaccatttttcttctgattctgagaaagctgctttgcatttactctctcgtttaattctcccatccttccttcaatgtaatttctattatcccaatttataactaagaaacagagactcaaagaggctaaatgatttgcctaagtttacatgattaatgagtgccacagtttttgtggaacagagacttgtttgaatctaaaactgttactctttgcagtaaaccacaatgaaaccttagctatatatcagttctccactttaaattttatggtaactcaacctctgaaaaggatcctgcaaatagcacagttttcagttcttttcttgagagaaggcagggctttcatatggacatgataaagaagacagctcttaggatgtggatataagattgcatttatgaactttactttagtatttgacagaatggggttttcctcacatgctgctgtgtgtttttgtttaacctaatctgagtctcattaggcagcttgatccagaagacagaaaggtctcctccacaagatgcaccttatgaagcaaacaaaccaatgaaatgcagtaactcccttcaaacttttgtaagctctggaaagccagaaaagacagctattgtaatatattttgccaggccagctgttatcatcacaaacaagcctgaaatagcaatgacttttgaaatcacagcacatttatttacttcttaacttttccataggtttgaaagcttgctccctccctttttatcatgctaaactgtagttgctaacaacattctattctgggtgggaattagctttggcataattaagaatggagatgggggtggataaaagaggttctgccaaaggacttgtcttatatgattttattcttacttttaatctgttttattctttaagcatgtattaactgcctactacgtactcaacactgtgctatgtgggaaaaatatactagaacaagggatggtcaactttttctgtaaagggacagatggtacacagcttagatttgtggtccataaggtgtctgttgtagctactcactctgctcttagataatacacgaaacactcaagactccaccataaacaatacataaataattgcgtgtgaatatgttccaataaacttttattcacaaaaacatgcagtaggctggatttggtctgcgtgccacaggttgccagcacctgtactaaaatgtccctgaaaatagagaactttgttttgttcattggctgtgtcaccagtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttatggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccatagaatggaggaagtgccctggcggaaatctaccctacttaactgcctgtcttcatacgtcccctgttgatgttgtaggagtaccccagcctttatgatggaacagtgtgtaatttagtcagtaaattgtagtcatataaattataataaatgtatcaaatttgtagctactagctttgttgcttttgaatttctgggttggcaaacctctcagagggcaaatagatttaaatggcgtaatagaaaatttgcattctcttgctgtacctccaattcagagtgtagtgtaatgcccagatttgtttgtagactaagatcactggaagggctgtatagtttaagcctcttttttaataatggggggaaatctgaagcctaaaaggtgggcagggacttgctcaagttctgtcaccaaattattttggcagaaccaggagtataatgcgaatgttaagttactaaatttagttttcttttcatggtgccatgccacatgtatcaataaagttcctaatttacatactttctctcccctttaaatctcatagctttttgctcatatacctcttgtgtactgcttaccataaagttatatcttaatatcttatcctgaacgagtagcccactgttatcccaaataaaggctgagctctgtttccctggagagcttaacatatttcctggcacttagcatgtgttcagcaaataattgtagacttgaaatatcttgagcatcttttcttttcccatgtgttttgactcaagttcctttgcagttatattgtcagaaaagtcaagctcttccagaattgctgaaatacaaagataatttctcttaagcttccttaaaaaagttgaattccctattatggctgagacctttcttaacagctcttctgatagttaaatgtcagttgcttcaaaaaagaaatgtcattaaattatcagggaaataaattacatatttatttgggctgaaatattttaattgaccacttaaaataaagataatagcaaaagactgatacatttcctagcttgcacatttctctcaattgccaggacttttttgtttatatctcttaggagatttcatttttatttcttctgcattatggttatatatgtgcttttgactctcccagtgggtgataagttctttgaagtcaatgtacttaaaaaaattaatctctatatacccacaaagcctagctctgtaggagctaaatactaaatatatttactttaaaaaaattgttaggaaaaggtcagtgttaccttgatttcagtgttattttgcagccctcaagtcaacaaccattttactgaacatccagctttgtgcctttctgtgagcttaacattggtagcaggtgtggattgggacataaaaaagtaaataaaacatagttaagttgacataacccataagtataatgtgatgtggaaatctgagataggtacaaataacctgtactagaatctggaggcaggttaattctgacaaggtgagtccagagaggctcacaaagtgtcaatatttgagatgagttttactgggtcttggtcttctatttcagttgctggttttgatttttctcaacgcaacacacacacaaacacacagatacacacacacacgcaaagtgatttgttttctttttataatctctttgactatagacttaagagaactgcctttatgtaagattaaaggaaaagaggagcaggttttattgtgttatttgaaggtttttcagagtctgaaacacacagcgaccgaaagtatttgggatggatgatgccagtagtgtcatgaaacaaagtacgttggccagagagagacatatactattgtaaattaacggtgttcttttccaaggattttctcgtttacctgttgttgtcttcaatagtttaattacactaaatattctcgttggtgcggggagcatagtatggtggaggaagtttcaactttgaagtcagacagttctgtttctgtacctaacttttcacttattgtatatgtgactgaaggctgttgcttatcctctctagggttgtttcttcatccttgaaaaatgttgtgttttctttttcttttcttttattttttttgagacgtagtctcactctttcacctaggttggagtgcagtggcgtgatctcggtttactgcaacctgtgcctcctgagttcaagcgattctcctgcctcagcctcccaagtagctgggattgcaggcgtgcaccaccatgtccagctaatttttttttttttttgtatttttagtagagacggggtttcaccatgttggtcaggctgggcttgaactcctgacctcaaatgatccacccaccatgccctcccaaagtgttgggattacaggtgtgagccaccgtgcctggcctgaaaattgtgatcatggaaagtacctcacagaattgtgggatgaatggagctaatgtttgcaaagctcctatttcagtgtccaggatatgttaggccatatgcctacagagtcaggcacattttcttgaaacacaaagccctttatctagcttaacctcttcccactttagagtcgtgggtgcaggaaatattttgttttcctctttaccgtaaggaaagtaacagtgctagtgtgttgttgaaatgccatgctctgggcatgtgtttggggagagagatgcagtgcgtggtggggaatgggaggtgctcaagagggcatcctctctgaaaggggtgacagccgcttggcgctagctaattattgccacgtggagatgcatcattgccagatttttatgtaaactctttggtttttaaaatgttggcagctcattcaagtatttttaaagcactatgagagatacttcctcatggaagaagaaaaatgcaacttacaatcttactcagtagcatcaactttggctcaaaacaacaacaaagcacgttgtaagtccacactgcaaatggcaaacagaacccgtctaaggaccagatttggcctgcagccctcaatttgcatcttctgtgcatatttttaactggtagagataacagtaaatgatggcaaaacttactgagtcctttgcatgtgctagaaactttgctatactttgcatatatcattcaattctcacaataacccaaagaggtgtctattactattattatcccattttacagacgtgagcattgaggctcaaggaaatgaagtatctttcctgaggtcacacagatgaaatgtgacaggtagctttgaaaccaaagcctgttctcttttaaaatcatacataccagtggatctcagtcctggtggtatgttagaatgattggcgtgcccttaaaaacagtgttgtccaaagtccacccccaagctcattaaatcagaatatctgtgggtgggactcagacgtggctgttttttcgaaagcctcaaatcaatgattagaaatagctgtaagatagataaaatttgtgcctccacatctggcactacctatctcctgtactctattttatttttgagtatttattgttctctgaaaattatgtgcatctttacctgtttatgaattttctacttttaccacactgggatgtaagctccgtgagcgccaggatttagtctttttaagttgtttgttgtatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctgggctgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacacatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctccagggcaaatcatttgttctttctgagcctgagttgttgtttcttcttgttcttcttgttcttgttcttgttctcgttctcgttctccttctcctactccttctccttcttcttcgtcttcttcttcttactctcctcctcctcctccttctcccttctcccttctcctttctccttctcctcctaccctctcccttctgcccttctcctttctccttctcctcctccctnnnnnnnnnnnnnnnnnnnntcctttttccttttcctcctccctctcctttttccttttcctttctccttctcctcctccctcctctccttctccttcttctttttcttcttcttcttttttttttttttttttgatatggagtctcactctgttgcccaggctggagtgtagtggtgcaatccctgctcctgcatcctctgcctcccaggttcaagcgattctcctgccttagcctcctcagtatctgggattatagacgtgcatgaccatgctcagctaatttttgtatttttagcagagatggggtttcaccatattggccaggctggtcttgaactcctgacctcaggtgatccacctgccttgccctcccaaagtgctgggattacagtcatgagccaccgcacctgtccagagcctgcgtttcttctaatatacagtggaggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgtttcattattaataccattgtccttatttctttaaatgagaattgataatacccataacagaatctttcacacaggccaaaaacaggaaaggataaattaaacaaaacaaacaaacacccaaaacctcaccaccaccaccatgactgccaacaaaacccagtgctgtgaggatgcatcagctttaagatctctttaagtcattgtgttctagagaaaggggttctttatttgtttctatcaggatagagtgagtttttgttaaagttgtctttcttttttttttttttttcttcttctggaagactgacgaagttggccttttgggatattacaagaaagataactttgtcttctaatgtctgcagtgatatgaggcaggtgactgtgtgtattctgtggtgatccatgttcacaaggagagacaggccaaggatgcccggttgatgagtgcgctataggtgcttgggagtgagaaggcaagaaagcaaagtgaacttaaaaaatagctagccagtggaattgagggagaaatgctcattctttgctgacacatgaaataattgttgagggagagttgctcaatctttgcctacacattgaaataattgtgttgaagagtctatgaaaagggggtcaatagatttgagttttcatcactttggccaccacctaattatagatggcctccactgtgaaatatgtgagttgaaatagatttttttaaaattcattttctggactggcatttagaatttgagtttattcaatccttgcttcttgggcagttagggtgtcaatggcaataggaagggtagctgaggccagagtggtgggggtagatgttgggtggaatgtgtgtggttgagcagagcattattattattgctattattattttttaaaagaatccttatagtaaagagagccaacattgattgaatatatgttccttgccagaacttgggctaagtgctttattataagttatcttatttaattttcacagagacctgttgaagtgtaagttttagctttctgtttcacagctgtggaaactgaggtgctgaaaggatgaagaacttccaaaaagtcgaagatattaagcagctgtattagtcttcagatcctgatatctttctcatagttattctgatatgccgtattaagttgcagaattgaggccgggtgcagtggccccaatttttattttttagttattcttattttctaattattttatatgctctctctctctctctctctgtctactgtcaaatcccggcactatgggagtctgcagtgggaggatctcttgatgccaggagtttgagaccagactgggcaacatagtgagaccccatttctacaaaaaaatgaaataaaacaattagttggtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttctttttttttctgtttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttatctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttgcttattgatttattacagttaagaaaattaacttgtagtctgtgacaggaattgtaatgctttaccattttgcatttcttttttaacttgcagattaaaataaaaagttttatatagttaatccttttttgattttatgtttctttgattttgtgtgatgcctagaaatgccttccccactttgtgatatttaaaaagaaatttccaatttttcttctagttatttcttctgctctttctcaaatctttgaaccattgaaattttattttggtaaaaaatgtgaggttaggatttattttgatatttttctggatctgcatttctaaacactgtttattgaggagtccatctctttcacactgatttgaaaagctacctttattgtatattaaatttcttaatacttaagtatttaatacttaagaacaccgtggaatactatgcagccataataaaggatgagttcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggaatgctcataatgttccctgttactagtgacattggctttcgatttgagaaatgtattgtgttgaaaagtatccacacttattttgatagtgttgttattgttgttgttttaattgagactggttgttaaaaggttatctagcttttttttttaaagaaactttgaaagtaatcatatattctaaaaaaattttatgtttttctcttttgtcctgtaaatttgctgtaatatatgaataaaattttcaaatatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgtgatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcctttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattattttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaatcatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggagattgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctgggggggagcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgacaggcccaacaatccttgctaaggcacagacttgtgtatttgctgatccctgaggggaaagctgtgattcaggctctgaagtctaagaattgcagacttagtttcttgtctcccgatgaaactgctaatctgggtgccaatggtgtttctgctacatggacacctgcccacacagcatgattagaaattataatgatgacgacgatgagtcttccaggacacccacgttctttgcaagatatttctgctaatcgtttctaccagaatcagttggaaaacttttttttttaagttttttttttttctctgtatctaagtcaaccaaaaatgctggtctaattcaggtatagattaaaggtttgtcctcaccattaatggtgtgttattattcatgcagggcatcctagaaccttgggcacatagtgtaatggaaagcacgctgggccagggagatgtggattcaggcttgagcagtgccaaaaattttcgttatggccttggtaaaggtgatttcccatctctgtgactttgtgtctccttctgttaaatgggcattcaaatcttttgtacctaacttattagggccctgataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaaatgaagctctgaggggatggtgcacagggagaaaagagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaacaacaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattcttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccgaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataaaaattttcaacaattagcaaaaatgtggatttttcagttaccaattccttatttggcacagttggtctttctcatcttattcattcattcatttatttcattttatttatttacttttaaaatacttgtttaattcacctttcttgctcccattgagccttttaactaatcaaatgcatttgaaatgctattaatttatgataacagtaagacccaagacatcactttatgtaatatcttgtattgtagttcattgttgtcagctctttttctgatggggttttgatttagctggaggcagtttaagggtgttcattccccaataatgtttgtctgttgaagctggtgagctagactaacagtacaaagagttcctgtgtacccttcacccagctttccctgatgttaacatcttatataaccaaagtatgtttaagcaaagaaattatcattggtgtaacatgactaaagaagtgattatatcttttattggcagttttccagtttttccactaatgcctttcgtttttttcctagatctagtttaggatgctgctgtgcatttagtcatcctgtcttctttgtctcctcctgactgtggctatttctcagcctttccctgtttttaggaccttgacacttttttagtgtaacggtcaggtattttgaagaatgagtgtcttgcaacttgagtctgactgatgctttctcatgattaaattggggttttagatttctgggaagaccaccacagaggtgaagtacgcttctcattgcttcatatcacagcgtacatgatgttaatgtgagttattactggtgatgttaattgtgatagtggccagttttgttttattttattttttaatagaagaccagttgtctgggactatacacactccaacacatttgcaaattggtggcaatgattattgactagtcctcaaactactaacttcatgataatggaaagccgaaactcccaaatcacatggacctcaaagttcaattagaaaatttggttaggacctgacgacaatgttgcgatttgctacagcctgccctgcagtctcaactctggggtcccctcagtggtgagctcagtcacagtgctgcttctgtgtatacttacccagtaaacaacccaggcattggggcctgtctcagaaaccacatctccaatagaaaggagaacacttgggaaagcaggaaggagtaagaaacggaactcgcccattcctgacaactaatccttttcctttctaagtatggcttagtggatgtcagccattcactgttcaggacaggatagggatgaggagagaattctttttcatttgacaaggacattgaattttccttatccatggatcaagactagaaggtatggagaggaaaagggcttctcatctctttctttcagtagcttcatgcactgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagcgtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataatttttttcaatgagccttttgaaatgtggctactagaaaattttaaatggtgtatgtggctcctatgataattctattggatggtgctggcttagagcctgggaagaacatggatcagagtcaattgaccttgtgttctcccctgagttctaataatattgtcattaaaaggagaagcttcaacagccataattttcattttaaaaagtctaattcagaagaattggctcattttatattattgcttggactggagaaaaatctgacatttggtattttcataattgagaacataacttgctgacttaaaaaaaaaatcacaacattttgtgcttggccttaggtaccagcctttgagctctttgaaaatagggattgggtctttttctctttctaccatcctttttcccccaaaaccacacactaacacgtagaagatggttaactggcatttgttgaaaaccaaaataactttaaatagagaaaactttgtgaagctaccttgtatttatggttggaagagtgaaatacctttataaggcatcccattttcttaagatagccagcaaaaatgaagaacattgatccaagtgtttatttacttattgatttaattaccattctcatcaggtgtccctgtcatctcagcttatgataaggaatcttttcaagatgcttcacctcatcactctctaggtaaagggggacagaaaaggatgctgcttacatatacgaatccccatctttgctcagatattatgtctaagggcctaaggactggataatcttattttttctgtggcttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttagccatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgttcgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaataatcatcttccatcttcactttagaggtgggggaaaagggcattagagtgattgtgtggtaaaatccactctaattctagctgtgagaaaaagagcagtgaaaatgtggtaagcaagtgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttaggcagaatggaagtggaggtcatagattttagggttttctcctgggattgaatccagctgaagcaggaatgattctgggtgagctatataacgtctctgagcattagtttgtcattttcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccactcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcagcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctggagagatctaaaattgttggtcagatcatatcacacccctccccttaagccatacggtggctgctgtagtatctgcagaaggtccctgacttatgatggtttgacttacaatttgtccacttcacactgagtttatctgggtgtaaccaaccccatagaaatcaaggagcatctgtagaaatgtttgaaagaccctttcatggcctgcaaagccctgtgagatgactctatgttctctcctttttttttctttctttattttttttgagatggagtctcgctcttgtctcccaggctggagtgcgatggtgcgatctcggctcactgcagcctccaccttctgggttcaagcaattctcctgcctcagcctcccgagtagctgggattacaggcaccagccatcacgctcggctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttatagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgattatatatttatattttttgtgttcctcttgttttaggatatcagcttcttgagagcagggtccatgtttgttgcatctgtatctccgcctgtagaagattctctggcatagggatttttgtgcaggaagtgtttattcaggaactgaatggatctcagaagattatcatttgggaatagatctacatgacaagaaagaacaaagagtctctctcattctttttcccagatatatcccgggagaaaataccctcgactttttcttatctttaatctgagaaggaagcagttgttggaatctgatttaggattggctctagtggccctgtgtgcagacacagatcttgggattcatctgaccatttggggagagaggttcttgaggggcaccttgatgataacgagtctttctaaagctttaagtttggcgtttgaggtggttggaaataccaggtcttccgacttttacgttctttgtgcgcacgctggtgatgtgcgtatgtgaacctttattattatggactcagccagcagtaaccatggtgagtagacctatcacacagcatttttctgagtcagtttaaaatgctgacaattaaatataccgtactcttttaagcaatccatcagtctctcttgttgtcatggtgaccggagtatatttagaaatgtgacaagtacactgagttcaattgcacttttgccaaaacatagttttgcagctaaaattgaatttcctgattgaagatccaagtgctgttaagggggcatgatcgtttctatacattattctggaagtataacttaacgttattctgttaaatccacagttacgagtcttatcaggtattgatagttaaagtggttgtacttaaagttgatgaaataaagtgaaataaaagtgacatgatgctttttctattgaaaatgaaactgggccttactaatataactagtttaatgattagtttctttatatatttataaagacattgtaggtatgtacctgtctgttcttcagaattatatttctaatttaaaattatatatcatggagatcctcccctgtttcctgcttgtattctattcttagtattgtgagggcattcttttttctttgggtctgacctctgtttgataagcattcttatttttcctcaatctcaattcttctggattttaaatgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctgactgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatataagtggagcagtagtggagtctgaattctgatacaggtcctagtaaccactgcctgttccatggaaggcacacagtgagtattttttttactgaccagtggcctcttgtatggtgacatcatacagatgtttcagtgtttccagaggctcaagaaagtagcagctatataaagatagacaggtagcagcgtctgaaagtagagatgagctactctttatctttcctagtggtttagagccaaagtagattagtgctagggagagagggaacataagtcctgtctagttcagtggtttcatctctgaactcctttatgttcttaaaaatgagcttttgtttgcatgcattatgtataatgatatttaccatattcaaaaaagtaagaaatgaaactacaattttaatgaaaaatatttgtataaaaaataaatatatttgtgaaaaaatagtgacaaaagtgggagctggattctgcatttaatttgttgtgaaatattgttttgattgatgtttatgaagaaaatccagcctctcacagctatgtatttgaaaaaggaaggataaaaagtaattgtggattttcttctttgatactataccaaaacttgacagttttcacattacctaaagttagtagtttcttataggttagtttcaatgtggaatgtgaaatcatattaatggactttttataccctattatattaaaatccattggtcaaattttcactttgattgagtctcctatgattttgtaaaatcatgcattggtcatttagaaagtcgttggtcactcacttattcagttcttgcaaacactgatcatttcattctataatataaaaagtcatcttcattaatatcactgctcattcatcaaaaaagcatttgaaatattagaaaggtgtcaagtgcacagtagtagatgtaaggttttcaaaattctgatttttacttgaaaacatgaattttatttttggctacaaatactgttgttttccttgaaacgataagctctcttgctttatttttgagaaaatctccggcaaaacccacatttaaagaaccatagttcgtcagtcattgtttcaaataaaaatgatgttccatgaaaaaagcgattggttagcagctgtcaatttaaacagttacacaaagtgcatttcttagagacaatcatcgtagtttgatcttcagcaggtgtttcatggtacttcccagaggtcacacagaatgtaaaaaagatgtgtactcaagaatattaaaaatatgtctactttttgattatgctaacattttatgtgatcaggtttctttagtaaaacctagtcagacagtactcaaggactgagatttaataagattgatacgtttcaatgcattaaagagagtcttaagtgaaactggctccctgtcccgcttattgtatgtgtcttacagtgaaatcactcccttgattcactttaagactgcaacagtttttttacccactgttatttttgtagcattaatgtaaatttcaacacagggaaacggcttcttagtatgattatgaaaataattttgaacttgtggactcttgaaaggtctaagggactcctacacatgtatgggtcacacattaacagccactcattgagtccagtcccttcatttgacaggagaggagagtggtggaaagatgtgtctaagatggcagcacaagttagtggcggagctgggacaagaacctattgttacttaactcttctttcttttcttttgatttcctgctccactttcaggaatttaaaggtaactcaaggaattccaaacttctttgtcagagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaaaccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactataacccatcttactaggcaaactgtgccctttgctccccaattattctctattaaagtttcttgctctccctccccatccttctctttctctctccctgtctcctcccctttccttctagaaagaggttgcccaataaaacttgctcttaactttgcttttggttatgttgatattttatgtgacttgttttcttcactaaacagtagtcagtctatgagactgtattgaagaatgctgagaaagtcaatagaagtggacttagaatactacatgttcttttaaatatgtctcttatgttatagagtaactttttggggagctaaggtttgcagacaatgctgcgtgtgaacatatgtgagtaaatctgataagctgtggaaggaggcttgcaaactttcaaatgtattgtgctttcattttcaacttaattggatgttcttttgcaaggtcttgtttttttcctagttctcattcaccgttcagttgccttcccccacctgtgagctttttgagtcaaactttgtttattagcttttttcctgattcttctttcatgtctttctttcctatcccaaagtatgatttgattagacctcaggttacccttctgaatgagctcttcctcaatcctaggcctggccaggcatggtgcctcatgcttataatcccagcaacatggtaaaaccttgtctctacaaaaaacacaaaaatgagctgggcatggtggcccatgcctgtagccccaactactcaggaggctgaggtgggaatatcacttgagcctgagaggcagagattgcagtgagccgagatcgtgctattacattacagcctgggcaacagagggagatactgcctcagaataagtcagtcagtcagtcagtaagtaagtaagtaagtaagtaaataaataaataaataaataaataaatacgtaagaatcctaggccttggtgacttactctttttaattttttttcccacaaaactgatgtgttttgcccttactttcaccagaagaccatttagtcttcttattttttcttcctgagacttctacatttgtttttttctagccatttatattaggctcacaaattgcatagtgatagctgattgaccccttcaaaatgcctgttttctgcctccttgtctcagcttcttgaggatggtgctatctcatgcttggtgtatcataggagccccatggatatgttgaatagattttgctcaggggtctcctctttagagagcgttcttcacatttttatctggagatctgagcttttatgtatctcccactattgggctgctaaatctcccaaacccagaattgcaatgtccatcttttaatgcagactcccagccactgccaggatatcacatgtcttctctgacagatggctatgtagcctccacttgaacttttgcagctctttgcaaggcaatttgttctactgctggacagcttcatgtttaatgtttttccttgtattacactaaaactgattttcccattattttaatccccatatttctagcattgcatagtttgaaaaagtataatattgcttacacatgacatgtccccagatactcaaagatagctctaattcccccatctgcctcctttcctcctttagaccttctcttgctacttacatcccatagaaggctttggatgctcatcctcttggtgctttccccatttctacatcactttctagattttggtcctgatgtccaactctaagggactccctcaaggccacattttatctctgatggtactaggagcagtatgagtaaatggtatgtgtatgagtctgaaagctgagatatgaattctggtgcttattagatgtgtgaacttgattaggttacttaatctttctaaacctcagtttcccaagatgcaaaatgaatataatattaaattccaagactatttttaaggattaaagatataaaatgcttagcttagttactaaaatatattatgtttagcttgatcaattatttcatcttttatctatccaacaactccttttctttttcacacatgtgcacttggttttaaaaattatttcaagagttcttccctcctcctttccttctctcttttcttctctctttaaattttataacgtatatactcttataaaagttaccatcatgtttagatttccttctaaacttttatatctagaatttaacatgattttcttgacaaatatgttttcttctatgtgaattttcgcagctgctgcctacatttctgctcatgtgtttagcctctgttaatcttcctgtgaaaattgtgacttcatcctgccaatgggttaatgatgactggctcattgcatgtcacttaactcctcgctaaatgcttcacttgatcactcagtaactttacaatcatttagttgtacaatacatttaaaaaaattaaaagttcaattaatttcaatttcacaaacacttactaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttcctttactactctgtgccttagctttgtcacttgtcaaacgagaatatactaggaacagtatcagttttgcctcactgagctgcagtgaagaataaaatcatttatctgtgtgaaaggacaatgcatacagatggtaacaattataaatattaaactaagcttttgagtgaccggattggctacttctcttaaagtgagttctgcttaattagttaattcttacttattgccccaaactttctgagatagcttcatgtttttttcctctctaccctgaagtgcctgcttgcaagcactatatgctcaatgagcatttgttgaatgaattttttaaaagtatttaccttttttgcttttattattattttaaattaacacataattgtacatgtttacggggtacagtgtgatattttgatacatgtatacaatgtgtaaagatcaaatgaaggtatttagcatattcatcacctcaaacgtttattatttctttgtgtttggaacattcaaaagccactcttctagctacttgaaaatatacaataaattgttggtaattatagtgattctatagtgctgtagaacactagaactgactcctcctttgtacttttgtatccatttaccaacctttggctatcctccccctcctgctacttttctccacctctggtgatcagtattttactctctatgtgatcgatttctttcagcttccacatatgagaaaggacatgtgacaaataactttctgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgtttttttttttttcctttggatatatgaccagcagtgggattgctggatcttacgatatttctttctttttttttttttttttttttgagacggagttttgctgtgtcaccaggctggagtgcagtggtgctatctggctcactgcaagctccgcctcctggcctcctgggttcaagcgattctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagccaatatttctaattttagtgttttgaagaacctctatactattttctataatggctgtactaacttacattcccaccaacagtgtatgaattcccttttctttgcatctttgccagcgtttcttattttttttgtctctgataatagctattctaacttgggttagatgatatctcatggtggctccattttctgtatatggatgtccagttttcccagcaccatttattaaagagattcttcttgtttcctttgttgaaaatcagttggctgtaaatacgtggatttatttttgggttctctgttctgtcccattggtgtatacgcctgttcaagaactatcttgaataaaagtggtaaaagtgagcatctttgtcttgttccagagcttaaaagaaacctttcaatttgaacgtgtccagtatgttgatgactgtgggtttatcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcagagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtgattttcataaaaaaagacttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagcaagtgcagtggtgctgagttctaggtgcaggtgcttgaagtggctgtgggactagagtcttatgcccaggatcttgccaacctattgtgacacctgggtcttgggttacaggttcactctctgtgctagggttggatgtaggcttcccacagagccaggatttgtgactctgagacattactctacaaactcagtcccagctgtgagtggctcaactccaggaaagaaggagtgcagggaagtttggacccagagagcaggatatgccctgatttggcaacatgagccagtagggttcagtggcaacttggatctcaggggatgaggcaccatgtagtagtgattcttgacccctggatgttgggactcagcagtaccttagactctgtaagaccacatgcggtagcagtaccccagaatggcaacatacagctgttacttgtgccctgagtgggggcagagtacagcacagtggtggctgtatgccacagggagaggggtatcttagcagctctgacactaagcaggtagaccagctccagggaaacagcgtattagagttgttttccctttaggctggagtgtctcagatcagcccagccactgctcagttttccaaggatgtgggttatcacatcagctcagctttgggatttacagctgctcagctgagcgatggcaccaattcaccaagggacaatatgccacttcagctcaggcctgggggacatgacttttctaggcagcccaggtaccatttccctgggatgaagggtgctacttcagattaagtactggggtgcgtgaccgctctgagtggccaatgtactgttttcccaggaggcagggtactgcttcagcactggcctgaaggggagggtgaaaggtagattaagtgactctaccttcacctgggcccatggggaagagtggaacagttgctggcagctcggcttggggatgtcgggccactgggttcgggtggttcaacggtagcttagccttagtgatggagtgtcatagctatgcactcccagagcaagagacactccagccaaagctccatttccaagacggcatagcgcagtagctgcgcaggccacagagggcaggtcacactggttgctctttttcttggggaagcacggctatgtggacttcaggcaggtccctcagctgggacttggctcctgtgaggactacatgagactccatgggtgaggtctgtagctgttcaaggtgttgatggggcttgctgggatccttttgtgtaccattctaccctagagagaagttcctccctgtttccagcagatcccaagtgggtgatgggtggtaaagaccaggtgttttgtttctattctctatgtggtcattctgagtttcttgctatccagggtttctgttacttctctgatgcagtctggtacactgccttagttattattttttcttcttctgtttttagttcatctttttgtttttttctatatagcaatggggtttccctatgttgcccaggctgctctcaaactccagagctcaacagatccactcaccttggcctcccagagtgccgggactacaggcacgaaccatcgtgcctggcccagttatttttgttaaagtttagttgttgattgttgttgtggctgtctttgtgaaagagacgagagctaggggcttctggttggccatgctactgatgtcactcttaaagtacttatctttaaaagtccagtgctggagatttgtaagctacttatatttctgctcagaattcctaaagtctctcattttatttctagattatacattccattgatagagcccttataaatataacattaagaagttgagcattacctttaggccaaagcaatttacttttaaaaaatctgattaatttcaacacaatcaaccagatgtcagaagatttcagtgcctctgatagatgctgacaggtgtggaaattaaaatcagagagggaagcaattaaatcctggcaaacattactttaatgagacaaccaaatcataagctatggaataccttgtattcttgataagtatcttagggtggcatgagagtgcactttaaattgtatgtggtatttgatgactggaatgcagggcagtccatatttgtcatctaattcctttggcctgatttaacatttcagttgcttctggggacagacttctatgtttaaaacattgttttattttaataaatgttaggttaagtaatccttttactactacctctgttgccacatgaaacttatgaaaatgaccaaattattattggccttttcgcagtggttttgggataactgtgaaaagagaaacacagaatgtgtattttatgcaacttctaatcaaaagatttgataattacagcactaaaaccagaacccagttcctccatccccatttcattattcttttcaatatgattccccctattcggaatgaatatcttggacaccagggtgaaagaggtaccagtttattgacttagtgggagtttttataagatactcttatattgcttattgaggtactaaagcacttacaaaatatcaagtattttgagttagctttacactggttcaataacacttagaatttttgttcataatactaagataatcatcttagggatggttacattttgttgtgaggtgtggtggaaaattcaaaggacaccatggtttgtgaaaaacccattgcagctgatctctgcacttttcatttccatgtcattccattttcttctgctttttctttaccccctgttattttcttgcttctctctctttattatcttaccttcatttactccatcctgtttttctccaaaatatagttgcttctgtaaaattgcttctgagggtgagcatatttttgaggggagagaggatggatggtttgacaaaggatgcagacatgtcaggttctgggtcagcagttagttataaaatacacagaggcagccaaggataactggcttcattaccaaaaggctagagtgggatttgtcagttgtcccagatgtctgtatggaattatggaaaactccattgcattatgaaacactcaggagctactcaggacacatgccactcaatccacgtgaagagggctggtgaacttcttagctagaaagacttcagctttcctattgcttaaaatgagactgattggtgaaggatttgtattagtccgttctcacgctgctataaagaactgccagagaccacgtaatttataaagaaagaggtttaattgactcacagttccacattgctggggaggcctcaggaaacttataatcatggtgaaaggcaaaggaggaacaggcaccttcttcacagggcggcaggaaagagtgactgccagcaggagaaatgccagatgcttataaaactatcagatctcgtgagactcactcactatcatgagaacagcatgggggaaattgcccccatgatcggattacttctacctggtatcacccttgactcatggggtttacaattcaagatgacattttcggtgtggacacagtcaaactgtatcacactcttcacaaaacttcactggtacagacttgcgtatatggcttgtgcttcgacactttgcccagggatgttgcatcttgaaactttcctggtgagatctgagaaagtgtttatggtaacactgcatcaaacactccttttgccttagcttagtaatgtgtcaccttctggttagaccacagatgtgaagtctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaaggggatggtttgagacataatggtcattgtgatttttcaagctataaaataaagcatgatgttaaaagatgattaatgttttcatttggtggtagatgacaagtttcttgcagggcatctgatcaatcatgctctttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaatttgctttgttcttagagtctggtggaaactccaactctctgaacctagggcatgattatgggcacaaagttgaaaatgatgtgtgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatacatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctaggaaaaactgaagtagaaaggaaggattactggactagcaggcacaaactttggctccaaattcatgccctgccagatactaaactgtgtaatcttgggcaaattactttccttttgtgaacttcagtttctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtagacactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctgggccacacagacgattcagatttaatgtgtatgtatttaagtgtccataaaatgcaatggagtagaatgtgcttaaccattattttattgtatcctcaactagtatgtggcaggagggctttttacctggtttcctaacccttgattgagcgcatttttgactacactatactgccagtgttacctggctctgaaggggccaaatatttatggctgggtcagtcactctctcttagctgccaaacaaaatcatctcaaaaagctagaatccaaagccacaacagaaaaatcctaagaacacagaaaattgagttagtcttttgaaaccttgcatccattgtatctgaatgccactctcctgggggactgttgggaatgacaccaatccttggcagaagaatacatttgtcttgagtttgccaagaaaatggaggccaatggagaaaaaacatttaaaggaagcatcatagttgtaaaatttaccagatgcgatttttctcctaaagtcaacctgctgaatctgtaccttctaatgagctctactgtgttttatgtaatgtaacttaaccaaaaagaggtgaagtagtcaatatgtagaatagtaactttgtagaagatttgatatcattatttagagtactatacacatgtattctgctgaatattttgttaattcctttggtatgttatatctatgacctcgaactgcaaccatgacttcagttgcacagacctttgagaagaataaaattggttggtattgccccaaatttgtaggacttagaaaatttagaattgagaggaaattaaggtgtcaggtttacatgattttcaaagctaatatcatatatatataataagaacacgtgcagacaaggtaggttatgtatggactatgaaatttctgtaattaaaccagacataacagccacttaagttatttagattttcttctcattcctacaaaaaaagaacattgtttttatttttattattatttatttatttttcaagtggaatataagctagtttacccaggaagttttttatttatttatttacttattattttactttaagttcttggatacatgtgcagaacatgcaggatttttacgtaggtatacatgtgccatggtggttgctgcaccctatccacccatcatccaggttttaagcaccgcatgcattaggtatttgtccttgccttgccctccacccatcaacgggccccgatgtgtgatgttcccctccctgtgtccatgtgttctcgttcaactcccacttctgagtgagaacatgcggtgtttggaagccatcattctcagcaaactaacacagaaaaagagaacattgtttttaaaaaaggtagtagcaaaaaatgtaagaatggctcctgtccaccttttatttcttttctagtccacaaaataaccctgcaaaaacttatttctaatgttttatttttacggataaatatatcagaaaagaatgtactgtagatacctactatcatagtttttgacagctctgtgaggcagagatctaacttgttcatttagaaactgcagttatcacactaaccttccctccgatgccaattgttaaatattaatagaataagctttgaaaagtaattaactgtatcccctgtccccacagaaacccatcttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtacctacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctggtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctcttatatatgattttatttcctagctagtcccttctctctcctggtgccatgtttccaaaatcataggacagtcctatgactctactgcacagccactgtggaaaattagttatttttctgcttagcttttgcttcttttacataccagacatgcagttaatgacttttattatatatactgtaagaatgggcatttatacaccggtagcggtagtcccttaccccagcaacttgcaattccttgttaggaaagaaaagctgttttcctccacatttctttactctgtgacattgttccctgatctgggtcttatgagaggatctggtaaacttcccccctattaagaccgttaggaagaggtggatgcttcttccattatttgatttttccagagcaaatcactggatctgtaaaggagatcagaatgtcaaagccagaggggacttcacgaagtaatctaaacaaattatttcatgtcacagatggagattttagtgtctgggagggaatctgatttgtctaaagtgtttttgactgatcttggactagaattcttctgactacatagttgtatctttaagtagagaaatctttttctataaactatcctttcacttcctagttcttaaaaggccattatcttccaggcaaaaccaatttcattttcagcatggggatgtgagatgtccttaaacataaatggactccaggtatcttcattaatttcatgaagacatggcacagagggttccggctaccttctgctttccgtgtttattaaaagactgtggattcccttgcagttcttcctgtaagaggttgtttgacgctgacatcatcactctcctccacccgcctcctgcccttttctgaatcagtgaattataggaatctgagaatgagctcctgtttcctgcacattgttggggaacattaaaaaaaagaagacagatgagggatttataagcaagaggacagaagaataatagccaacacaatgaagtctagttcaaggcctgcgattcccaattgctgggctacacagcattaatagcagtgtctctcaccctttcagacccttctctcttatttcagacccttctgccttattcttgtggggatgggctgggactgagaaacagctagtataatcattgccaaaatgaaactcacatgtacatgggggcttccaggtctggagaagagtgtagtaattgttacccatccgatagaaggtgcttagagaccactggacctaagcacttacctggaacctcacagtacagaggttcaaagagtagaaatcagttgactgagtctgaggttcaaatcctggctctaattaatttgctatgagtttagtgaatgcctaactttcctctgagctgcactttctccatctgtgagatgggaggaggagggtggcatagatgatgtcaaaggaaccctctgattttcatgagtctcagatttgcccaaggacctgcagcgaatgtgcagccaagccagatcttgaattcagagcccctttttctggtttgagatggtcatcattataagttccactacccatactttccaaacagtatgtttgcagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccatgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttgtcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtagtagctgggattacaggcatgagccaccacgcccagctaattttttgtatttttagtagagacaaggtttcaccatgttggccaggctggtctcaaactcctgacctcaggtgatccacctgcctcagcctcccaaattgctgggattacaggcatgagccaccgtgcgtggctgaaaccatacccttttaacaggactataccagtgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttcggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattactcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatctgagtcctcgtgtgtttaaagggattttttaaaattcccatttgataagtgcctggggttgcctctggagttacacagcgctgtctcatcaatctttctgccatgctttcactcagacattactggctgagtataaactcggtataaacctttgctgtaagtagcttctgtggctctttctttccagatgcctcctatcctctgcaataggttcagtgggcctgccccatggatggcacgtatggagactttgtctatacaacattttaccacagtggtaaaagcagtagccgaaaaggtggcagcactgagacctgtttgctccatcagggactctgtctgaggccctcggccagctgttgaattgctgcactgcaaatttcttacttgtaaaactggaatgataataccagtgctcctgagctcacaagcatgctgttcatccaatttgcagtccatgccctttgctcttcctctcctttccttcatgcctcttctcctttgctgcatgttcagctggtctagtaaaaagcttgatggatttggaggtggctgaaaccattttgcttgctctggggattgcacacttctgagcttgtcagaggcaggcaacatggcatgttttagaagatacttggctgagtgtccacgaactgtggctctcagaccaacgtgacttagtaatcatttactcaacacctacaagcaaggtagcttgctaagaaattgaaggagggagctggcgggtctgtggaggtgagtttgattcagggccagtcaagacttggtgtgatgtgtgagctcagtaattatactttgagagagacagaatttggagaactctttcctattggaggtttcttatagaactagggacaagagctggctttgaaagattattaattggactttgataagatattacaaggatttgaagagtaagtctctgtcaggcaaaaaccagcttgcagtgggactcggaagcaggcaaatatcaggcatggctgaagaactgggcatcaatcacagacatgtgtagctgagagaaatcacttccttttggtgaaccctagactctatctgcaaaatatgagctttgaacaagatagttctcaggaagcctcaagaactctagctgaaattctacaaagtctcttatcacacagccaggttatccacttagcaaaatcctggcactagaatagcagcaatggagcaaggcctgggacccaggtgtcctgcctctattttatattcttcttactgtccacagagcattatgatgaagataggtggggtggacattattattctagtttttaatgtatgaaacataggatgttaagggaatctaagacataaaacgaataagagatttaactatcccagatattgatcacccttccaccacagagggccagctcttataaaatacaccccttgccattttgcctgtgtgggccttgctttcctgcctgaggaaccagcacgtaccccttctcccacgaaagtcatccctgtctgctctttggctctggaattcagtcttagcaatggactttgttttataattaaactttattttgtattgccatctttccatgtttccacccccatctcatccctcatacatattttaaaggctttgaatttaaggattactttctgcttctctgagttccctgtagctcctggcacagggccccagacatagtgctcagtagagaagcaaatgactatgttctgcaatagtttttctctctgcctattgcttgtttctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgataggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacgatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcacggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatccttattttacaatgaagaaaaaaaattcaattgactgctcaaatttacctctaggaacaggtgatggagatttgatttgcatttagatcttttgtctccaaatattgtaatgttacttctgctttcccccactacataccgaagaggtcttacttcattgacagtggttcagccttctgctgaggagtcttcagtctttttatgttgtaatctgcctccttatgagtttgggaaaagaattatggggcctcaggtttaaatgctgttatgctttgggtaacactttagctgatttgttttcagtaaagccagaaggaaaatactgcatttctgtcttctttaatttccttaatttgaaataagccttgaactagtttgtaagactcctttaacttttaacaaatttaggcacatatgtaatataaagaaaaaggcactctgccctaaatgaattgactaattaagctgagaacaaaactagaccacttttttttttttggtttcaaaaaaaggatgcaggaatttttaaatgctacagctaaaacccagattttgtctgatattgatgttctgtaggttttctcaatatttgccatattcattagatgacattcattatactttcctaacttttataggatttagatgaggtttgttgataacattctatattctttctgaaaagaaaaacacacacacacaaatgtcgagcagtcttctttttttaatgtatattctcaggaaaaacaccattgactaatttaaatttcagtacggaggcaaagctgatctgtagtgaatgtaacatcttgttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgttttttcttttttgtttttagacagagtctcgctctgtcactaggctagagtgcagtggcgtgatctcagctcactgcaatctccacctcctgggttcaagcgattctcctgcctcagcctcccgagtagctgggactacaggcgcccgccaccacacctggctaatttttgtatttttagtagagacagggtttcaccatattggccatgctggtctcgaactcctgaccttgtgttctacccgcctcggcctcccaaagtgctgggattacaggcgtgagccaccgcgcctggctagaaagaagagacattttatgtatgatcgtcataatgattttgtgaactcaggtgtagtaaggtaaaacgccctggtaaaatcacttactgggacttttcagaatctgtttagaagtcattccattactcttgaaatccctctgctttatagactttctgagaaataaggaaagtccatctgcctacttgtcatagaaatgggtacttcagcagtaaaatagcctgtttacatactggctcaaactgtcaatgtaggaaaaggtttcgtgtattataaaatgttacagagctagaaaaaatatatacaagtaatatatagagtgcatatatatgtacatatatatgatctgttccttgtcacaatatttaacccaaagtgctatttacagtaatgaatcaaaatgtcagtcttaaaaatatgaagtgtcaaagtgttcccacgttgtagaaaagtttgatgtgacagtttgttaatcatatgactattctatcaatgtgtctcataatgtcttttgctcaacactctcgtaggctcctcacacttttttcatgaattcctagcttaagttactaacccaaggagcacatttgagttgcgtgtctcccacacctcacacaaaggcggctatgttttgctgtacttaaaactgaatggatttcacattattttagagtggtttgattttgtgcctgacgcatttatggatagtagcttaaaaaatttctgtaattttgctgttttcactacagaatcatcaaatgaaactttaacttatagcgcggatgttttttgtttctccaaagtttcccaagatatcagatgtccttatttgctagtgcccattcgttgaacttggacacatttttgaatttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtgacaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaaaaaatcaaattgaagaaaatatttttcatggacagaaaacctaccctaaagacaggaaagaaggtgaacggctatttcactagatgctgaaacatcatctccaaagttcctcaggaatcaaactatgggattagattcaactcttttaatagctgaaatctagaagggagagagtggttacgtctatagttttatgaatgatgctgaactctttctcacaataaaatgctcttctactaacaaatttaaagacttgagcacccagaaacagcagttgcatgccaagtcaggaatattctttttttaagtcacatgtcagccactggggatgcacccgggtttaggctggaggttggagagggttcatccaaaatccatgcacaagatatttatccaaaattctggagtggttccttgttcattctctgaagaaattggtgagataaggcaagcatcctaaacaaatgttgagctctaaaaatacagtttaaataaaacagaaagcattctgagtatagttttggccaaaatagaatagtataataaatcatttggctggagggtatgacatgagaataaacaaaaaaacagcatgtttgctatcttttctgtttattttacttatgcatcaacccccttctgcctccttttactccttgctagagtgtggaaggatcttgaattcagggccttgtctgtcttgtttttcagctggctggagtcacacttggcttatttatgagctcaataaacattatgaatggatgagcaattttgaaagattgacatattgaaggaaaaaaatgacgtgaatctgaaaaattctgacatggccacttctaaactctctgggacttgtactaaatgcttatagatttaggtagcattctgagcattacctcacttattcctttcaaccagcctctgaggaaggtactgttattatcaccatttcacagaggaagaattgagatccagagatgttacataatttgcccaaggttacataataataatataatagctaaagccaggatatgaactcaggtagtctggcttcagcagcttctctcttaactacgaagctatattgtttccacatggtgattataattataactgcctgttctactttcctgtacgttgtgaggctgagtttaggtgtgaaaggattagggaagaagtatatcaactagtgaaggcgagacaacacacaaacaactataacttaaagtagatagaaacttgcagagaaagttcagagaagaaaaaagaactattatttccaccagggtgaagggcaggagtcaaagaaggcttcctgtgggaagtgacttagtttggccttgaatgagtagaattatagtaaagggagatgctttccaagtaaacagaataaacagtggaagagatgccagtctaatgctgttgagtttagcagattctttccgaaagagtgtgcgctgagaagtggggagtggagagggtttgtggtggaaggaggtggaagccctgagaagggatctgagtgggaagatgcaagcgttccaaaagcatattcgcaatctctctggaggtcaatcctgggcaaaatgttgcttttgtcatgctttaactcattattttttgatgcattgtccgcaaagactagtccaaggaggtaccactccagaaagagtggccacacgagtctggaaaatgctgcaccctctggtgctctattaggtgctgacagtgcgtgttaacatgcccagtcttcaaggaagtcccgtgagacagcaatcaccttgctttctttgactgtagacctggtttgttgttttactttgagcaaacccctgttaacatccctcagaagacacacttcaggagccctcttccagccaaccagctggactaatttgtgtaaactttccaacaagttgtgtgcttctgctgaacacaggtcatctcagagtaaaacttgctccattctcaggacagccaacagtccccttttgaaagaagttagagcacgtttgcctatagaaattgttatgtgtcagttagaaagcaagctgcatccgaggtaacaaacttgaggagctgcagcccctctgacgaagtaaaagtgagaagcaggaagtgaaggagtctcagctcttgaaataaaatgtgcatacgggtgagagttgccaaccacaagaactctagctggctgccctgagaacatattaggagaaaacatggttaaagtcggcacctgacctattagctgcaggggcagctcattatcttttttattctttcaccctgcattggcccgaaaggggaagagaggcagtaagtggactgtaaagagtgcttattccacgctgggcaggtcattagaattgtcatgtcaaattcccttccttaatcccctcaactacccagtggagtcaggattattaatctcttcctctatacgtgaggacagtgaatccagagtggcttgctggtgctgaatagatcatgttgtcttacaacttgagcttttcccttgttcctttccctatttgtctgctgaactcatctgtctccaggttgtaaatgagattctcctctgaagagcctctgagccccctgtaactctattcttgtattgcatgacgatactcttgttctttaggtttatacctctttctccccttaagacctaaaactcgatctgggttactctagagcccacaggtttatattgcactgctctgcccacattccagccttctccactttaacatatgacttgatgatagcttttcagacccagtccctcacaagatacctctttttcaacccattattttagaccttctttacttgacatattttgagttttctggattctaggcttccttatcgttagtgtcactttccccccttctgttacatgtctgttaccttcttgctatttgcttaggtcctaccttaactttgaaggaacgcttttcaaacccggcctgcatcggaattaggaatcccaccctcagaagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttttttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccgtgtgttcttggacatcttatggactggagtttccttgtctctaaaataattattccatttccttgtactgcagaagctcatgaaaaaggtcaaatgagatagcgggtgtataaagtgctacacaaatgcaatgatgctaatagtaaattattgttgatgttttctttgtttctgtacagttgactcatttgctttatcattaatgatgaggcatgaaagaaatgctgcttgtttttaatgaactatggaagactaggtggagctgacgggatgttgggatttcaggaaagctcttttaggtttctggaaatgatactcataccaatagttgtgagcttaggttgaagagcaatgttgtatttatactataatttttcttcaaataaactgtgataaagattttgaatattactttcatattctgaacttctcatgtacacttgaaaagagtcatgaaatagtagtagcggttgccatttataggggtcgtagggtgttgttatggttaaatttataaatccttaaaattatgatttctatcacaaaaatgcctaaaagggtgcattctctaggttttttccttctttcattcccttccttccctcccctccctccctccttcccctccctcccttccttccttccctctcctttcctttcttctcctttccttttccttttccctctcctctcctctcctctcctctcctctcctctcctcccctctcctctcctctcctctcctctcctttcatttttcctttcctttctctcgctctgttgctcaggctacagtgcagtggcacaatctcggctcactgcaacctccacctcccgggtccaagcgattctcatgcctcagcctcccaagtagctgggattacaggcgccctgccaccacaccaggataatttttgtatttttagtagagatggggttttgccatgttggccaggctggtctcgaactcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgcctcactctcactgccatactcctttggacatcctccttctcttgtttcctaatacttttacatccccttccatcctttactccttagcttttgtttttatttgcagtgttaaagatagcctctttttatttccctgtagtgattagatcgacgtgtttacaatatgaacacacaggttttctcttcttcaggctctgagtcatcgagttcacaatgccatgtctagtcagtacttctatgtgtgtatagtgcccattgtggccgagtagagataaggtcactggggaagaaaataaatcgctaaaatctgttagaatacgtcagcttccaggtttgtctgaggatgcagtggaaaccacgttctgtggccagcatgtcagtagcttttgatgatcagagccttccattttgatactttaaaataatgtaatctaagttcacatcaactgaatccagacagtttcaccatccaccacattattaattccagatgggaaaattcattagggctcaaattttgtttgagacccaactgttttttaaattattattacaattattatctatttattttatttatttttttttttacaactgatgggaagggaaatttaacagctgtgtgattagcagggcatgaaattaaaaacgttttgcacagaatcaagaggttgtttactacagaatttgtcatctgagaattaagtgtcattaagactgcccacaggatgatctctttcaccattcaagctttgatttccacgcccggttttttgctaaaaggcctttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctgggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgcagtgagttgagatggtgccactgcactccagcctggacgaaagagtgaaaactccctcccaaaaaaaaaaaaaaaaaaaaaaaatactatgtacttgttcctttgggcaagatgttggcagttttctgcagaagcgtggtcaagcacattagctggactgtcttggtcgaggtttgaaggcaatgccatttgcttgggcaagttacatggactctctgcagttcatttgcctcatcatcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcgttttttagacaaattttattttcatatttgttgaattaaaccagacacagcttctacacttatggggtttcctttctgggagaatggggctggtgacaattaatgcagaaaacttttattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaggaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgctttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagtttaccgtcacttttagtatgtgacttgatgaggcaccataatgtgtgtgttgctggccaaacattacatgtcatgactgtagaatcatgagactggagttttagcctagaccttagaacacgtacctgcaagaggtagttattcgagcagcagtctttgtgagactggaattcaggcacagggaacacttgttcctaagttgctgccccgttgctcaaaacatcttggtaatgtctttctttctttcttttcttcttcttttttttttttttactctgttgaatgttatcttttattttgtttttattaaaaaatcaatttccagctttatcaggatataattgacgaaacaaaagttatgtatagttaaggtatacaacatattttgaggtacattgcattgtgaaatgattaccctagtcaagctaattaacataggcatcacctcacagttacctttctgtgtatgtggtgagaacgtttaagatttactctattagcaaatttcaagtgtacaatacagtattaactacagccaccgcactgtgtattaaatctccagaattattcatttggtatcactggatctccctttgaccaagaaccaagatctcctcattcccctggtcccggtagccatcattttgctctgcttctatgtgtttgacttttttaatttgcacatatcagtgaggtcacgcagtgtttgtttttctgtgcctggcttagttccttaagcaacatttcctccagattcatccatcttctcgtaaatgacaggatttccttctttgttaaggctgaataacattccacgtggtaatacaccgcattttctttattcactcttcaaatgatggacatttagatcgattccacatcctggctattgtgaataacgcagcagtgaacatgggagtgcaggtgtctccttgagacactgattttgccttagaggggattctggggctgggctccgtggtgaagggcactctctttccctcacctggaggttatgtcagcggtgtgctgggggttgtacaggtcatgttaagctgtccttcctgccttcctcaatgcgtcatttcttatttctatgttccacccaggtgctgcactctcgcctgaattccttaacgtgtgtgaggtattttggtgtgtggctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaagaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggccagaaagttgattcttagttaagcctatgaatagttagaaaaaaaaaagagaagagagaaagttccccttagcatggcctattatcacagggtatgtttgtagcagagggagaacccagtccttatagagtgggttatggcttcttctacattccaagaaaatctcaagaagtagaaatcactctgagtgtcaaatattttagttgcctattgtcacatctattataaaatagatctggtatagataaaaatagagttaaacatactagttaatagatatatctggtgtggataaaaatagaatttagcatactagttaatatataaatatgatgtcgataaaaatagagttaaatgtacaagttcctaattggattgtagaacttaacattcaggagtaaggatgctgtcaagtctaaagctatgcccttatcctagtcagttgttatattcatggcagccttttctaaaatgtgctccatgaaatactagattcataaatggtcaaatcactgtgggactcttgctattatttccacccattgtggagattcttgatgcatccccaacaagtttaactctgagaagtcgaacaggcaaaagcaataagcacaactttcttttctcttatgttagattcaggttttgtccaatttattttataatggaaccattttgtggatgatttcccagacttgtgttctgtggaacattctttggatagcatgactttattgttaaaattcttaaggttcacatctgtcatcttataataatcttgtgtgaaatataaagtcatttgggctaaactgtagacctccatctgccctcccttccccacaggagaaattacaggtttatttaaggatcaaacagttttgaaatgaaatgttgttaggagggggaaataaaaacctttcagagcttaataattgtagaaagaagacagtgttataccggccaaaccaattttgtgaattagcactttaactcagagagttgttcctgaaaatagcttgtttttaagcaaaactttgttggcttctggtggtacactttttcaccatcaaaggcacaaatatgggtgattttaaactgtggcatactttttttgcattcaaaaccagggcttgtggaagaaacaacacccttttttaacttttcagaaacagttggcttgaccatcatggcttttttttttcccctatgtctttaggatattagcttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactccacacacacacacacacacacacacacacacacacacagagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctccaagtgcttaagggatattgcctggttataaatcatcatgtgattctctctcctcccacccccatttacagcttctttcttctttctccactgcccatgtctaaacctggggaactatctcactgcatagacagaaaaggaaggtcagatccaaggtagatctttctttctgctaggtttaacctagtgatagcaacaaaaacagttcttatgcctctgagtttcttgttttaggcagaagcatttgataggttggggatcacaggaaagtttttttttttttaaattctccattaagaagatgctaatgtacttgtgaaggcaagtacattaagcttagtaatggaagatatgggttctaagctgcacctctctgccaactagtagtgagatcctggggaaatcaaacaatcgtttggaaccacatgtggcctagtcttttcattatgacttcaggagtcataattcttgtcttgtcaacctcctggggttgttgtgaggattaagtgagataatagatatgaaaaggcttgtaaactacaaagcatctcatacatatgtgtaaggcattgttattatcaataataatagcaaccacacactgctgcctttgagctaggtactgttttaagtgctttccgtcgataagctcacttaattctgacagcaactctagtgtaccaatgaccagtgctgggcgctgtgaatcagcaggactggcagctcaccctgattagctggtgatttcctgtgttcttgggcatgtcctttcccttccctaggcctgaattttactctttgtaaaagaatcacagactcaggttggatggaaggattcttctgttctgtcatttgtgattttgtcaggcagtcattggccccacaggctaagtcactgattatttctatttatttatttatctgagacagagtctctctctgttgcccaggctggagtgcagtggcaggatctcggctcactgcaacctccaccttccggattcaagcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcgatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaattatctacattcatttatatatgaattattagatattatctacactgaaccaggcaaaattggggataccaaaatgaattagacacagttcctgctttcaaaaacctcatactctgaagagggggagatttgttaattctgtcaagtcatctttgatgcctaccatgaccaggtatcagacatgccactggaactgtggacatctggcaggtacaagcctattcatcacagggtttcaggtctagggaagaaaaacatcatattaataattttacaaataattatgtagttatagttgtgataggtgccacagaggaaagactgagtggtgggaaaatatatatatatatatatatatatattttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttcattgtagattctggatattagccctttgtcagatgaagtaggttgcaaaaattttctcccattctgtaggttgcctgttcactctgaatggtagtttcttttgctgtgcagaagctctttagtttatttagatcccatttgtcaattatggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccaatttcagctttctatatatggctggccagttttcccagcaccatttattaaatagggaatcctttccccattatttgtttttgtcaggtttgtcaaagatcagatagttgtagatatgcggcattatttctgagggctctgttctgttccattggcctatatctctgttttggtacccgtaccatgctgctttggttactgtaaccttgtagtatagtttgaagtcaggtagcgtgatgcctctggctttgttcttttggcttaggattgacttggcgatgcaggctgttttttggttccagatgaactttaaagtagttttttccaattctgtgaagaaagtcattggtagcttgatggggatggcattgaatctataaattacctttggcagtatggccattttcatgatattgattcttcctacccgtgagcatggaatgttcttccatttgtttgtatcctcttttatttcattgagcagtggtttgtagttctccttgaagaggtccttcacatcccttgtaagttggattcctaggtattttattctctttgaagcaattgtgaacgggagttcactcatgatttggctctctgtttgtctgttattggtgtataagaatgcttgtgatttttgtacaatgattttgtatcctgagactgctgaagttgcttatcagcttgaggagattttgggctgagatgatggggttttctagatatacaatcatgtcatctgcaaacagggccaatttgacttccttttttcctaatttaataccctttatttccttctcctgcctgattgccctggccagaacttccaacactacgttgaataggagtggggagagagggcatccctgtcttgtgcccattttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatgttgaaccagccttgcatcccagggatgaaacccacttgatcatggtggataagcttcttgacgtgctgctggattcggtttgccagtattttattgaggatttttgcatcaatgttcatcaaggatattggtctaaaattctcttttttggttgtgtctctgccaggctttggtatcaggatgatgctggcctcataaaatgagttagggaggattccctctatttctgttgattgcaatagtttcagaaggaatggtaccagctcctctttgcacctctggtagaattcggctgtgaatccatctggtcctgaactttttttggtcagtaagctattgattattgcctcaatttcagagcctgttattggtctgttcagagattcagcttcttccttgtttaggcttgggaggatgtatgtgtcgaggaatttatccatttattctagattttctagtttattttagaagaggtgtttgtagtactctcctgatggtagtttgtatttctgtgggattggtggtgatatcccctttatcattttttattgcgtctatttgattcttctcttttcttctttattagtcttgctagtggtctatcggttttgtttatcttttaaaaaaaccagctcctggattcattaattttttgaagggtttttttgtgtctctatttccttcattctgctctgatcttagttatttcttgccttctgctagcttttgaatgtgtttgctcttgcttttctagttcttttaattgtgatgttagggtgtcaattttagatctttcctgcttctcttgtgggcatttagtgctataaatttccctctacacactgctttgaatgtgtcccagagattctggtatgttgtgtctttgttctcgttcgtttcaaagaacatctttatttctgccttcatttcattatttacccagtagtcattcaggagcaggttgttcagttttcacgtagttgagctgttttgagtgagtttcttaatcctgaattctagtttgattgcactgtggtctgagagacagtttgttataatttctgttcttttacatttgctgaggagtgctttacttccaactatgtggtcaatgttggagtaggtgtggtgtggtcctgaaaaaaatgtgtattctgtcgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctatattgggtgcatatatatttaggatagttagctcttcttgttgaattgatccctttacaattatgtaatggccttctttgtctcttttgatcgttgttggtttaaagtctgttttatcagagactaggattgcaacccctgccttttgttgttttccatttgcttgatagatcttcctccatgcctttattttgagcctatgtgtgtctctgcacgtgagatgggtttcctgaatacagcacactgatgggtcttgactctttatccaatttgccagtctgtgtcttttagttggagcatttagtccatttacatttaagtttaatattgttatgtgtgaattcgatcctgtcattatgatgttagctggttattttgctcgctagttgatgcagtttcttcctagccttgatggtctttacaatttggcatgtttttgcagtggctggtactggttgttcctttccaggtttagtgctttcttcaggagctcttgtaaggcaggcctggtagtgacaaaatctctcagcatttgcttgtctgtaaagtattttatttctccttcacttatgaagcttagtttggctggatatgaaattctgggttgaaaattcttttctttaagaatgttgaatattggtccccgctctcttctggcttgtagagtttctgccgtgagatctgctgttagtctgatgtgcttccctttgtgggtaacctgacctttctctctggctgcccttaacattttttccttcatttcaactttggtgaatctgacaaatatatgtcttggagttgctcttctcgaggagtatctttgtggcattctctgtatttcctgaatttgaatgttggcctgccttgctagattggggaagttcttctggataatatcctgccgagtgttttccaacttggtttcattctccccgtcactttcaggtacaccaatcagacgtagatttggtcctttcacatagtcccatatttcttggaggctttgttcatttctttttattcctttttctctgaacttctcttctcacttcatttcattcattttgtcgtccatcacttataccctttcttccagttgatcgcatcagctactgaggcttctgcattcgtcacgtagctcttgtgccttggttttcagctccatcaggtcctttaaggacttctctgcattggttattctagttatccattcgtctaattttttttcaaagcttttaacttctttgccattggtttgaatttcctcctgtagcttggagtagtttgatcatctgaagccttcttctctcaacttgtcaaagtcattctccgtccagctttattccattgctggtgaggagctgtgttcctttggaggaggagtggcgctctgatttttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcgttcctctggaagttttgtctcagaggagtacccggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcgagcttcctggccgctttgtttacctaatcaaacaactaactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcacggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctcaagttgtgccttgcttgagggcaggagcgcaagtggggctgaagtcctgccctccccactagccaggccaagataaggaccattttctttctttttttttttcttcctaatttgcacaaaagatactaatgattaacagagatcctggtatggaaacataagacacaagtttggttttgtctgaaagcactggtagtttagttggtgaggcagccacaaaactaaccaaaagtaattatattgccagccacaatgaaatatattaaccagagatacaaatgacattctgagggggcttggtggaagtagtttaaccctgatagggtggggagaatcaattcttacaactttcgaagagactagttggatgggcaagttttcttaatagctttattgagacataatttaattaattaactcaaagagtagaattcagtaatttttaatatattcatagagttacacagccgtcaccaagatcaattttagaatatgtccctcaccaaaaaacaaacaaacaaaaccaaaacaacaacaacaacaaaaacacatagtggtcgtttcttatttctcccaaatctcttgcatccggtactaagcaaccacgaatctactttataatctgtgaagttgcccattctggacattttatataaatgtccatacatttatataaacatcatacaacatcatacaatatgtagtcttttgttactttgtttctttcagttaggttttcaagattcatctatgttgcagcatgataagtaggcttttgattggtgaagaatagaagcaagtttaccccaaaatgatgcattagggagagctaagagattaacctttgtaagaaaccacggtctgtgtttgaaaggttgaaagtagactattgggtctgctgactagggcctgtagggaatgttacaggaattgaagttagaaatataagttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactactagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagttggcctgtgtttgcatctcttgtagccaagagaaatccctcattgcttgtttctgagctactcatgtcacagacttttgcaagaggaaggatttttgagattacatggttcaaatgttattaaattaaggtttagtggtccatgaacctcctgaaattgtttgcaaaattatctttaattgtgtggaggtgtatttttctcccccataaaattctcagatggattgcatccctgtaagggggaagaatcatttatccaccaacaatattgaacttttattgagtatttacactatgccttgtagaagacttgtgttatctcattcagtctttacagcccattctcatggattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacccgatacacccagctatttttttttttttagattttgtagagacaggggtcttgctatgttgctcaggctggtctccaattcctgagctcaagtgatcctcctgcctcagcctcccagtgtggtgggattacaggcataagccatcatgttcagccagggaatgtttgaagatagagaaaaaagccctgctttctccattccttctacggtttggcacccagttcatatcccatttgcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtggtcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttattttgaagattttgttttcctggaaattagtgggatgttaacgtctccttaaagaactcattctttgtctttcctggttccccctcttatcctctgtaacctgtgacctcctcccaccatctgaggtggatgtctcctgaagttcttactctgtcccagcaatgatgaccttagtgtgtctactgactcttaaaacccgtagggacataggatccaactgcctcatagaaaagtaaggccgagagagggttactcctatatttggttcaagtcaatctgggtgctggtttataaacaatgcctattcagtgctctgcactaaggcatactggtgttatgcttctatttttgcctttattatttttaaagttttttggatgaaattactgacgttgatcacatattaaaaatttatgaggattctatttttgggttccattctatttaattctagctgaaatttgcttctcttttttatcctgttatggtacatttgttcctagacataatcaggaatgacaccagacacagactatattttggtgtgtattagtgagaaaatttagtatgtttcttttgtcatgttgaatgtagacactatggacaatgtttaattaattttaattgatttttgttgttgttattatctttctcaatttcctctgctttcttcttacttccttagcatggtatgccacagatagggacacatttcatctgaaagatgtatactatatatggatgtctttgcagtttcttcagtccttttaattacataaaaatcttaataatattaaaacaacaattatgtaaattttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaagtagcatttacattttggctcttgaaataactaccagcatgtcatttccaaagagacgttaatcattgacaccaccagcagcaaatgttctcattcatcagaccacatttgttttacacgttcctctccttagaaagagataagtatggtttcttttctttagttcttgctaataggatacccaacatattcaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtattgtatgtttgtgcatgtgtgtgtgtgtgtgtgtgtgtgtgtgtgtgtatagatctacatacatgtgtacacaccatatatatatggcttataatggggacagaatcacttagcagatgggcaaccctgatgatccaggtatttacgaagggactcaaaccatcttcagttgtctaggtattcagaagaaaaaaattcagaaggctgggcgcagtggctcacgcctgtaatcccagcactttgggaggctgaggcgggcagatcatgaggtcaggagattgagagcatcctggccaacatggtgaaaccccgcctctactaaaaaatcaaaaatcagccaggcatggtggcacatgcctgtaatcccagttacttgggaggctgaggcaggagaatcgcttgaaccacgaagtcggaggttgcagtgagctgagattgcgtcactgcactccagcctggtgacagagcgagactttgtctaaaaaaatttcagaagtcccggagtcctttccatgatgcatttgaagggccagagagatagaggcatgccctatgtagtacatcttgctgctgtccctcgtgtgtttactctatgggtcaaatgagatggtgttggagcaatcaaaggatacagaccagtacccagcctttcttgtcaagactttgcctctccttgggatgttcacacacacctacccctattttctttagggatctagttgcttacttattttagacagtacatcctttatggccttgctgaaatgtaactccttgatggaatctcctctggtttctttctatctgtccacctcaattgagaactgatttccttcccctgaacccctcaccttcccatagtgctttagctgtagcttctttattcaatgtttcactttttactttggaccagagatatttatgaactttacaaaatctcttttaaggcagatatttcagttctctttgcattaacacaggacttgttggatgattgagtaagcgtgtgggggggtgtgaagagagggttcatttgttccttcctcgtgacagagctgagaggggaagggcccttgctggtggtggatgggccctgagggttaattgggctgagtgtggccacaaagcagaaagacttgctgtgctttctgaacttacgtaagttacaaacactattaaaatgtcacaaacaaataagagaatgaggactgtacttaggttccatacttgtggtatggaaagctatctaaaataaaattagctacatatctctgcagatttctctgattcactctacaaagaagcaagtgtttaatctaattctgcaaatatttgagactctttaccaggcgttgtggaacatgctttatgactggaaaagatgataaaggcatagtttctgccctaaggagctgtttgtgcatctgttggaggatatagatattttaacaggaagattctaacactaggtaggctgggtcctttgtgataaagtctgcattagaaatatgtgagaagaaaagattaacctgagtgcggtctctcatgaagttgctagtatactcttctttctttatgcatttaaccccaaaattatctctactgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcacgcacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtacaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaattttttttttttttttgaggcagagtctcaccctgtcgcccatgctggagtgcagtggcatgatctcagctcactgcaacctccgcctcctgggttcaagcaattttcttgtgccagcctcccgagtagctgggattacaggtgtgcgccaccacacccggctaatttttgtatttttattagagacagggtttcatcatgttgataaggctggtcttgaactcctgatctggtaattcacctgccttggcctcccaaagtgctgggattacaggcatgagccaccctgcccggcccagaggtgaatatttttatggttatttctatctattgatgacttgttttgtgaaagggattttttttttttttagctttagtaggaatgtgtgagtgagtcagcatctcccctatcatgctagtattaaatatgttgtttttttggtattagcatttctctggttatttgtaaatttagatatgtttccacatgcctcatttccagttatttttttttattgcctttgaagatgagtactttccaatctttaggatcccattcacagcaaatcaaagaggaaacattttagtgagaattgtgcaattgtgcatgtcttataaaaggttctagaacattttttactcacatgaaggactgtttgaataagttgagacatgccttattcctaaatggaaacatagaggttgttaagtagttgttttccctacatttcgtgcaatcacagttagtacaactctcaggtcaattattcttgaattttaaccaaaaaattctaaattgtcttgacaataaacaggcaaaataggtaaaagaaatctgcaaaataagtgtaatgagcaactgggaccatcctagccagatgctgaggtgcatttataaggcaactctgattgaaggaggaggtggtgctggaatagatgggaggtcaaagcagtaacagaacccacccagacataaggcaactgcacgtggaattaattggcaataaaagaaccaccttgctacattccgaaaaggaaggattattctcatggcattgggataattggtcagcgttaatgaaaaacttacatcatgagtatgtttcacaataaaccctgatataaattagtggtcatgttaaaaaataaaacttgcaaaagtcttcaggcaaagaagaaatttgttatatctgtagtaactgaaagcagtaacttttaagtttacacctgaggtcctcaaactttttctgtaaagggccaagtagtaaatattttaggctttgtaggccagatggtctctgtcacaggtcctcaactctttgtgctgcaaaagcatcaatagacaatatgtaatatgtctcatatataaacaaatagagaatatgtaggtttataggaagagtcataatattgtgaatgttaatttcctgacaaatcgtgtcccatggtgaattttatgaatctttcatttttttggcaaactgtttgaaaaagcatttcatggctattttaatttatatttccctgattattatttaagttgtgtgtgtgtatgtatgtgtgtgcgtatgtgtgtgtgtgtgtttggtatatttgtgtgccactgatgtctctttttatgtgaattataggtagagttaatttatctcacttatttcacctctctgtcacctgatgtcccaataccctggagagctttgtgatatctacaccccagtacagactaataggtcactggtttgcttcagaactagaacttctcctgtgcctttgtgcccaagggcctgggacttgacttttggctcagttctacttgtctgctaacctgaccgcttgacagtggattgaggatggagggcactgagcagttttggctgtgcttgacctcctgcttagtttccctccatggtctcttagaaatctgagactgggcgtggtggctcacgtctgtaatcccagcactttgggaggccaaggtgggtggatcacctgaggtcaggagttcgagaccagcctggccaatgtggcgaaacgccatctgtactaaaaatactaaagttagccaggtgtggtggcaggagcctataatcctggctactcaggaggctgaggcaggagaatcacttgaacccgggaggcagaggttgcagtgagccaagattgtgccactgtactctagtctgggcaacagagtgggactccgtctcaaaaaaaaaaaaaaaaaaaaaatgggactccgtctcaaaaaaaaaaagaaaagaaaaaaagaaagaaatctgggtgagttgttgcctgaatcttgtctgaacctgcctatcccctctgggtcctgaaatctaactgtgggtgagatctgcctttgcatttctgttcatccaggtgagcaaacctggagtttggcctcactctgtccaattgtgttccttccaagagataaaactgagaaagtggtaaagtcacttgcataagccactttcagatccatagaggacccacagcatgagattctgactgttattattacagaggtagaagcgtcattttcttggagctgtgtctccgtgtctttggtgtgccacagtcacaggcctgctcctgcccctccctgcaatctttccattgttgtgtgtggtacaggaactgagacaattatgacagagccgagctggtttctcttctcttttggacatcattgtttgtcacaattctgatcaccatttcttcctctagatcacaaaattgtaaaatcactgctatatttacattttcttttgctgcctgggctttaaaaagtactatttatagctttcctttgaaattcctttattaatagtcttccttcacatgtatatcactctgctatttacaaaatgctcttacgtttagtatttcacttgatcagcataaacacccatgggataagctaggcaggattgttgtctccattttacaggtgaggaaattaaggctcagtgaggcctggaaggccctggcctgcagccactgctggaccgggtgccagaactgggtttagacgtcttactagatctctcttgctgtttttctttccgtctacaaaaactccttctcatttatgagtttcaaagattttcttgtctgacacataaggaaattagtggcttttcttgagagatctaagcattactgcatttgcctaatatttcttttactatacctattggtctgagtactttaagagaaaccagtgtctgtaaataatcttccttcttgtcagacatggaggcagaaattttccaagaagagagagaccctgaagacactgtttgttctctgctgttcttaacaagtactgcaaccacaattttggatttttctcctcgaggctttctagttgtaggctgccacagaatacttcggggtcacagattcctattcccttttaaactgtatcgggcatgtgtgttatgtgacctttgtgttctgaccttcagatttagggaactgaagatttaggaagtcttgttaggacttaaatccaagtaaattccctcatgagtacaaagactcatctgtggaggtgtggaatgttggagagaaagggactttcattcatctagccccctgggttagaaaacagggctggtgagtgatagagctgaggctagcatgcggagatcagactagattcggctttctgctggcttcctccatatcactcagtacttctggagttgtagcatgcctcttccccctggactgggagctttgagagggacggcactgggtgtgctctgtgcacggctcttctagaggtgatccaagtgctttgcataggcactcaggatttatttgcttgatgaatttgaacctgtctgttgttgataaaatatcattattgcccataaggatcttgagggagtttgtaaggatcttgagggagtttcagtcaggattcactataggaaacaaaccactttagatattttaagtggaaggtacttaatacagggtgtttcacagaagtaattagatggactgcatggagcagaatcgaggctgtctccagaaatgaatcacaaaactgcacaaaattattccattttctacaatcaagcaagacaaaaatggtgaagccaccatgggaattactgagttcagtgatacatcacaaaacttgtgaaacagagatcaaaagccatagtcagaatgatggtagctggacactgagacatgagtccagctacttactctttttgtcacggctgctttttgacagccaccaagctgaagactcaatatgagaacacagatgctgaaaaaccccatgtctgtgtcaccattcttctaacagaaaacagggcaaacagcagaaacatgtcttccatcttacttttgcctttcaaatatcaagccaattacatatattttggtagaatttcttttgcaatcaaaccttacctgcaagacagcctgtgcaatatgggaagtttgagtgtcgatctaccatatccaccacattaagggtgatggttttcatatttcgggcatgtcttccataaggctttgtgtgtagtagatattaagttggaaccagagtaacaattacgttctattacatctctacttgtcagtgtagttaattatataacagaatggactgcaacagttttactttagggaatccctaagggggaattcctatttatcagaaaaatgctgtaaggagggaagaccctgaggtgggagagtattctaaactgttttggtttcaaacatcttggaaagtactacatggagacatgcgatattataacatatcagtgcttaccatgtctggggggagttctgtcttaaaaaagcttgcctaccttctatgctgttgctccctcgctgcactgttttgaccccactttcctcctcaccagccaaatacaagttttgcaatgagaattaatgtaaaatggtttctttataacaaactaaataggcttattcttaaaaggaaacatagaggttgttaaaccgttgttttccctacatttcatgcaatcacagtacaactcacaggtcagttattcttgaattttaaccaaaaatttctaaattgtcttgacaataaacaggcaaaataggtaaaagaaatttccaaaacaagcagaatgagcaactgggaccatcctggccagatactgaggtgcatttataaggcaaccttgattgaaaaaggaggtggtcctggaatagatgggaggccactgcagtaacaaaacccacccagacacaaggcaactgcacgtggaattaataggccataaaagaaccaccttgaaacattccgaaatgttgagccttcactgaattcttctgacttttccctcaactctgtgtaaccccaatttagaaatgtgaaatagttgttagtaatcccttccacctttacattgtaccctagtgagtgcatttggatgtattttagacacattttttttttcctgctccaaattaagaatcaggcaacatattgtccttctagtacttgtaaccaagtatatattataaaatcactgataatctcgtatgtgtggggtcaggtgttaaagatataattgaagtaaacactcttgatttatttttatttttattttaagaaaaagtgacatttttgcttcaggagaaagaggctgagtgaataggttagttgataatagtttctgctaggtttctgctatatcttgcttttctcccgaagattcattttagtaccttctttccttcttaagagcacatgctcctaaagcagggaagcccccaaagcctcctctacttcccgttgctaattgctgtggcctcttatccacgccagtaatgaaccaaaagtatgggagggctttagccatatggaacttctgggagaggacttgactgtattcaggattcacttggactaaacgaccaaaacctcattaacacagtgttttcagtaggtgattatatgagttatcgtcaaaactgggacacttttgcaaaggggcactgttaataattacaccagaacagcaggtataaattggagatgtatggtcatcctaattatacagagccttcaagaacagtgtttgaaatgtgaattaaaacgattcgaaaccagagcttaagttctctagtatttttcatgggtttaagtttaccttctcttttatataacaatcacttgctgagatctgatgatgggatatactgtgtattaggtcctaggaatatatagataaagtagataccaattttgtttttttcttcactcacagtattgtaatattttagaccagtgggtttccagtctggcttatagcatactggagatactagggcaataatgcattttatgcttcccccaaattaaagtatgttttgccaaagtgtgatgatttaaatgcccctgtaatggttttattaatttttctatttatacttggggtttttgtttatgatttggcatgaagaaaccatttattttgctaaggaaaagtttgaaagctactggtttgagacttaaaaatttatctttaatatttggttataaagtcgtaaggctactttttaaagaggggaagaactagactgattaaagctgaaacacataaagatgtaaactgagtgggaaacaaataaattacctgaaatatataaaggtctgctatgtattagaggttttgtgattctagagggcacaggtaggaccaataggtggtacttatgggaatacaggcttcagctgcagaaaactttctagcagtcataacttttctgccatggaaggggctgtcttgtaaggtaatgagttccttgtcattggacatgtacaaatgaactcacagatggtgggtaagcttcatcttgagctccacattagataaaatgtcttcattaacaatttcacacttcaaggatgttaaacttctgtattggtgaatgttgggtcctttgctacttctttaaaaatatctaaagtgtgtgtgtgtgtgtgtgtgtgtgtgtgtgtgtgtgtgtatgtatttgtgttttatttccccagaacattagctgagtatatttttcatgtattttattttatatttttacacagtggtcaataattgataaaaatacagaagctactacaacagttctctcatcaagggaaacttaaaagggataatgtccatagatgtgattctgaaactgatttgaaaaagcctggttcatttttactgtgttgccattggttaatgcttaaccagattttgtctctgtttcaaaatcttgaaataaaagtggaacaacttccaacatgacttaagaaaaaaggtccccagttgaaaatgcttccaatcgttttgctattaaatgtgaaattgcaaaactagcctctcttacaaaaactagtgagaagcttgcctgtttttcataccatttcaaatactgagaaataatttctctaggctcttggaattagagttaaataaaaattatatttcagagtatataatgcatgaagttggatttctttgttttctaaaactgtatctcatggtccttgaaggttgataatttatatctctggtaccactttatttttctattatttgtggattaaaaattttaaatttagcaatatacttatattttgctttagaataaagttgatttttaaaaacttatttagagacagggtctcattctattgcccaggctggagtgcagtggcatgatcgtggctcactgtaaccttgaacccctggtctcaagtgatccttccacctcagcctcccgagtagctgggattagagaggcgagccaccattcccagctaatgttttttagaaattattattattttttttttccagagacacatcttgttgtgttgcgcaggctgatctcgaactccaggcctcaagcaatccagggtctcctcccaaagtgctaggattatatgtgtgagccactgctcccagctgagctttttcttaatagatatttaagatgatatgtaattagagaatcggagattaaactggaaactttaatttacaataacaataaaatattaattcaataatagtaatttaaattacaggccaggtgtgatgactttaatctcagcagtttgggaggccagggtgagagcaccgcttgagcccaggagttcgagactagtgagaccctgtctttacaaaaaaaattaaaaaatttgccagacattgtggcacacctatagtcccgactactttggagaggctgaggtgggagaaatacttgagtctaggagttgcaggcttcagtgagccatgatggtaccactgcactacagcttgggcaacagagtgagaccttgtctctaaataataataatgataataataataaaaataaacaaataaataaattataatgtccaaactcaattcaaaagctctaagctaatttatagtagttctgatgtaggatacaaacaacacagttgacagttttgtgaacaatatgatgttcaaaaggctgaagtataatctctaactccccatcttgttgctatgattactcttagcagattatgtggcctgaatcaacattggttcacagtcacaagcagtgttatcagatgtaaatatgtcttaacgttcatcaatagtagactcatattcattgaaggaaaaattaagaatttctactttttcaagttataactaaaattgcttttaaaatcttccttattttattgagatatcaaaataaatattcaaaaacagaaaaatacaaacagaatcattaaaaaattaagataattagaacatcctaaagtggtagcaaaatctcatggcctgactaatggtcatgacacacttgtaaatggatatctaaaatggagtgtttacatgttttaatacaagtttgaacaagctgtcagggaaacacagctaagtgagctgcagttaacttgcagacttacacagttattggtaggtttagaaatagaagatgctagataaccattaaagagattgctaggtctcattagagatcatattggtgatttttcctatcgtcactttttcctgggtgaggggcaaaatctttatgaattaggcacttagcgtctcacctttacaaatccagatttccacctttagaagcagatttactgaactcaaagaggtgcaggctattgttgcctgttttctcttggccttgaacagaaaagcagtctataagaatcaaggacttataagaaacctgctaaggagcccgtttttttgccagcactgcacactccacagactagccataacattgtggatcataagaagttgtgggaggagattttgaaggtcatcattagttgcttattattttaaatctgcagaaactgaggtccagagagaattcacattttcttggttactttgccacgtggaacaattgttatcaaatgtgacctggaatgcaaggttggggccatttatcttctgtgctaattttcagtgccatggttgcgaactttcttggcagagaaattgtttacttctgtgccctattccattgccttttacctaccccatctagttataatctagcaatagagttataagcttgtgtaatcaaactttcccactgcagatgctctttggagacagaatatttgggtttaaacccagcctctgatatgttctagctgctctattacattggataagtttctttagcttctctaaatctcggtatttgaatactcaaattagaagacgtaaattatttcctaagatttctcctagctggggctctctatgaccttttagctcttaagtagtctgtcctggctattgtcaaccatgtctttttttccttgactgatagaaactgtggcaaacaaaaggccacttagtcagtatttgttccgtccttaaccttctctcctgagagtcctgatctttcagtgctgttgtttccctgtcagggttgattgtttccttttcgagtgccgttctgaatctgaagtgaaagtgcagcgtggaggcatgtcactgttgtgtctcacttctttttcttttttttttttgagatggagtttcaccctgtctcccaggctggagtgcagtggcgcgatctcggctcactgcaacctctgcctcctgggttcaagtgattctcctgccttagcctcccaagtagctgggactacaggtgtgcacctctgtgctcggctaatttttgtatttgtagttgagaaggggtttcaacatgttggccatgctgatcttgaactcctgacctcaaacgatctgccttcctcggcctcccaaagtgctgggattacaggtctgagccactgggcccggccgtgtctcacttctttatctgagacaatgtttactggtctagacctgatgcttctctcccttgctgcttcgtagtttatttggatcctgaaatgccgctgagtttttcttgtcacctgcagcattgccaagaacaaggagtgcaccattagtgttaatttattttttctggtactctgtgcaaggcagatgggcatttaatgtgctgattccaaccctaccttccctcatctacactccctggtctcataggagttaaaacatagttttgtaagaaaccttagctccttgaacttgtggacttgtgggagaatcatggaaacatgagagttagagggaatggtagtggatatctaatctttagtgtacagataggaagggtcactgaggttcaaagaggttaagaacgaaagtcatagacccaattagtgactgagctagatagaaagtacgcccaagtcctctgcatctaagtctagtgccttttccagtttttccaaatgtctctcagatagcctatataaaggtttggcatttctgtagcgttgttctctcgttacctcttctgagcaatgccagctgtccatgcagagagtggggcacttagccagtgctgggccaaagctgtctgtaagaagaagttgagtgaatacattgacattttcagcccatggtagatcctgctttgcccttccggctctatgtgacctgatgcttcagaggaagagtgaatacatttgctgttcaactaacaattgtgtgtaattttcagcctgccttattcttcaatgctgtcttcccacgcctccaccacatgccacagcatatctgcttcgcaattacgctggtagggacttaccccgtttggaaaaggtttgcctaaatacttatttacttgtgcatgatacatcttgattgataccttgttaatctctgagatcaacccaagaatccttccttcaagggggaggatagaagagtcagggaaacgggtgacagaaaaagagaaaaagaggactgtgcttcctcactgatgagcaaagaggagaattacagatgatatcaaaacaatgaggagaatcacaggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagctaagactagaagctgggtctgaattctgaagatcaggcatctttccactaaatactgagatgtgaacaataatggagagccgtatagcccagaggggaaaccacattataccactttagtggatgattaggaaagcagttttgaaattccaggaaggtactgacttttgtataaagagaatgttttaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaagagtagcatattgatttggacgaaaaaaaggaaaatatgaccaaacactacttctttctgtttttgtgggtgacagtgacttgacattcacatggtatcctgagagaggcttagtagctttgttagtattaattgtcagtttgcctatggcactaagttttcccacctatgtggggcgggtcctggtcatcacatagccttttgtagttatttgctttctgttgtgccttgattttttttttctgttgactattggcttcatcactttgtggtcctgtggcttattatgattagatttgagggtacagaatagagaaaacattatggcaagtagaattcaagagctggaatggaaataataagagcaaaaactactgttaagtgctgatttcctttgaattgtggtgttttcctttcttctccaaatagggaggtagtacagagtgaagaccggagatttggagttaaagatctgtgtcccagcttcagctttgctatttgttagctgtatatccttgagcaagttattcaacctcttacagtcttactttcttgatttgctagatgtgggtaatgatagtgctacctcatatggcagtcaggatgacagtgtggccattgaaaatttgctagacatataataaaccttcaataaacacttgtttattgtcagtctctagtcttcttaggaccgctgggggaacagacagaagagcagcagaggagttgataagtgaaacctcttaggttcttcttaattgcttgcatgtgacaatttctgaaagagcaatgctgaggaagcagcagctccccagctcccttcagcagtaggcatcttgcttagaggagggccactgctcttgctttcctgtctgctgatggtggttgtgtattctcagagcctctctggaaatcttccctttcacttcttgctttcatgatgattatgaacttcaagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcactctaaaatattagagctgattgggactttacaggtattcattttgcaaatgagtgtcatctcttgttaaaggtcacacttatatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactgttctccctgaatccctcattttggtgccgctggtctgatccctgtcctacagaaatgccttgcttcatacccaagctcacagtattatttctaatctttgccctggttactccagttttcttttatttactcagcattcaaagtcctggttaagggctacctctgccaagcttatgctagcttttctgacatcccccaagatttttcatgtgctttctgtgttgctctctttctcttttcacatttataaatatttcttcctcaaatagtctttgagctctttgagtaaagaataagaatctgattcatctatagctccagtgccaggcaaataaattcattcattcattaaattaacagacatttttattgagtacctatcatgtggtagcccctggaattataaaatgataaatatttccactctcaaggatttgcgagtttagtttggggaacaggaaagcagatgggcagagcaccatgtgacgaatatgtgacaacagtatgtagatgctgtgggattgtactataaggatgtataacttgaactgtagaatatagtgcaagatttgccttcaaggactagtagaaagtaatgcttatgatctaaattgatgcatagtatgttggaagtcatttttagacaagaagtagcttgtttcagagggagcagagatcaaacctaggaaaaaaatgtgaatttctatcagaaaagtactgcaaaatgacctcagaataaatagaaaactactactattatcatagaagttactggcaatatgattaatgtctgttaaaagaagatgtatttagatgactttatgctgaatttggataacctttaaaaaaccagataattccagtgtagttattaaatatcctagacagtagaggaggttggagaaaactcccctatcaaaacctaatcatgataagtaaaacaagcagaaaaaaatgctataaaatgatctttattatgattatatgtacacaaattatagataaaatagcctagttaattcattaatatatcaaaacacaagtgtaacaaaggatttattctaggcatgcaaagatggttcaatatgtagactttatcaacatatttcattacatcatcaaattaagggagggaaaaagagttgaatgtatcagtggttgctaaagagggcactgcagctgtaactagataggattttattccacaaatgccaagatagttcaatatctggaaatctatcagcatgcttcattacatcaccaaattaagggaagataaaagagatgattgtatcagtgaatgctatagcaattctagaaagatatgagtaactaagaaagagtaacgttcattcattctcccatttctatgtaacatacttgtttaaggggcttcctgcctaggcattgtgccggtatagtgagactagttggagtttccaacttgttgggacatgtaggcaggtaaataaatggctttcttgtggattgttataagtatgccgaaagtactaaagagcctagaaaaaggaattaggctactcttctttggagaagttagggaaatgttcacagagttagagacatttgagctgagacaatataaaaatatagggcttggtagaacgtgaagagagggaaacgacattgttgatggtgaacacagcatgagcaagggttcagaatcttgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggttttgtgctaggccttaatggtagtttataaatgtgtaaaatatggtccctacccttttaaggaactcaagtttagcaagtatgtatgtgtctttgtgtgtgtgtatatatatacatgtatgtatgtgtgtgtatatatgaatatgtaaaaggtacgggggaaagaaaaagaaaagaaaggccctgtaaccagagtgaaaagccagtaccatcactggcttcaatagcatgtgtcctgattaccagtttagagtctttgtcattgattcatgttatcctcgtcttttaagaaaactatacatcaagctgttcttccaagcaagatggtcataaaattgccattgactttctacaagaatagaggcttctttttttctcactttgcatagcactctatactataaaaagtactttaatatcatctcattggttgccataaaaattctgagagttaaggaagacagaggtttatatgtttgtttgttttttgagagaaggtctccctctgttgcccaagctggagtacagtggtgcaatcacagcttaccgcagcctcaatctcccaggctcaagtgatcctccaacctcagcctcttgagtagctggaacaacaggtgtgcgccattatatcctgctaattttttaattttttgtagagaccgagtctcattctattgcccaggctggtctcaaactcctggcctcaagtgatccttctgccttggcctccaaagtgctcggattagaggcgtgagccattgtgcttggctgagtcctctgagacagtgaaactatctgaggctctagaggcgatgccgttcaaagtcatgccacttgttggtggtgtggactgatgtgaatatccaggcaacactgtttcccagctctcccctccaccctgtctctctattactatgccatgtactgaggcctttgatttctgtgttctgatgctctttgtctttacagacatctggaggtaattgtgtagccctcttaattaattcagttcaattaataaattagtaggtggcttttgggctgggggcgcttacagggtgccttccgggcgtccctgtgctggagagctcttgcaatcaggcttggagagccctcctcggcagcagcctctgagtctcatccccagcaggcaggctgactggagaggtgattggcttaccctgacagaggagacatttcctctcttcaaatattatatgcaatctgatcagagcagcatctgggctgggctgattgttcccctcctagtttaagcaagcttttcatgaaggtccaacatggtatcagctcaacatacaagttgatgggcatttctttgttgtgcggggctgacctttgcattacatgtgttgaatattctatcctctggtcctaaattctaataattgtcccagacgttggggcaaccaatatgcccctcttccccttttccacataccccttggtggggaccagagctgctcctgcagatggatcatttaaaagtgtcctgccaggtatctgttaaaaccctgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggactctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttgtttttttttttttttttttttttttttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctaaaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggatggctggctgggtgagtgcactgctcagtgatgcttctccaaagcagtttggaatatggtataactcagtcttttgttttctgaaattttggctctctcttgcatttctgccaattctcactctttttctctctccccctctctctaaatataataacctttaccttttctgaatatgcaagagaagaaattttcctttaatatataagttaaagacaaatcttgggaacagtttatggacattcagactttttaaaatagaagctacatttctgcatctgctgtatgaaacaaagatgtatccatgtatttgttggaagtagatttgcttttctttatatttaatttaaatgttatcagtgcattctgttactctgaacatttttgtaacttacatctattgtgtttgtttacacatttaaacaatttataaccattccttttcgtttctttttttcatttagaatgttctatactctcagtgaaattcccaagatagtaggtagcacaggttttatttccaggatgcattggtgataccagcttatgctctgtattgcctcagctcatgctgtttttggcttttagagtgtacttgtcccccagtttcctgcttctacagtcttttaattcattgcttaaaagttgacctccacgaagctcaaccacaaatgcagaaagttagaactaatagaaatcacgcaatccatcttgttctgacgtaaatgtgaaaactgcagtctagagagtgtaagttatttgttcagagaagcacagcctgctctgagccgagttggcactcaagtcttttccctctaactctagagttacccaaaccttgtactatattctaatggcaaactgttctttactaccccataccctcatgcattgcctacaattcttatgacaatgtgttttttaatagatttgcttgtatatgcacctgtcttctctagcggagtctgaactttgagagtcaggggctgcctgactcatgccttttccctcaacagcacctagcaggatacctgacacatactaggaactcaatagtgtttgcagaactgaattaattgataaagcacagtaatataaacctacttctccagacacaggttctaggttctcagctacttattagacactgtggttctgcagtttcaacccacgtctttgcattacttttccttcctatgcccattctttgaacttacatttctcaccttggtgttacgtctgtaatctctggagtttgctttcccatgttttaattctgactgtgaaagtagaaaaatacccacatgttttccacatcaacttatctttctggggtacccatatttataatttcttttataagatattctgataataaccattttctaaagggctttggcacactgaaaagtggggcatgctttttttcccagttagtagctctttagatctcagggtccttttattttacttccattgttctcatttcttttcactgattttgtaacaagttgtgttttcatagctaacttagaatacccctacatttccaaatgctttctctgtgttcaatgctttgtgcttacgaactcatacttattttttaattaaatttagtcttcttagagattttttttagttcaatagcttttggggaacaggtggtttttgcttacatggagaagttctgtagtggtgatttctgagatttcggtgtgcccattgcccgagcagtgtacactgtagtcttttatccctcacatccttcccatccttcaccctgagtccccaaagtccattatatcattcttatgcctttgcatcctcatagcttagctcccacttataagtgagaacatacaatatttgattttccattcctgagttacgtttagaataatggtctccaactctatccaagttgctgcaaatgccattatttcattcctttttatggctgagtagtatcccatagtgtatatataccacaattttttatccatttgttggctgatgggtatttagaagatatacagacaataatcatatgaaaaaatgctcaactcactgtccgggaaatgcaaattaaaaccacattgagataccaccttactcctgcaagaatagtcataattaaaaaaataataaatgttggcatagatatggtgaaaaggggacacttttacactgttggtgggaatgtaaactagtacaactgctatgaaaaacaatatggagattcactaaagaacgaaagtagacataccatttgatacagcaatcccactactgggtatctacccaaaggaaaagaaatcattacatgaaaaagacacctgtgcacacatgtttatagcagcacaattcttaaagattttatagtgttaactatttcattttttgtgaaattattttggtatatatttatgatgttgttccatcactttctattctgtgtaactgatgacaacaagataagataatgcaatttttcttctggtcttcaaaatactagcctttagtgttgtttgtcctataatctgggttttcactctgctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgtctctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagaggagacattttcctttagtatataaattaaagacaaatattgggaacggtttgtggccattcagactttgggtctgcattaggtaccaattcaacgtgatcattttggtggaatccttttatattggtatactcttttatagtttatttagcagttgcatgttcattgtcttttcatttcagtagaaaattcttactgtcactctctgaggtaggtagaacagatgttattgtcattttgatgatttgtaagtagtagaagtggaagagcttaataaggaatcatgtagctagtaaaagagtagagggagaccctcacacctagggctcttacgaattttaaatgctttcgtttattaaagcgttggctacacagtctgatgtctcctttaacttcattattttattatttcatgattcttctttgaaattaatttcaaaatggtgaccctttttacaaaccagctttgtgaatattggttcacatagacttgtcaagatagatcaagataggtgaggtgaattatattaaatagggatcctaagcctggattatttttttatgacatctttctgtgctttctgctactgtgaggttacgaatgtattattccatggaggggaaacagttatagatgattgctaatctacccatgagtttggggctgaattgatccagaacccaggtttcctaaatgcactcattcagctgtaccactgtggtttatgggaaccaggcaagtttggagcttggttcctaggaactgatgagtcctggattattgatgcttggtggagaattagccattagtgatgtgaagccatgtatcctgggtaggcaggacacatttgttttcttagcagataactaacatgtgagggaaatggatgtccacttatggcattatatttaaaggaataatttagactggattttccccattatttttgctgcgaacgtatggtcctcatggtgtgcttttctgtctctggagtcttattgtccttttccccatgcaaagagaatcttgctctgactttggagatacaaatgggaaacatcttttttggaggttacaaatgggaaacatctttttgtaatcctgacagtcctgttaattgcaattagagactgcagttgtaacatcttggacgtttggtataagtatgcgtgttatgccatgaggatagccacaaattcacggaaacatcaggaactgtaatgaagctcgggtttgcctgtcatgccccttttctggatgagcgtaagcatctcgagcctcatccatcactgcacagtgcagtgcatgagttttaattttcaggtcctcagggggacaaaagaacaagctgtgtattcattaaaggatcaaatattaattgtattaatttgatctttacactgcatctttcagcagagaaattaacttgtaattcttggagtgacatcagatcttaccaaatattcttaggccttattgatgctcaaaagtgccaagatgcagccctggcttgatggtcagtgcagttacattcaagcttcagtttcatcacttggccttgggcatgatgcttttctaatccatatcctctttaattcataaaatattagctggtaataccaactgcctcacaagattgttttgaaagccaaatatgatgataaatgtgaaaatgtttttaaaccataaaataccttataactctaaggagttactattatatacttattcagcagtcatttacttaaaacagattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataaccttacatataattaccaataactattcaaaattataaaaaatactttaatataggttaagtaactctaatccaaaaatctgaaatcttaaatgtgaaaaaatctgaaactttctgagtgctaacacaatgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaatcttaaaagttatctaatacaacccctttctttcctagatgagaatagttgagaatgtattcactaatacatttcagcgaagtacaggttctttgcccaggagtgctgtaaataaccaatgaaaattcttgaatgcaggcaacaatttaatcttcatttcagagactcagagaggcaggtggcttgttcagtattgcagattagtaagtggggaagccaagccatgatcctggggattccttctctggttgccatagacacgttttgggggacttgtttagaagttacagtgattgaactaatatacccgaacaaagtggattggatgttttagaacaaggagaagtccctgtattgttgacagaaatctcttttattttgtaacttgtcagcttaattaactactgaaatgagttccttaataaggtgatgggtgcctcctaattcttgtatggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggtggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataatctggacatgcttaatgaaaaaactgtctcgaaaggttacatgtattatatgatttcattttaagacaaagctctagagttaaaggacatattcatgattgctaggggacagaaatgggtgggtcgggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatccttcatgttgctattcttttccctcagtgctttcattatagacaccaatcgtttgcatatgttgtcctgggtcattttatttgggatccaaaaccagaaaatttcaaacaacaacaaaaaaatggattcttcgagaatgccctagccatggccaagcttctgcattacagagctcttgctattgtgttgctttgggtagcaatgcctgaaatctcagccaattttgggtcacagtaggcctatgtaaattatctaaaaatggattcattatggacattataaaaataaatctgacacctgagcctttgggcaaatataccatataaagaaatcataccctagaataacgattaacctaaagaacttaaaaaaaatcagtatgatatttttatcatcctttcttaaaattactgcattcagagagacctgatggctgaggacagcacctggggcagaggagtataggtcattgggatgtggcatcctgagtcttctagcagtttgctcttccagcactctcccttattatatgttctttacattgttctgtatgtcgctgtcttcaaacagaatagataagtctactagtcaagatagacatataacaggcaccacatgtgcataaaaattgcattatgtaaatttagtgccgtaatataatatgaaggatgtcctctaggaggaactggggaaagcatcacagacgaggacacatctgatctgagtgttggagaatgagttagttgtttaccaagcagaaaagggtggtggacagcatggcatgccaagtaaagggaacagcatgtgcaaaagcagagaatggcccccatcctgacccttgtaattttggcagctctttgctgatgtcctcaggcaatgcatctgggctcctgggaatagctttgcaatgtgaacagagtgacttcactatgggtagacctaaatgttctagcgtgctctgaaacttacctctagaaatagctccaggaagttaggtagcttcagagaggaaggaccaagaaatatgatcttataccacaggcaagaagtactttcctggaggtactggccagaagtactattgctatctctctgcacttgtctgttatattttagaatgaaatgtgcctgtgcatacaaatgctaaggcaagaaagaaaaagcaaaaggcaattctctttaaatctcctgaaataatttcaggcagctttttttacctagtcaaacacacacgcttaagaatggagttgtaagctaacttaatcattttttgttttgttttgctctcttacttgttcacacgttggggtaatcctgagaaaacaggaagcaatgaaagaaggattttattgtgaaatgttcattacaacttgtaattttaaaatgtgtttgtatgagtgtgcacaaatgtgaataaattttagagcactttctcacataatatctagtttaatcaccagaatatcctgcaacgttattatagttcctacattattatggttcctaaagacaaatgaaaaatctgtgattcagagacccaaggttaggctaataaatgtagaagtcacatttgaccaaattttagtatcttcccttaagtattggtaatgtacgataaacactatttggtaataatgaattattacaattactaaaacaacttatctggcagaacagtatcttaactatttgaaaaatattgtagtggatttattagcttccatttcatctgaagtccactttgctttactgcttactttatctttctagctactctgtaaaaaagttattatcaccctcaatctgccaagtataatgtatgtaaagtgaaataactagcatattgcaaagctgggaattgaacccttgtctcctaaatccaagtctgtagctgttcctcagcagtacactgtatctcatgttaatgccattattacttgtattaaatgaaataatttttccatcattattttcccgaattattactatccagagcgatttgaaggttaaggtcatccaaataatgtgtgaaaattgcttaaaatcaatctcctgtgcatggatgtctatgatgtatacaaatataaaacagccaaagtagtctcaagaagttattaccaagtttctcaaatagtgtctcaaggcgacattatttgacaagacctttggaataaccatttggaattttccttagttcagttgaattgtgtcatcttgcttaaacttttcagatatcaggggtagttttattgacattacaatggaattaaaatgacattttattttattttttaccgttctatagaaatggcattttaatttgtcattatttttattattgatctgttaatgttgtaatgacttgggttttagtaagggcatcctctgtaaaaattacctcctgggaaagaaatctccaagttctatgaggtctcccagaaatatcaccacttgaggtgagagtaaagtgtcatgaatgccacccaatgtgattcctggtagataagatttcactgttttatatcttgacatctgcattaaattccgttcttttactgggtcctattcacttccatcttgtgccattgttacttaaccaggctctgtagtggacaggaaaaagtaaaaacacgtcttagcccttaaacagtttatattttcattagaaattcaacatatgaaaatgcccagttaactaacaatataaagctttactgtacagcttctatttgtgaagtgactccatggctaactctatcagaagaaagagtttgcttggagccaaggtagtattggaaggttacagagaagaaagactcagggaggcagtggttaagcttgtagactctggcatcagatagatctgggtttcgagttttgattttacctcttaattctctggaaacttggactcaccaggataagtggcaacctaagttctttcagttttaaaatagagatagttatgcactaggcgtggtggctcacgcctgtaatcccagcactttgggaggccaagggtggatcacctgagatcaggagttcaagaccagtctggccaacatggcaaaaccccgactttactaaaaatacaaaaattagccgggcgtggtggcacacacctgtaatcccagctacttgggagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagttttttttaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcgtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattacccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtttcatttgtggtggctcttatggcagcttttatattgtgaaagttaattattttggtcagttttgcctgtctccatctgcttaagcttcttgtattccttaacaaaagattcaaccacatcgatacaaccaataattgccaacttgattttattataaacatgtccggtaaaatgctgaaggaacaaataaatttatttttaaagcctggccgtgatcttacagtcaaaaagtggtccaccaaggttatggctcctaagtaccccacccgtatttcttattgtgataattgtttgtgaaactagttcttccctcactggccaaagtcaacactgttggcaggggaagtgagaacagctggtggttcacagtatatgctgagaatcagaacttctgcatttttctcatggggctagtaccagcttttgctctggccttgaccaatgcacgtacctttctcttccccatttacctttctcttcctctaggtctctgaagagtagaggtggatctttcccttcccaggttgtgccaacattattaccaatgttcccttttgttgtagaatattttggtcagtaatcatcagtaatcgctaagtaacagaaaatcaaggttcgacagcacggttttcaaaaacaacctcaaatactataaatagtctgttttctagtgttagcagattatggtacatggaaatcataagcattcagtgggggcctttgagcttacattaaatgcctgccttttgcttttatgtctttgctagaactgtgttcaatacccaaagacacagctttttctttgatataataatttttctaggctgtctttcctgccagtcttcccaaaatcccagtgaagtttgcaaacacctcattaaactaaatgcagttttgggagagatgagattgtgactagggagttttctggtttttacaaaaagaatagaaaaagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttgtgtgtgtgtgtgtgtgtgtgtgtgtgtgtgtgtgtgtgtgtgtttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttcctgtgttagtttgctgagaatgatggtttccagcttcatccatgtccctgcaaaggacatgaactcatttttatggctgcatagtattccatggtgtatctgtgccacattttctttatccagtctatcattgttgggcatttggattggttccaaatctttgctattgtgaatagtgctgcaataaatatacgtgtacatgtgtcttcatagtagaatgatttataatcctttgggtgtatacccagtaatgggatcgctgggtcaaatggtatttcttgttctagatccttgaggaatcgccacactctcgtccacaatggttgaactaatttacactcccaccaacagtgtaaaagcattcttatttctctacatcctctccagcatctgttgtttcctgactttttaatgatcaccattctaactggcatgagatggtatctcactgtggttttgatttgcattgttctaatgaccagtgatgatgaggtttttttcatatgtttgttggccacataaatctcttgttttgagaagtttgttggccacataaatatccttcacctactttttgatggcattgtttttttttttcttgaaaatttgtttaagttctttgtagaatctggatattagccctttgtcagatggatagattgcacgcttttttttcccattctgtaggtttcctgttcactctgatagatagttttttttgctgtgcagaagctctttagtttaattagatcccatttgtcaattttagcttttgttgccattgcttttggtgttttagtcataaagtctttgtccattcctatgtcctgaatggtattgcctaggttttcttctagggtttttatggttttaagtctcacatttaagtttttaattcatcttgagttgatttttgtataaggtgtaaggaaggggtccagtttcagttttctgcacatggctggccagttttccaaacagcatttattaaatagagaatctctccccattgcttgtttttgtcagatttgtcagagatcagatggttgtagatgtgcagtgttatttctgaggcctctgttctgtttcattggtctatatatctgttttggtaccagtaccatgctgttttggttactgtagccttgtagcatagtttgaagtcaggtagcatgatgcctccagctttgttctttttgcttaggattgttgggtctatatgggcttttttttggttccatgtgaaatttaaactagttttttctacttctgtgaagaatgtcaatgctagcttgatggggatagcattgaatctgtaaattactttgggcagtatggccattttcatgatattgattcttatccatgagcatggaatggttttccatttgtttgtgtcctctcttatttccttgagtagtggtttgtagttctccatgaaagggtcattcacatcccttgtaagtcgtattcctaggtattttattttctttatagcaattgtgaatgggagttcactcatgattcagctctctatcattggtttataggaatgcttgtgatttttgtacattgattttgtatcctgagactttgctgaagttgcttatcagcttaaggagattttgggttgagattttgggattttctaaatatgcaatcatgtcatctgcaaacagagacaatttgacttcccctcttcctatttgaatattctctatttctttttgttgcctgattgccctgaccagaacttccaatactatgttgaataggagtggtgagagagggcatccttgtcttgtgctggttttcaaagggaaagctttcagcttttgcccatttagtatgatattggctgtgggtttgtcataaatagctcttattattttgaggtatgttccatcaatacctagtttattgagagtttttagcatgaggtggtgttgaattttgttgaaggacttttctgcatctattgagataatagtgtgatttttgtcattggttctgtttatgtgatgcattatgtttattgatttgtgtatgttgaatcagccttgcatcccagggatgaagctgactttttcatagtggataagctttttgatgtgctgcaggattcggttttccagtatttttattgaggattttcacaatgatgttcatcagggatattggcctgaaattttcttttttttgttgtgtctctgccaggttttggtagcaggatgatgctggcctcataaaatgagttagggaggagtccctctttttctattgtttggaataatttcagaaggaatggtagcaagctcctctttgtacctctcttagaatttggctgttaatctttctggtcctgggctttttttggtcagtaggctattaattactgcatcaatttcagaacttgttattggtctattcagggatttgaattcttcctggtttagtcttgggagagtctatgtgtcgcagaatttatccatttcttctagattttctactttatttgcatataggtgtttatggtattatttattggtagtttgtatttctgtgggatcattggtgatatcccctttatcattttttattgtgtctatttgattcttctctcttttcttctttattagcctggctagtggtctatctattttgttaatcttttcaaaacaccagctcctggattcatcgattgttttgaagggtttttctcatgtctctatctcctccagttctgctcttatcttagttatttcttgtcttctgctagcttttgaatttgtttgctcttgcttctctagttcttttaattgcaacgttagggtgtcgatttgagatctttcccgctttctcttgtgggtatttagtgctataaattcccctctaaacactgctttagctgtgtcccagaaattgtgacatgttgtgtctttattctgattggtttcaaagaacttatttatttctgccttcattttgttatttacccagtagtcattcaggagcaggttgttcagtttccatgcagttgttcggttttgagtgagtttctgaatcctgagttctaatttgattgcactgtagactgagaaactgtttgttatgatttctgttcttttgcattttctgaggagtgttttacttccaattatgtggtcaattttaaaataaatgtgatgtggttcttagaagaatatatattttgttgatttggggtggagagttctgtagatgtctattaggtctgcttggtctagagctgagttgaagtccttgatatccttgttaaccttctgtctcgttgatctgtctaatattgacagtggggtgttaaagtctccaactattattatgtaggagtcttagtctctttgtaggtctctaagaacttgctttatggatctgggtgctcctgtattgggtgcatatatatttagggtagttagccctttttgttgcgttgctccctttaccattatataatggccttctttgtcttttttatctttgttggtttaatgtctgttttatcagagactaggattgcaacccctgcttttttttgctttccgtttgcttggtaaatattcctcgatccatttattttgagcctgtatgtgtctttgcatgtgagatggatctcttgaatacagcacactgatgggtcttgacgctttatccagtttgccagtctgtgtcttttaactggggcctttagcctgtttacattgaaggttaatattgttatgtgtgaattttttcctgtctatgatgctagctggttattttccctgttagttgatgcagtttcttcatggtgtcgatggtctttacaatgcgctatgtttttgcagtggctagtactgtactagttgttcctccatgtttagtgcttccttcaggagctcttgtaaagcaggccttgtgttgagaaaacctctcagtgtttacttatatgtaaaggattttatttcttcttcacttatgaagcttagtttggctggatatgaaattctgggttgaaaattcttttctttatcaatgttgaatattggcccccattctcttctggcttgtagagtttctgcagagagatccgctgttagtctgatgaggttccctttgtaggtaacctgacctttttctctggctgcccttaacattttttccttcatttcaaccttggtggggtaacccaatctttctctctggctgcccttaacattttttccttcatttcaaccttggtgaatctgacaattatgtatcttggggttgctcttctcgaggagtatctttttggtgttctctgtatttcctgaatttgaatgttggcctgtcttcctgggttgggaaagttctcctttctttcagagatgccctgcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgctccaccctgcttagactcaacctctgtgggctgcacccactgtctaaccagtcccagtgagataagctgagtacttcagttggaaatgcagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatattttttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttcaaaaaaacaaaaacaaaacaagaacaacctgatcacgtctttataattgtgactcaatcctcatcagataggacctttctgttcttcacttttgagttataaatcctagggaaaggaacaatgaggaacaattagacaaagaaataaaataagtactttctatagtgagacagcactagagttaccttgttaactagactgagagctggaactctaagcctttcatcattatattgacaatgtgtaacgtatggttaagttacagaagaaacattacattattattattgaataagtaataattatgagttttattaagagggcccagttcaatttatatgtgcaaaactgatgcccttaattgtaacaatactttagaaatgatagtggaagtaagttccttttgcagagaaaatgcaccttaaaatgcctaggcacaaatttaatgagatacattgttctatatcccaataaaaacaaagacaaagccaaagtaatgtcctcaaactctctagaaggacacgaggcttaatggtaacagtccctgatgcaggtgggtcctcttaggcaatcttaggtttgcattggccttactatatggtgaaagtgagcatatgttttatttatgcatcatccattttactttagattgaaagtatttccccatgttttggtaaaacctgctgctcctgaaacctacctttgttcctagtcctgcccttataaattgcaaaaaacaaagccaattcatcttgcttatatgagcccgtcttccctttcataatagagatatgtccttcattctgactcgtcttcttttctttaagcggaatagttccactgcagagtctcttaattatttaatgtagtacatccggaaagacctcatttgtaaggaccaagaactgaaaatattgctattgaatgcagaaagggaatggtaaggttctctcagagaattccttttcctaaacaaaggtgcaattgccaggaagcaccttcacatttttctacaccatgtcaggcttccttatagcactgttatatgtggccgtattatggttgacattaaaaaatgtgtgtatttttgaaagaactacttcctttattttaaatagaaaagaacacagcatctctgagagtgagaagatcaaaaataagttaaaagcttttcttgtgattagattaaccagattgattaggacaaatagggtttatctatagcttaataaataagttattatttcctcaaaatttagacttactaggcctaaaggagcatagaggtctttagacttaataagtctaaattttgaggaaataagttggaaaaactagagttcagaatgagtaatagtaaaggcaaaactaagattattaagaaaattatcagaatttcctatgtgatttttttaacaactttccctggcttatattgtacatgggtttaagttatcttacagctctttaattatttttaaaagtaggatagcatgttatcttccttctctctgtctataccaagtgtttgttatttgagcattacagttacacaccaccactatctggttgtaccgtgactgaaatatcagttaattggaaaagtgaaaaaaactctttaaactcaacctatacaattaagatgatgaagtggcagcaatcattgcactcttttacttacctgtgtgatttgttataccatgtgtttgtttagaatgtaaataatgtgcagttagagtaatagatgcagatgactgaacatccttagacatctggagaagcagcactggcaagattatctctgaaaatttctgaaaatctttttgttgcaacctgagaaggcatagacataactgaaagcccaatagtaaggccaagttcagtaaagttgaaaatgctttacaccatcactgatgatgttgagtcttccccacccagctcaacattgagattttttttttatatgtagaagttatttgttccagaatttttcctttaattcattgaattattacataattaactttttttttctttaggatttcttggctctcaaatacttttactctttttagagtgctacagccacagttttcttaaatatagggatttttgaggtatcatattttgctaatggtaagtttatagtattcctaagcagcttatctcatacagttttctctatattgaatatgattcagatgaaaattaacctgcgtgaaatggttgtcatctggaatgactgccttttaccctagaaaacagccagcccaaggttgagaacacatctgagaaactgtgcctattttgagaactaccaagaaatttttattcactggaacagctgccaggaaacttgttggtcatagaccagtgccttagttgggcatttttttcagaagtagagaaaggcaaagctagagtcaccgagggattggaaggatgaaagacgtgtagttgaaagctgggcaccatggaagaccgaaacactcttcaaacattctgttttcaagaataaacccaaccctaggagcacgagacagagtataaagagccatgatttttagcgaagacctcgcatttatcttaaaatttgattttgttgtgaatataatctcagaattatgcagggatggtccatcaaaaaggtctgccagagtcaagctgagtttatcttagccatgctgaaaagtaggtggcagtcaatcaaaatggcaattactgtacaagacaagagttcactggagggaagggtgaatggaaaggacactccctgcattcttgaggcctatgtaaatcaacaaatgactctgggttagtttccacaattgtaaaacaatgtgattgaacaatattgtttcttcacttccttcctgctctaagattgtacaaaagtatgattcaactacagatattgcataaaattggttactcctgaagtgcatggagtaaaattgttcccatagaatatcgtgaatttagttaggttgtgacatgggtcatagtctccgcagtctgtacgccctcagtatattcctctgacaaccccatgtcctttcattctaagctaatatccttacacatctttttctctacacctgagcaaaatatacattcatgttcttaagtgcatgtagttaagaggaagctaacacttaatttgttcctgctgtatgccgggtatctggtatgtcatcttcatagcattatttgaagtttggtactaatatttccatttttcaagtgatgaaattaaggctcagagagatagtaagttgcccaaggcatcatgacttacaaagaatggatcttagatttgaacacaaatatctctaaatccaaacttcatgatttttctactgtatttcatttgctcacttccaaagtctatacaaaaatatttgttaaatgtgcatgtactgagctaccgatatctactatatctgtgtatacagcgatagctatcaaaaggagagacgtcctctaaatctttgataaaagtatgtcaaaatggaaccctcccagaaggacttcatttttaatagaaatcagagtattagctgaaggcacgaagttctaagataaaaatgtagctatgaatcagggtggattcagagaggtctttgtgtgtatgctataggtgatcatgtgtgaatttgacctacggcaagaagaattttttttttttttaaagctcttccaggttatccttgtgttggggaggaggatagaataaagaaatgaatgtcttgctggttcttccaagttgtatgaggataatatcacccagggatgatatgctagataaagacccaggatctttattactttttgacatttagttttgttgttgttgcttaaatttctagtctgttttgatggcattagaacctttaaaaggagcttgtaaccttttctttttacttttcctgaaatgtgtggatgggaggattggacaagagcctcaagggatgggaagaagagctcagtgcgaacacacatgcatttattcatttagcaaacatccattaagtgcctaggacctttaaggtattctgccaagagctgtgcaggataggaatgaacaagggatgacctttgctttggctatgtacaccagaaaaacgagcaggggctggaggactcttgccaagaagctatttagtggttctcttagagccttatctctatctaggctggagattaactcagaacatttttttagtctgtttacctctaaaatgaaaagaaatatatattaagaataaggaggtggcgtggagctttcactgaatgtatttcaactggagtattgaacgttatagtgatggatacagttaatccatcacaaccaccatttcaaaggaaagtggggaaaacctttgtccctgtgtgaaaaataacttaggaaattttggtctgacagttgtgagagggttaagaaagtcaatcattttgtaaccaggcacagcaatcttgtatgaaccatgtcaggatgttgtctgcatgccgtctttgctgatcacagtaatcgggtcataagagaaagggaagtaatagagtgtctcttagcaaccaaccccaggaaaaagaaaattactcaaacccagccatccagccagagaagtagaaagaaaaaaatattctgatagtttgctgaaagagctcagggatgagagagagagaaagagagagagacagaaagtgagagagagagagagagagagagagagagaggagaaaggagagagagaaggagggagagagaggaaagggagaaagaggagaaaataggaaggagagagagagatgatggagaagagaggccagagagaaagaggaaggtatggagagacaggagggagagagagagagaaggaaaagaaggaaggaaaaaagcagaaagaagtaaacaaaaaactgaaaccttttatttctttgttttcctttctcttggtgttatctttttttaaaatttttatttcagaaagagagaaagaggcaaagagtgggtgaggacaaaagaaaccctgtctcctaaaacaggaacttgatagtccacatcgtgagagaaagtggggagggtgaatggtagtataacttcatcgtgtcccatgtttctcatggtttccagttgcgatctggattactgttgagaagtaataggaagacgaagtctacagatgctgtgattagtgttctaagacctgtttttgaattctctgcttgttaatcgtgtagcagtcagttctacagcttactgcagtctttatagtaatgactttcgaactttgttttttctgacataaatagtggtaagaaacacatagtacattgacaagagcgtatatatgtacatgtcaatgtaatatatattgtcaatgtaatattatgctaagtgaaattttcatatatagatatatatattttttcatatataggctctttatgtgatgcatactaatgttttctattcaatttcattacaaaaattcttttggatacctgctgaattgattgtatgaccctaatgagttacattcttccatttgaaaacaccagtctaggatcagcacttgccttacattttgattttactagagtggtgccaggcagcaagttcagtcttggtgaagagtctttggccagcactgtgatgttcagaataacagctatttaagctaaatattttcttgtcatctgccaagtagatgtatcctaagagtctgtcctggtttggaatttaaggggataaacctgaggcaattccccctggactatcttcagtttagaaaagtgccacagtgtgttcaagaagcaccggactggactcaggagacttggttgcgcttgatggcatccttttctcactctgagcctggggtcaatgatggatcgaattagatgatgtcataaattccttctggctgtaacatcttggaatttatagctggatggggctccagaaaccatcctgtctaatgtctttgtttccaagatttagttcttgaaaaggaatgatagacttcctactttctttaaagatctgtgctaggaacaagtatacatgaaagactgaagcttagtacataacttcaaacatctcagtgtggtataggagtataccatgcgcacatataaacataattcgaagaaaatatataatttgttaaacactacaggtagggtagaagtaaaatataaaaactcagaaaaatgataatttaatcttactgggaagaatgtctgaatgctacactagtatataaggaggaaggctttgctgtggactttgagggaaggaaaatattgataataataggatgttccgggtagattaaatgttgtagggaatcaaagaatggagtcttaattgtctcctttgagttctgttttttgacctcattgaactcacaagggtttactttttaccactaaatattcctattattttatagctgttttttcttccaatttaacatgactttttaataatgatccattgcccacatttagtgataaggtgaggtttgattaaatagtatttgtacagtactacctcctacttggagacacacgtttatataaacacaaggtgttatataatttgtttctctgttggggggagggggaaagtaaataaggaaatataaattaatacctgttttcttttcaggataaataatatctgaatatgtttctttttctttcttttttcttaatgcaggctttatttagtttgattttacctttagaaatttataaaccatggaaataccccacatttttggggatattggaaataatctctgtgatgtcactttctgaatcagactaaggtttgtttattacatcagttacaggaaataagtgcataaacctgaattaatctgaggatgttgtgtttgtaatgttgcttccattttgtccctttccttgaagcttgaggcacttgcacatctcactcagtcttccttttctctacagctttcctgctgtcctaaagagacaaaaggcatatggctttctccagctgcatttcctgacctgtttccttgccatagatcgcttctaaagcaacattcccaccatttgaacttccattcttcctctgtcccaaacctaatattaacaataacaggagccaatgcaatttttcattataatatggtgttttacattcatagcacacacattactttatttgatccttggaactcgtggatatgtaaatggcaagagttactcttccattgtgtagattactaaaatgaaatatctagaggtaatgtcacctagtaccactgactatagtgttgtgataccaataccagaataacagggctcctgacttctgacccaagggagataaggtggatcatcttaaggttatggctgatatataattgacgttatcagttttagtaaattttattttacacgaagaaactgaggctaaaagaaacggagccactagtgcttagggtgtcaacatcagaatcagatctttgattcccagatttaacatttcctagattctgtgttctaatcatctcaatggacagtgcagatattacttgagaaacatgtttgcatttcgtgaacaactcctgtttattttcaacattttctatgtataaataatgtttgtgtaagcatatatttacttaggacccgatatctgttcagtactgttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacggccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgctgataaatgagacttaggtacagtgctttttctgtaggattcaggcctaaatggatctaggaggatactagagcttccgttccaaagtacgtgcatttgaatgatatgctaagtaatgccttgtgtatccttcaacaggaaaagttcctgctattaggataatttgatatgcacttgatgtttgctaatatgtttcaatcacataaatccttcttggatatttttgttctttgtggacttcaggtaagtttaaagatattccacacacttaaatatgtacacaaatgactttataacaagaaagcaaatttgtttaaaaaacaaacctacaattctgtctctctaacacatcaactccattttctctgtactcttttagtctttgccaatatatgtttatagttttcataatatgtaactaaagatagacataattttgcatttttttcacttaatactacagaataagaattccccaccatcatatttagcaatggcattatagttcttgaagtaagcatcccagaatttattgaactattgccatattactggtcgtttgtgttatttcactgctttaagtgtttttatgttagagaacataatgaaggtcttcatgggtatagctttttgagaagctagacatgttgaagaaattgggagcatgctattactagcttctatgaattggtatttactatgtatccctttaattaaattccattctgcagtaagtgtgatagctttgccgaagcacttgggggccaaaaggacatttgtaactggttaagttggaagatatttatttgtataaggtgggtagggacaggatggacaggctatttttcttggccacactcactgaatttaaataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcatttcacacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttttgaacttattaggcagacctaaggttttttacacttcctgaggctatagaacagaactaatctcttagccttaatgtcactataacgtaaaaaccacgtgaagagaattacgatggtgagcagaggataggacacttattatagttgttacctcatttatttaattctttgtttcttagagaataagattctggtacatagcaggttcccattaaatacctattgatttaaagtttaaaacaaggaataatggctaaatgaatcattgaatgcgtatgtctatttcttggaggtctaatcatgttttcaaaactttggctcaactgtagttagtgcagagtatgtatggtcattctgctagagcaaaatcttagtataggattaaagaactctgcaaattgttaaaacatgcaggtacactagtttcaaaatgtattagtttgatttattattgtcattttctgataaagaaaggggagtagtctcccctaaagtttggtgattaagtcaccagccaccttttctattttggttgttgtggtaattggtgtttcctggaaattttccctctgttctattaataatgttaaagggggttacagccgtgactcactccaggaagtcaaccatcattcgcttcctcaatctcaccaaccagtccccatgtacaaaatcagcgacttctgcaaatgagttactttacagctctcaagagagttctagaaaatacagcttttgtatttcgctgtgtgcttcctgccttggcagagagtaaaacaaaccttcatgttttgctccttggtagtctcgagataattgaccagttaggtaactagtgtagtctcactcaagagaaatcccacttgctgtctaacaaaagtcccttggcactcagatttgcaaagttaaacctggggacagttcatgaagtccagtggagtctatacttcttttatacctggctttatgtttctgtattcattattttgctcaatgtttaattaagtaatgaatattttaacttgttcaacatataactccgtatgtcttagcactgctgtgtagtagataccatcataggcactgaggatgcagtacagacatggtagctgcccttgggaaccttctatcctagttattgttcactatattaccaagttaaccacagggaaaacaagttcagagaatacataggctgtgggcctgtcctaaaggaatcaatctgtaaccgacatgtctaaagttgtgcaggataggattattccacttaattctgtaatttgttttgtctggaatttatctcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgaactttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgattgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgtgtgcgcctgtatacatcagatatatggattgatgcagtgtactctctctcccttaatatgtgtgtgtgtgtgtgttgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatatattcttttgtagtgttgcttacattttaaataaaaataaaactgcagtggatgtgcatttgtcatcatttagaggccttcagaccccaattcgtagtttcttcacagttgcctctattttctgattactagtccctggaaggtacagtgtcagagttgaagggatgttctcaaatccccctaaagttttccattgcaatactcattacagtttctttttttcttttcttttctttttttttttttttttttttttttttttgagatggagtctcgctctgtcgcacaggctggagtgcagtggtgtgatctcggctcactgcaagctctgcctcccaggttcacgccattctcccacctcagcctcctgagtagttggtactacaggcgcccgccaccacgcccggctaattttgtttttgtatttttagtagagacggggtttcaccgtgttagccaggatgctctccatctcctgacctcatgatccgcccacctcggcctcccaagtgctgggattacaggcgtgagccaccgcgcccggccgcaatactcattacagtttctaattgcgtatgtgtgtaaaagaacatataacttcctcacagactcagctgtacactctacaggggcatcattgtatcttaggggtctagcctaatggctggtgggcactaggtgcttagcaataactattgaatgaatgaatgaaaaaatgaataagtgaattcaacacaacttttatttatttatttttattattatactttaagttctagggtacatgtgcacaacgtgcaggtttgttacataggtatacatgtgccatgttggtttgctgcacccatcaactcgtcatttacgttaggtatttctcctaacgctatccctcccccagccccacacaccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacagtctacaacaacaaaaatgacaattcctgcttgccattgaaaataatgcaattgaaaagaaagggcggaagcaagttcttggctgcatagcttcagtctgatgccatattctagagtgaaaaggtattggcttggttttgaggcctgccttcatcacgtgaaggctctgtggcatggcagggttatcttacgctattgaacctcagtttctccatttatccaatagagatggaaagtattggcctgcatttatttctccttcaaatgacatattgtatagaagcgtattgtaagttgtaggtacttaacaaacatgaaggactgttatgatctcactttctgggctaaggagaaaatggtgggatgagtttcatgtccttttctttgtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacaggctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatggtggagctgtattctttttctaataatacaaataatatagggctgtaagggtttgtatcattgcatgtatatgttaagaggataagaggtatgtataaaagtaaattttgagaaattataagtataaaccaaaaagtcttatacctttagcaatgcctttaaatcttgaacttgaaagaaaaagttatgcccgactcgttgattgcatattaaataggaaaatacatttgttatacttgaactagattgttcttaggattttgtgaaagaaaatatataagcatgaatttattatagaaaataaaaatgaccctagaagaaaacctaggcaataccatttaggacataggcatgggcaaagacttcatgactaaaacaccaaaagcaatgccaacaaaagccaaaattgacaaatgggatctaattaaactaaagagcttctacacagcaaaagaaactatcatcagagtgaacaggcagcctacagaatgggagaaaatttttgcaatctgtccatctgagaaagggctaatatccagaatctacaaagaacttaaacaaatgtacaagaaaaaaacaaacaactccatcaaaaagtgggcaaaggatatgaacaggcacttctcagaagaagacatttatgtggccaaccaacatatggaaaaaaaacctcactatcactggtcattagagcaatgcaaatcaaaaccacaatgagataccatctcacgccagttaaagtgggtgatcattaaaatgtcaggaaacaacagatgctggagaaggatgtggagaaataagaatgcttttacactgttggtgggagtgtaaattagttcaaccattgtagaagacagtctggtcattcctcaaggatctacaaccagaaataccatttgacccaacaatcccattactggatgtatacccaaacaattataaatcattccactataaagacacatgcacacacatatgtttattgtggcactgttcacaatagcaaagaattggaaccaacccaaatgcccatcaatggtagactggataaagaaaatgtggcacatatgcaccatggaatactatgcagccataaaaaaggatgagttcatgtcctttgcagggacatggatgaagctggaaaccatcattctcagcaaactgacacaggaacagaaaaccaaacaccgtatgttctcactcataattgggagttgaagaatgagaacacatggacacagggagggtaacatcacacaccggggcctgttgggcagtgggagactagggagggatagcattaggagaaatacctaatgtagatgacaggttgacggatgcagcaaaccaccgtggcatatgtatacctatgtaacaaacctgcacgttctgcacatgtatcccagaacttaaagtataatttaaaaaaaaaaagtaaaaaagacattgattcattcattcatttattcaggcaatgtttggaactcatgatgtgccaggcactgttttaggaccaggaataagcaatgaccaaagtatttgctctcctgatagattataaacaaataaatatataatagctcaagctgtgaaagtcacaggcacacagagacacacacatctccaacatatgcagcaaggtaatgagataaagaattcctggccattttttgtgatacaggatagatgtaatggtttcctatcagttttatcatttttaaggtctctcttcttagaataaattattttatttgtttcttccgtatgccatttaacagggaggggaagttttctgccagttttgcacccactgtttttctttttcagtaagagccttctcatagtctgcttgaaggcagcggtcttgccacatgtgttctatgcataataatttcaggagagtcttgtccacaatgcttggttgattacggcttgtgggacaccacttaaatgactagaaacagctctctttaataaacacactggtgttgtccatcattttaagtgagcatgagagcccagcttcattttgccactccaatctcacacggcctagaagaactagtgaaagtagcaggtggtgtttgactttcagtttttctgaaatgtgtctctttctgccactctccagacgccgtgccagtcaggccctcaaggtcaaaacatcatgaaattgaccatagattatctcagccttttctttttaaaagtgtcattgtaacctgttggttactgtgtatgtcatttaacttctctgtctttagtttctgaagtaactggttttacattgccatcaaaaggcttctgtgggtttttatttttctttgtttttatttgtttgtaaacaatctccttttctaaactcatttccccaaatttccttaatttttcacggactgatgaaaatgttttgctgcttccagagcttgtcagcttctctttgtggcattgctttcattgttgttctccaagttcccactcagctcctgctttcttcaaaaaaccctttggtttctaacatctatgttttcaacatggcaatggagtgagttgcccagggaatgattggaccgtgattgttttcatggctttcttttgccttttctccatgtcctttttagctctaagcctcatttgtaagctttctagaaatgtggattctattatagaacttctgtttttctcatttttgtagttgctttctcaagagcaggtgctggtgaccacaggacgagtgagagacgagatggtgtctctcctttagcagttggcttaattaaggaggttttttgaagtgtatgggcttcaaaaagtctgacatgtgagttgtggcctgtgtggtctaactctgattcctttggatacagaaccttagaaagccttgagaaaaacctcagagatcatctatgcaatcaattctggctttacctggagggagttttataaaacacaaatgccagggcttcaacttgagagactctgatttcattgttttgcagtgggtctgcacatcagtagtttatagaaatttcccacatgattttgtgaaaccagggttgagaatcacttgattttacagggcatatataaggtccaaagcaaaagtgactcttggctgggcgtggtggctcacgcctgtaatcccagcactttgggaggccgaggtgggaggatcatgaggtcaggagatcgagaccagcctgcccaacatggtgaaaccccgtctctactaaaaatacaaaaattagtcaggcatggtggcaggtgcctgtaatcccaactactcaagaagctgaggcaggagaattacttgaatccaggaggcagaggttgcagtgagcagagattgcaccatagcagtccagcctgggcgacagagtgagactgtctcaaaaaaaaaaaaaaaaaaaattaacctgtcatggtggcatgtaatcccagctactccagaggctgatgcaggagaatcacttaaaacccgggaagtggaggttgcagtgagccgagatcgcgccattgcactccagcctgggcgacacagcaagactccatcttagaagaaaaaaaaaaggtgactctccgggattctatagcagtatggccatagagtagggacaagaacatatgcctcctcatttaccatcagtgctatttctattttgtttactaccatttactctcatttgattgtgtcaaattatctactgttgtactggggggccagagtggattcccaagcctcaaccacatagaagagtagattggaggttgttttcaaactattcaacattatcagtgggttgaatttgtaagctatcaactcaaaatataaagataatttttataacagggtctatattggattgtaaaaagagggtcataggatttggatctttagggctctgtaattcaaaatttgggatgttcattaggactatttgtgttatgttgtaaaacaattgtacttgttggcagacgtcttgggttcaagttatgattttgcatttaggaggtttgggaacgtggacaaactcccttttgagttttccttcaccccgtctttgtaatggagataatattctcatttccctgggtttttaggaaggttacctgagatgactcgtgcaaaagctaacacataatagataataatatctatctaaatagatattatttagatatctatctatattgagatatctatatttagataaagatatctatatttagataaagatatctatatttagatatctatatttagataaagatctatatttagatatctttatctaaatatctatctaaataaatgttaatttattctgaagtgtggtaagtttatctaacatttactgtagcaaccaaggtggggctaaatatggggaccaatcagaaagatgatctctgtcagttttgcctaggacgttcagtgggacttgggtaggagactgtggactaatctcacctatggaaatttgtgtggcctgtgctataactgagaggaaccaagtaagcctgtgtatatggcaaatggtagtcctctcccaaacaacatttgtaaagaaaatgcattttgcactatttcttagtgtgtctgaggctttttatgttcataaaaatcttagtgagttgttgaaacgtgcttttctgaaaaaccttggaatttacctggtttagaattagaatcagaaatgtgtctttttaaactgtattctaccttcttaaatcttttgccttctgcagcaacatggagcaactctgatacttttttctacttgagggcctttcgtagtcagagattatactaagatagcaaaaaatagaaagtgacacactagtcaaggttggtttattgtgtggtaggaaatccaaaagacgttggaagcaacaacaatagctctgaggtccttggaaccaggagttttgaaacttttactttattgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcatagaagcctaatgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgnnnnnnnnnnnnnnnnnnnntgtaaatttgattagcgctgagacattggtattagttttttctacagatgagaaaacaattacatacttttacaaatgatacaaatatgtgtgaaatatatttaatcacatacatgaataatgctcagtgagcaggcatagaattgtcaggacctttgcagtatctccaatatataccctgcccatagattaggaactattgctgtactattgctcatcagtttaaataattatgttaattcacatttatctatatgatcagcataatctttcaaaaatcgatttacaggcctggtgcggtggctcacgcctgtaatcctagcactttgggaggccgaggcaggtggatcatctgaggtcatgagttcgagaccagcctgaccaacatggtgaaactccttctctactaaaaatacaaaaattagctgggcatggtggcaagcgcctgtaatcccagctacttgggaggctgaggcaggagaattgcttgaacctgggaagcagaggttgcagtgagccgagatcacgccactgcactccagcttgggtgacaaagtgagactctgtctcaaaaaaaaaaaaaaatctatttacattgcagctcctttaggaggtttactacttgtaatactgtagagtcttccagagtgtgcatccattgtatttcactgattgatttcgttagtgatacacctcaaagtgaggtagtcatatacctccaactcttggctgccacaaatgtactgtcgtgagcattttgtatatgtgttcttaatgattggcagaagttagctcaggatttgtggctgtggggagggtgcttgatcatagtgcattttaatattgagtttcactaggctctgtgttttttgttttttgtttttgtttttttttaaacataaaggcttcactagggttactttcccccagtaaagcattaggattcttgttttcttcatgccatcaccagcacggggtattgcatgactttatattttttgctaatatgatgggtatggaactactagtacctcctggtttctgcttcttttccatacatagtaaacagattcagtctctcaaaattactgggaagaaaagtgatttgtttcataagtgttaagtgtctgtttctggtcatggctatctctgggactgtggtcatagagaggcatactggctattcagcagggtttctgagtgggaaaaaaatctcttgaaaatgtggtgttgtcaaggaaggccattttactgatgttacttcagggcccttctttcattccttcatatttttcaatatttattgtatggcaattgcattgtagaaacttttctaggtacttgggaacaaaattgtgaacaaaatagacatgtcctgtggtttctctggaacctttagtgtggtcaaggggacaggcattaatcaaaatactcaagcaaacatttaattacaaactatcatgagtgctacaaagggaaaggagaagagctctggtatataacggggtagatgatctgtgtgtgcttacttgatgcaggtgtcttttggggatgctataagatagaaaatttagaggataaggtaaagcagtaggaggaatattcagacagagagaataatgtgtgcagagatccacaggcaagagggaatgtggcatcctcgagggatagtgaaaccagagttgttttgaggacttttattcatttattcaacatatttttatggagtgcttactatgctctagaatatgacagtgaacaagacagaacactaggagatgtttgagatgaggccgaaaaaataggtaaggggctcgccctattgtacactcatctcccttggtttgtttttttgtgtgttttcagagagaaacagccgtacttaacaatctggtttcagattcttttaaccttctgtttgcctttctctgaaggtgctacagtttgtttgacaccctcttcaagaggggccagtagaactaaggataaaatttttaagtcttcccatcaagaaatgtgtcgttaacattaattaagtttcctcactgttatcaatgaatatccctccgtatccttctctttcactagctgagcattatattatgtgttgttcaagggcagatagtctgtgaagaagtgctttaaaaactgatagcgtgtgggctctgagcatgttgtgcggctgactggcccccacctcctcttgtttcctttctccccagaaaggcctcacttgctgcatgacaagtcaggctattgtttgctcattcgatattgtcagctaagatgcttcacaattccttaagaatttattattgttgttgttgagggatgatagagtcctcttcttctcatttaagtgacgtgtatcgaaaaggaaaaatgacaaataagaaaggacttgggaaaatttcctccactcctgacttccagacctttagaacttaatgctttccgttcagtacttctgccccctaaccttaaagtcttgagagaagaatgactggtgttgacaggatgcttgtttactggcttctgcctaatttttgaggcatgaagtggccatctcatataaagcaagtagttcacatcctgggactgagactacaacctggtttctccttgtcttgtttcgatggagttattctgtatcctgtgaagaatctctgttttgtcatattgtattccctctttaaatcttttatatctctttctcgtactattttgcccctgatgctgtttctttctttattttaagctttagattcacctcttaagttgtcagcccacatggccatacatgaccatggttcttactggtgtgaagaaagcagattgtagctggttgtttgagatgccttcttaggtggaccaacctctctcgggttctttggttttatctcttgctcttcctcttgaatgtttatgatacttcctggtcacgtcatttctctttgactctttctttcttccttccttaggttccggattcatacaggtatgaatctacttccccatctttgccaaccctggcatcgtgcccccttgattccttggcttttcacaggctagatgcttaatggactctggaagcctttatctctaggacgcctttatctgtaggactgggcttttttgtttgtttgagacagggtctcactccgatcacccaggctggagtgtagacctggggtttctaaacactcttcaccttgtgctcagctccttgtatgataccgaccggatcctatccatggacaataacaatcttgaatgtgttcacaatgcctgggggaataagtcccaatccggccaggaaatgctgatctccttccgacgggatctgcttgtctcacctcagcgccagttgcttccctttacaatctctttgctggccaggttagaacatgtgctaattctctgaaaacacaccatgctttccttcctctgtgtctttgcttgaatggttctctcagtccagaatacattttaaatatttctacttccacaaatctattctatagtatttatcaaaatagtaccttccctattaagtctcccctgattctttagctgaaagttattttgatttcctctgagttcctgttaattttgtgggtacttctgttaggcttcttagcattctacagataaggagatgggacttcgtttaaacagctctgggccacaaatatagcatgtagaactgtggagattctaactcacattttaacctaaaatgccatactctttttatcctattacattcttctcattccatatatgtctatcttatgtagtatgattgaaggcagggtgcttgaataaggtgtaatgtttttgactacttagcatatcctaggcactgtgtgacatattttgcatttatttaatttggctgtcataaaatttctgcaaggcaggtacagttactattcccactttacatatgaggaagtgaggtatggaaagattatgtaacttgtccaaggttaggcagctagcaggtgacaggcaggacaccagcttaggcagtgtggcatcacagcctatgcttgtaactgccgtgcaatgctgtaggtaagcaagagctaacaatataagcctgaaactactggctttctcagttgatggtatttgagaagtgtggtctatgatattcctcagtaactttcatccatggaaaaccaacatatctcatttctataggttttaggatttaaatatttttaaggatttttctgttgtagactttaaatttacgatttgagataaactgaatgctaaatctttcctgcttgggaagaattcagatgtaaaattgtaatttgtattattggaaaacaactccagttttatgcattctatgcaaggatgagctatgtattagttcattttcacgctgctgataaagacatacccgagactgggaagaagaagagggttaattggacttacaattccacatggctgggggaggcttcagaatcatggtgggaggtgaaaggcacatcttacatggcggaagcaagagaaaatgaggaggaagcaaaagcgggaacccctgataaacccatcagatctcatgaaacttattcactaccatgagaacagtatggggggaccatctccatgattcacatgatctcccacggcatccctcccacaacacgtgggaattattggagtataattcaagatgtgatttgggtggggacacaaagccatgactagaataaaccacatcaagttacctgcttatctaaagttttagaaggtgttcacaatgttattcgaaagccaacttagtgtagtgagcatttggagaagcatcctttatacaagtgagatgacatacattgttaatatgtgcttttatgtttgtctttgcaagatctgagctagaatagaatcatagctctagggccaattagagtgggagatagtttaatagataacacaggtgctattttgtcaagttgcatggtttctggacagtttacagagaaaaaatttttagctgagagcctgatgaagtcttaaggctattattaatagtaatatttggggactagcaaagtgctcacataaaaagcaccaacaaggattaaaaaaagagaaggtactgaccagattcactgccttctattcccaaaaagattattaaaaggttcatgtaaatagaatatgcgcacacccaggagaaagtgatttatttttaagctgaagccgaggttttacacatccctgataatagggtttaattaatgtttggagtgaataaaacacactcagaagaagtgtagtcatatccttaatttccttgattggcaaagtaattgatatcatgtgtgacatttgagtcagtgctattttatcagtcacttgctctctgcgagacagagactgtgattgaaaacagtaggtatgggtacttgattttaaaatgaactctatcataatatactgattacagaatcagaagggcaatgttggtgaatatttttgggcaaaaaatgactgtaacctattctagatatggtaaaaccagctctcagtacttaccctataaagagaatattggtttttttcagaattttgcagagggtctttttacttagggaacaaagagaactgtaattgtcaaatgtggttgtaaaacggtaaatctatttttgttcatggctcattcattcacttggcatttaaaaaaaaatttttttatttgtttattttagagacaggattttgctgtcacccaggcttgagtgcactagtgcagtcatagcttactgcacgctcaaactcctgatcttaaacaatcctcctgtcacagcttctcgagtagctgggactattggtgtgccccaccacacctggctaattttctattttttgtagagatgggatcttgctatgttgtccatgttggcactgggctcaaatgattctttgctttcgcctccccaaccactgcgattacaggcgtgagccaatgggcctgacctcatttggcgtttattgacaccatattagaaaccctgtactacgtataaagattattgggggaaacttctcagctatgcatgtgtgtacatgcatatgtgctcattagatcttggtgtaagtacagtttttcttctagtcatggtttaaaatatctgaaaaggtgctatggggacacagcagtttacaccaacagggaccttataattaagtagatatgactgtaacatagagagcgataacgttataaaagaaacacaggtatgttactataagaatgtgatgaacaaatcatttgataaagatatcagcagaggcttagtgtgggagatgccttttggctggacttgggcagttggttaattctgaatggggtttggggtaggggagtcaggtgaggattggtgtgtgtaggtatgcctaaaggcgtgaaaatatttccaagaaggattgcgtttctttttgccactgatggcagagtcaacctcggcttctgagtttaagaagagtgtgagcacctcgagcaaataagtcagctaaacaaatggagctgaggcattagaaaacgcctgtcgatttttaagaaaaggagctcaactctaagagtgcaaggaaaaataaatgcgtggagtgacaggataatagtctataattacttttaagattgctatattgaggctgtgacagtcacttagttcctgagtcttttcaggaaagggtaagaggtaactagccagagctggagtcactccttgtagaagttaggtggctttgatagtgacattaactcttcagaaactccatgactattatttggtatccaaagcagaaatttatgaaagagtcacagaattttacatctgtaagataatcttttgaaaataattagaaagaattcaggtttagaatatacatgggtgatagacagagtagtgaaaacatccccagaatctggtcctgctcaaaaatggagcagagtttcttagaatgcactgacgtcttcacattgaccctgcacagtaccatccctgggagatctggcaaaggagacatttcagaaatgtgtgagttaggtgccatggcattaagatcttttcctactgtacaacttcccgtttttaaactcaccatcttgatgtacagctaactaatgtaattttccaaagtttctagagaagacaacaaccttattgagatactgggacatctgggtgccagtctagttccagttacatcttacttttgaaagaaaggaaaatccattaaaattagaatttgtctaggaagcatctccctcccaggagcggagtactagctcttcactatcattggtctaagcgcttgaaatgctcccatgtttggaatcccattgtttatgtatcagttctcccaacacttccactcgttaggggtatgatttaagagttaaggccaggtgcggtggctcacacctgtaatccaagtactttgggaggccaaggggagcagatcacgaggtcaggagatcgagatcatcctggctaacatgatgaaacactgtctctactaaaaaaaaaaaatatatatatatatataaaattagccaggcgtggtggcacacacctatattcccagctacctgggaggctgaggcaggagaatcgcttgaacccaggaggtggaggttgcagtgatccgagatcacgcccctgcactccagcctgggtgacagagtgagactccgtctcaaaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcgcacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgttttatggaaaaggagattaaagaatgcagtgtgggttttttttcatggccgatttctttctttccttctttttttttttctggaagtaggattggtttggggcatgatgtaggaatgttattgggtaagggtttaaactctatgtggcttctgtggtttggagagaccccaggttgatctgatctactatagttaacaagtcagataaactagattttatttgtaatccttttgtactgaagcccaaacaactggcattcttaaattagctagaatatcacttagtattccatttatagaagagttgtggttttaatttaaaaaatactgtaagtggagctactgaaataggcccaagtttattatagctaatacttcattacagagacttccgccattccctaaatctaaggagggggttgtttgtataccaaacatagtagatgtttctgtttgactagattacctagaaaatggcacctagggtaacaacttatgtgcttaatttgaatgaacacgcccagaaaaacaggagagaggaaaaaaagaaaagtaagagaaaagaggagagagagcacatagagagaggtacattatcaagctgtccacagcttcctgacaagagcagctgagttcttggtatcacagcacatcttcacaaaggcctcataaactagcgtgtctcagaatagttcattaataggagggaggaagaagaatttacgtagcagttcctgattcccatcgttcaaagtacatatttcctttttagtattgacttttccaggaaacttgttttattagtactcctactttccaaaataattctctatgtatggttttattttttaaaatgaaaacgataggaaagaaaattcttcgaattcattgtcatggggactcatactcagagaattggatatgacaatactcaacaccaaacctagttctgaaccccaatatctgattattatcaatagaatcagatcaagggaatacttattttcctcttagcaatctatattgattattcatgggggggggttctttgttctgagatcaggagaatgccctggttatatgtccatgtgtggccttagtcagtttctcatgtttcttatgttcatgtatcttttgcttaaaattggaaatatctaccttcaaggaaatactgtcgaagacatggttgacaatttcatagcagcagtttgatgaaatcattttgcacactgagtaaattagtcaattatgtaaaaattttatctgtagttttgtccaccttatgacaaaaattttggagaaaaacaacagccttattgatttacagacatctttctatttatcagtactagcatcagctttctgggacatgtcaactttcctgtttttgagtctgaatggatccataaacctaaacttgctgcaattggagtgcagatatcaagactattgcagaggtcttctcacacattatctgtgtgccttgagaatgggacctctactttggattctatttcatccatcctatacaaagagatcaagcaagataatcacgtattctctctgctttggcctttgaagactttaaatgacttagcttggtattaaatatttcatccaggagaagttgggacttgaaaatcaggctttgtcccttgcagaaaacttgactggttccaggcgcagttactgttggaacagaattctctttaatcttttgcggccattatcaacattgattttattccttgtgcagggcagtagagttccagcttctgtgttattacttttaaaacatggtataattttaggaaaccattttctttgtttctgaagtgtatgtataggctatgttcttcacattagatttttattttgaaagaacatggcaaagtgtggaaaacaaggaacatagttaacatgatcaagatatctgaaattgtgtaattagtgatagcttggataaagttgatatgaataagtaatatagagcagggagtgtccatgaatggagtggagttagcctcatgtcaaagtttactgtcccccagccagacctcagcttgtagacttagtattcaatttggttactctactgtgaaagagatactctcatctggagaagaccagccaagatagagagagaactaggctatgtcttgggaggaactgttgaaagagattgtaaggtgactttaagaaggtgataatcagggataccagaggaagacttagaggactccagaggatagaaatatgccagaatacagaacttaaacagaggcaaattttcattcagtacagaaaaagagtttctgacaaagtgatctgaaggtagaatgggctgtcctgggggatggtgagctccttcccactggaggattttcaagccttagcctagtgacccctaaggatatcaagatgtacaagggtcagtttgtggtttaactaggtgaccttcccctccaacctaaagacatttttgttgtctggctagacatcttacttcccatagtcttttaaaaaataaaattaaaaggcaataaataacttctgacaaaagaaaatagaagccatgttcttatcacccagtaatgaatatattgatatggttctttcaagtaacttttaaccttttacaatatacgtatcaaatgcatgtatcataggtgatatgttcaataatttttgcaaattgtgcatttttgtttaaaaaacacccagatcaagaaatagaacctcactagtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttaaaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacactttctttcacgtttgtaaactagttatagatttggtacatgtagtcagtcactgtgctaaattctccttaagaattacgtctcttttttgaaaaactaacttttaaaatagacattactattattattattattctcattttgaagatggggtaactgagaaacagagatactaactaatgtagctaatgaagtgaagctaattagtgtcacatttggagtttactcaaaatatgatactcttcagtttgatatgctactgcccttcatgttatcctttttaaaaaatatttttaaattgattgtatattattgcattagcatatttagccaatttatatgagcttcatatatagcatatgtgtgtgttaccttcctggtaacacaccaaatggctcatataaatttagccaatttatatgagctttatatatatatatatatatatatatatatatatatatatatatatgcgtgtgtgtgtgtgtgtgtgtgtgtgtgtgtgtgtgtgtgtgtacttttttgggtgtttatttttaattttgttccaatttagaagcatataaaagtttgtttcaatgtgttttttaaattattcaagttgtaatcaaactgaaactaattttggtcaaaggtgaggctctacattgatttttaaataatttacccgtttttccaatttcatttaataaataatcttttctagccgagcacggtgggtcacacctgtaattccagcactttgggaggccgaggctggcagatcacctgaggtcaggaatttgtgaccaacctggccaacatggtgaaacactgtctctactaaaaatacaaaattagccaggcatggtggggggcacttgtaatcccagcttcttgggaggctgaggcaggagaattgcttgaaccaggaggcagaggctgcaatgagctgagattgtgccattgcactcctgcctgggaggcagagcaagactgtctccaaaaacaacaacaacaaaaataatctttcctttactgattcatttgtggtgtctcttttactgcatatgtatgaacgtgtggggtgtatgtgtatgtgtgttttagacataggatctcactctgttgcccatgtaggagtgagtggcacaatcatggctcactctgaccttgaactcttgggtgcaagtgatcttcctgtctcaacctccagagtaactaggactataggtgtgtgtcatcatgcctgactaatttaaaaaaaaaaaaagtttagaaatggggtcctgcaatgttgcccaggctggtcttcaactcctggcctcaggttgatcctcaagtgattaacctaggcctcccatagtgctacaatatatttggcaattatatctgcgtgcacggtttcttcattaatgtcgtcttattcctgtgtaaataacttccactcccatttcattttagattttcttacccatctttgcaatatcttcaaaaagaaagaagacttacaggagtccaatgctgcataatattaataaacttaattttcttaaattttcttctctggcagagaccataagcagtatgatatttagtcatgctaggataagacctgagtagaaattgtactagctatccagctcgtttgttaatttacttttgatgagacagagaacggtcatttaaccagcttttgttcggtgtctgttcggtactaggatctcctgagaaacccttgcatcctttatgtacttggtcctcataacattcacactaagcattcatggcagagccagcactggcacctgtggcttctatgttgctttttaccttgcattataccaattcatactaagaaaattgaagtgtgccctaatcacagtctttcatttgtaagtcgactcaatacagtattggatttggagttttgaaagaaagtaaaacctaatttccttccccaaagctattattattctatttagataaatggaaaagcaggtatgtgttgaggtttctagcttttaatctacagtgtttaataggttttaagttatttgttattgaaatcttgaagaaaacacataagttagatttcttgcttttatagcaaaaaattttttggatggcttagggagtcaagtgaaccattttaaatacagtatgactaaatctgaaaggcctgatatggtagctgctagccccatgtgaccatttgaagttgaatttaaatctacattaattaaacttaaataaaacatttgtaaaaattagtctctcagccactagtcacattttgagtgctcagtagccatcccttgcaagtattaggacagtatggaacattcccaccactgcagaaagttctgtggtgcagtgtccatctagatgattctacaaatggaagatttaggggaagaggagaagtaagtagtgaggtgtacctaattgcttctataagttttagtacaaagaacccttcctttaaaatattgatatttggtgaaacattcagatatcacgttttaaagtgatttcatggacactaatcaacagagcaacaacatagatatatcattgactacaaggatggatcaatacttgttctacctgtttcataacttagaggattatagggcactctataacacagcaccttaagtatcagaaaaataaaggctgcaggtgtttgaatgaattgttggatgttctgtttttataaacatgtggtcttctcatatttacaccccatttggtttgggatgaatctccattctgagtcccttaaatgttagggaagcttaagatgagaccctttggattccacacaccaatctaatttcggacccaatttgaagctgaaaaaggcttactatggaaaaaaaaaaaaaaaaaagcccaagccccaaaacatacacacacaaaacaaagtagaacaaaaggggataccatgatctttttatcaaattaggataataggatgacatggaattcagaagacagtgtgatattctctgggaatttgttattttatgaatgttcctgactgaaatttaaataaaaataaaatccagagtatacttccccctttagtaacagatagaagtgacaccttgttgaattccatttctggattactctgtttttattttcatctattggcacccaggacctggtgtttggtttgtaactatgattagtgggttggggttaatatgagaaattccgcaatgagtaagtcggaactattcggtgttatgtccaagaaagctcacatgtcctagttaaggctgtgtgaagtgaattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatataactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgagagggctactaagcagtttccttggattaataaagcttgtatcttctttataatattcatgtcaagtggccttcctgcctctacttgaatacttccagttatttgtcaatctcacatcctcaaaccaggtaatttctatttaatttttgcccttaatcttcagggtttataaatacctattgataataccttcgttaatatggtgctttgaaactcttcatttttttccctaaataaacttgtaatttttctttctatatcatgacagtagaggctcatatttttatgccttttagtctcagttatatttttgtctgaagagctaaatatacttgaaaaaagtggtttctgtcatctcagaacatatatatatatatatatatatatatatatatatgctgggtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaacttgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtaccatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaaaaaccaagcttgtggtactttgttgtagtaacaacagaaaacgaatacacacaatatcatgttaaaatgatctgtttatatgtttttctcctttctaggcaatgaattcctcaagggtaacaatgctatctttgaaaaatcattttagtccatttccatatgaaaagaatacgaaatgtcctgtcaaacaccagaggtggtatttactcagtgtgtatgcaccatatgcctggcactgccctgggtattttgctttgaaaattttatttcctgtctgtttaaccctactaaatcttaactttcttatctgtaatgtgagtctatggactagatcaggtttggcaaacttttctgtaaatctggtaactaaatattttaggttttataggccatatggtatttgtcacaactattcatttctgccactggaatgcaaaagcagccatagacaataagtaaatgaatgaccttggctatgttccaaaagaactttatctacaaaaacaggaggtggtctggatttggccatttggctgttgcttgttgacctgtagactagcggacctctttattctgttctaattcctgtctaatatgattattctgtcagtttataacattgtgccgtgtcagttaagccaaggaagtgccagtaagacctgaagaaggaactcaagtgattggatgggtctgtttataagaagaagcataatattggagactcaagtgccaggaaggggactgtcaccatgtccttggcaaatggacctgggacaaattctctttaggatgagacataaggagatccttgaatgccaaagctgagctcgctgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaaggattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggtggcggttgttttgacttggttacatcatcgcatttttgaggacaaaactaccctctttgattggtatgttacaatagcttgtttatgtcttgcaaattgttcgagaacagtttgtccattaaagaaaaaagtgacctagtaatactcccctacccaggggaatgtcgggttaatcagttgcacaagggcttgatatgccaagtcagtactaccccgaggctccgtatgcagttcctttccaagatttttaaacattctggggagaacacaatatttgtttatttggcttctaggactttgttttgttatcgttttagttacggtcttatgcttttctctcactccctgtctttcttttacccctaactctttggagccctggtgtgctaagagccatgttaacagtaaagcatctattcaataaacacttaactatattttatatttgagcttctaaatgtttgtgaagaatgtgtttctgggcaagtcacataaagaataatctcacagtaaaaataacttatatttatgtaggacattatagtttttatggtatttctaaattcagtaaaaggcgaaagatttataccatctgaagaaaaaccagggtgttgtatttttaaatttaaatactttggtctacacaaccctgggtagtataaaaggtaagtgctgttgctctcatttacaaacaaaaatattgagaatcaaaagtttcatgatttccctaggttcacacacatctagtaaatggttccaagtggacaaaaacttacacattttaatgtcgcagagctatttttttatatatgtaagttacctaactgcagcagtgattgccgagatcatccctatggtgatgttcaattgagtctccctatttcaatctttcaacctctcttttcttctctctctctctcatacacacacacacacacacacacacacacacacacacacgcacacataaaccacatacacacacattttgaaattggtagtcactcagtttctcaatcttcctttaaagactaatttattgggctagaatttatgggtgtagttgtcaaaaattcctgcatatacccactcaggaaatattttcccaaatcttctccatctcaactctgtgaggcattggaagaggtgcttttaggatagactgatgactcatatatgatgtctgccctcagggagcacacagtttagtgaggtaaatgtctcatgaatattccacaagatccaccttgataatgctctaaagttactatagagggctgaaggtgggaagatgctttcgtctggtggcaaaggatagtagtgtagggtgacatgggcctccaagaatagcttgggctcagatagtggagaggaaactcttaacggagacagaggtgtgagcaaagtcttggtgtccaggaagccagaggaagcattctggcagattaccgggtatgtggcttagcaaaagtcattattctgaaatataaaatgtccagtgctgctgtctgcagtattagtctcaaaggatacatactcaccagtacattccagagtttgttgacaaactttgacaacaaagcttatcaagtttctctccattgcctcataagaggcccatccagttagaggattcctccttttcagaatgagatcttgtcaaatcttgggaggctcagaacagacgtttaccaagcttccaataatactctcaaaccataattctctaaaacttcagcataattgccataaaatcaattgaccatatattagagagtttatttctgggctctgtattctattccatttgtctctatgtctgtccttatgctaggaccacactgttttgatcactgtagctttgtgataagctgtgaaatcaggaagtgagtgtcctccaacttggtccttttttcaagattgctttggctattcaaagagagccatgatatttttaatctagcaacagttgtatcaaatacattggaaaaacctgggtcaggaagaatgttgactatctgggctatttgtttagtctagatatgaggtaactatgcattaggtattttggtggcaaaggagatgcagagcagtaaatgaattagaaaaatttggtgtaatttaatatagcttgtttgtattcagagtgggtggttaagataaaaaggaaaagggttttccacctttgtgatagggagaattgtgataaggtaaatagaaaaatagagcacacaagaggaggttagcaggtctgtgggttatcctatctaaattcagatttgagcactgagctagaggttcatttgatgatgctcattcagcaatcagaaattcagaggtgaaatcaatgagtaccacaattattctgggtcttattttacttataaatggtgtatttatttagaattgcttttttaatgtaatgcatttatggttaccatggcacaagagccagatactgggaagcagttggggacagcagcaaaaatcaagatctggataaaggcagcttcatgaggcttctgtgccttacctcagctaagagtaaacagagtgctagatggctgttgacatgtgttttattttgaagtgactattattactaggatctgaaatccttagccttgatctcttggagcctaatgttcctgttctccagctgagagagactaattcaccatcttgtgttgtgaacactcactcattttaactgattacacctccaatgattctcaaatcactaaaattactaattgctattccttacacatcaaagagtgaatcctgaataattaaccccaaataaaattagatgaattggcccttttaattagagtccctgctgctgtttgttctgagcttccttttcttactgttaagagacttttagaatgattaaaactgtttaagacttaaacagccagtgaccttttaatacaatataaatccatgaaagcaatatttcagctagcaggtggtgaagtaaatttttagagcaagtacctgtcagctccagtattcctttggaaaaaaaaaatacatgccaaaaaacaaccaccttgaaatgaaatgagtgtctctatttgattatttttaaagcattcatgcatttgctaagcttcagacttgatgaaataaatgtcagggttgaaggagagtgagtaatggttggcatcattttatataaatagtaacaagaatttctcagtgagaagaatttgaagtcatttgtgcataaaagatgaatactggataaatcacagaaggcccctggcctcatgtagccatccttgtcttcggggattctcttgaagcaagagaatgagccccaacattggggaaaaggaagttttatggggtttaattgctgctgatcatcgaggcaggattaccagcctagccatgctgcattcagcctggattttgttggagatattttacatgttcctgctcgtctattccaagtctcctaaatagtaagaacctcttctcttcttcatagtcttctgaatttgtaggggtgtagcgggttttctcaccattcccaagaagtctcagtttctcacactaagtctgccatgtgctgtggtcagtgtgtccttagctagaagttaagatatttggggtcacagtgggctgcctggtgtggttctacactctttgactgtttctctattttttttccatggtggaaaatgtattcatctataaaaaaagttattggactagttcaatgacttactttttccttaaaatttaaaacataaattttaactttttattctgaaataatttgagaccctagagaacggttgaaaatagtataaaggattctcatttagtcatcacccagttttcccaagtattgacatcttacataaccacggtagagttaccaaagccaggtaaacactgacataatacttccttctaatacataaaccttatttagatttcattgattgtcctagtgatgtctcttttctggtctagaattatatccagaatcacatattgcattttattgccttgtcaccttagtcatctttaatttcagagagagagttgttcaatctttgtttttccagaaggtcaatgattcttaaccagcgctatacgccagaatcattgaaggagctttgcaaggtccttgtctgggtcccgaccccaaagattctgaattaaggattctaaagtcaagtctgggtgtatgtagtgtgagcaagtgccccaggagattccgatacacaccactggttaaaagtcagatgagtttcaatacctcaagctaagtattttcaaattctgtctatgacatgtatccttccccttccctcatttctctgctctttcttcatctccatctctcttttatgggattaaaaagcaaatttaaatgtctctttatactcttaagggatatacatatactgggtaaggcttatcaacagatcttttattggagaagatcaatacagtacagatggttgcaatatttctgaaggctagggtgcccccataaccaggtggtgacttgaggatgaagactctgttcctatactttgaagacataccctcagtaagataatgtgaaaacaaacaaacaaaaaacctagctagatggctacattaagacaggttattaactgtctagctgttggtatcatgaaggacctatgacccaccgtagtacattgttgaccttatgtcaatatttgaaaagtggcaaagttgaccatgggaaaagttcatgtgttcattgtctcaagagttctattcaatttaatatatgtagttttgtaccaataataatttatagcaataatatcattactgtttactgagtatctcatatgtgttctatatgctttatgtagagattataaaacagagagtctgccctcaaggagctgttaatcaggtaggggaaaccaatagttatccaattaagctaacaaagagcagaatattggctgtaatagagcttcagcaggaaggaagcctgcattatcattgacatgtcattgacaatgcattgacatgcattgacatgcattgacatgagaatggttccctctatagccaaagacagcagtggtgaaataaattaaatgccctatttaaagtgtttttattatgaaaccacactccctcaggcaccatcattgtctttggaggggttgtaagcttctggccttaatgaccaccacagggtaatgtcccaatcctaaggggaaaggatgtttttggactattctgtcagcactctgatatttgtttgcaagcttctttgtttttactggtaaattaagactttttgttgttgttttcctgggatgttgcctcattttctgtccatcacatgaatttttagatttttgtttcatttttaaaccgaggtaattttactttttcgcattggagctaaagatatctcactagctgatagaagactgatgcattaagctcaactcattgtcctatttattttgaatgctcatctttggaagtcaaaaatatatggtgtggtttgttgtctggatagcaattactatgtttttgtaaaacaaatgatacttggtggattcaaaagtgctatttggttctagtcgatgtgcagagctagactattgtcttaatttcatacgatttgaaatccatttaatgttttctactgagaaattgaatttgttatccaaccactgcatgacagagaattatagtatgcttgtatctcatgtaatacactgaggtgtctcacatttgtacagggtacttatttgtgattataaaagaggacttttaaagtctcagatatattctgtattagctaaatatggagtgaaactgtccaatttaaaatcagggagacgtcatctactttaaagataattcttcttgctttttaatttgagaatctcaaagagcatttcaagctaagttatttagaaagatgacagggacattaaattttggcttgagtacatatactgatgcattaaaattaaacgctgggtttgagtagattctgcgattcattttaaagtatcttatttttggttttttaaaaaaatgcatgcctataattcacttattgtataataattaagccaaaaggataaaaaattgaaaacaatgcttagcatctcatgagctgtagacaacccctgttaacataccggcctatataaaattgggaccatattataagcactattcaataacctcccttgtttcttacctgataagatatgaaaagcaggccgggcgtggtggctcacgcctataatcccagcactttgggaggccgaggcgggcggatcacgaggtgaggagatggagaccatcctggctaaaacagtgaaaccccttctctgctaaaaatccaaaaaaattagccgggcgtggtggcgggcgcctgtagtcccagctactcgggaggctgaggcaggagaatggcctgaacccgggaggcggagcttgcagtgagccgagattgcgccactgcagtccagcctgggcgacagagcaaaactctgtctcaaaaacaaacaaacaaacaaaaaagatatgaaaaacaattttttatgttcttcccccggatatgccaatacttactcccttactagatttaagtctttccccaaatatcaccttggtgaggccattttcatttttttttctttaaaattgcaactcccaccaccaccctaacagtcccaacccccttacttgccctacatttcatcatagcccttctcaccatgtgatattccgtttgatttactttttaagcattattcttctttggagtataagttccatggggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagagagttctcaaaggagtttcacgctgtagaaacgggagcaaaatgagaatccaggtgccgctttattaatagcttcataagtgcttgctctccctctgggacagaggtctgtgatcccactgacatagtgcagaggctttggctctaggaataagtagaatttgtatccggtatcttcctcacaccactgtatcttggaagtcaacatactcagtgagctgcagctcctgaagacctggcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccagtgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgttatcaatagtttgggactccatttaaaagatagtccgtgataatacatacatatatgtgtatacattattaaataaatgataacgttatacatgctgtcctaggccttgaatgctgcatttaaaaatatttcacccaaggtgctttctggtacagttttcttggtggcacacatattttgatgcagattgaggatggagttgaagttgaaattggaagtgaagtcttcctttatttagtttcataataaattgcctgtagtctgtggagtgtacattatagctgtggcataattcattgccttatggagatcatcattgctgttacctttgttttatcctctcactttttctctttaagggaccttgttcagggagcttggtctcctcctctgagtgatcaagtttagattcagttgccctcttgtgcataaggaaaaagaaagcattgtcatgtataatgtagacattgtactaatcacttgcacgtaatttagctcagttatgttcaaaatgtaaattgagacctatttctgggccacagtcaatttagtgggtcagaaccaattttttttcaaataacagagcatttcaatgtgtgttttatttatatagtaggtatggtttcatgaaaccctttttttctagtatacatgtacgtgtacatatctagatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaacattgacatctgagatgtacgagtcaaagacaccaggtcatttattaaaacatcagttaaggaattgaatgggtttttatttttcagtcatgcgacctacagttactgaggatgttctggcccaaacctgtgactagagatgggcatataaagataaatcatgagtggactctacttgtaagaagctgcagttctaaccaggagggagtgatcataacacacaaatacaatcaagtattacagatgctctgatagaactgtatatgagacgcaaaaagggctgctatctaaatccttggatgtgtgtgtaggttttatatggatatttagatgaagaagagcatgatgctttctttgttttctttttgtaccacagtaaatgaatccaaactttgttgatagtcagagttgaattgttcccatgtgtttttctaccacaattacccataactagtaatttacttactttgcaggtaaattcttgttatcttcaccctctgatgggggcctttgtttcataaagggctaagcaagctctgcgttaggtagatgcctttcgtatctgactgacgcaagtgttagggtaaccacagtggggaatagctcagctggtcccagctaaccatccctgcttctcaaggccgcatcctttttacccctagattaaaagggagagcttgagaaaatatgcatagctaggtcctccggagtctttcctcactccctttttgagttaacaatatgcctaacaggctgttttctgaagtaaattggcagtaagtagtgtttgggaatcagagatggaatacttgatttgtccaactcctcatttaactgtttcttgctgctacctcttgcacccagcaaaaaccttttgaatattagctgaatgatttgggttcacatggagcaaatcaagcaagatatgtctcagcatctctccaagagtgagaatccatttcctgctctgtatttcaccagctatgtaactttgaataaaccattttacatgaaaattgaggcataaatatattttgtatgtaggtaggatttggaggatgagtggaggagtatggagggaccaggtctgaaggcacgtgtctatgaccactctactgcttctaaaactggacatttccattttagatttgatacatcgctgccaattgccggatggcattttgttttgttttgtttaaaagcttgcctgtacgtctcagagtctgagaggtgagttgcaatttccctgtaggtcagagaatctgggaggtgagttgcaatttccctgtaggtcacagaatctgggaggcaaggcagagaggacagggcatgcactaatatgaaggtctacagcttagctgtgctggctggaaggtactgcatttcatttcatccaggggctttcctccagaaggatcaccacctaggaatgaaagccgcatgctctttcattctttcattgttttcagaaatctattagaatggagaagacctccttcccccttcttctaatcatatataaatacagttcttttcattttcccatttttcttaaacatgataattctgccttgtctctaaagctgaacttattttcactgcaacttagaggcattttcctttatttacttgtctatgaaaatgatgagctctgagttagaattctcttaaacttttagtctgatttaggatagttattagcagtttttcattgaaactctcccggttagtttatgcctctctccaagggaaccatttcctctccttttatcagatttgtatctgtttttgagacatttgcccgttcctctacatcttttgaaaacgtgagcacctctctaaggaatgcagtaaggaccctttgatggttaagcttaaagaactgaaaactttggtctgacttaataattgatctaaataaagcagataattatgtgtttatcacgagggcttttaaacatctgccttttcatgcttagaatatagaatccatcttttcaagttgtttcttaaaaaaaccaaaaacattccacttttcttttttgttcgttttgaccctcccaggattgtcagcagcctgtgcctcactgtgtctgagttctattagagaaacagagtaaagaaggatatatttggaagggacagacagttgtactttttaagacttacttgttgtgacattttggacttttcatgtagcttctttatgacatagtttattgaacctttccaattttgtgggtctaaagtaggaataacatgttgtggttctcaaagtgcgatctcagacccagtcacatcaatcacccagggcctctgtttgataatatgatctccaagattttgttcagttctgatactgtctgatgctctgaaaatttcccatgatgtaacagaatctgatgaagtataagaggggacccaggaatccttttataaaatgggtatgaagaagacatagtaatatggtttagctctgtgtccccacccaaatttcgtcttgaattgtaatccccatgtgtcaagggagggatctggtgggaggggattggatcatgggggtggttcctccatgctgttctcatgatagtgagtgtgttctcacaagatctgatggtttaaacttatatggcagttcccccttcatgctctctctttcctgccactatgtgagatgtgcttgcttccccttcaccttctgccgtgattgtaactttcctgaggccctctagctatgcttcctgtcaaggctgcagaactgtgagtcaattaaacctcttcttctttataaattgcccattctcaggcagttatttatagcagtgagagaacagactcatacaacatagattcagatagaacatttgaacttggaaattaggttgtgaacagcaacctaaaccttttttgcctcattgcctaagctctcattgtgagcactgttttcatacatatgacctttaaaggcagtaaaaaacttcttgacagttctttttaattaacagatatgaaatattttttcatgcagtctgtggccaaatgaaagtttctcaatcctggctgcaggttcgaatcccttaggttttataggtgtcctggtgcctgaccccctcactccctgtcttctatccccaagattctgattgaattgctgtgagatggaatttggacatcagcattttcgaatgtgtttctttggtgattctggtatttaaccaatgtttaaaactactgaatggaatgcatacagatttatgggatttataattgtcataaggatatgtacaaattatttccacagatttgtgcacccagagaataagaggagtagaaattttctttatgttgtaagttattgaacatttcttatcctgtgggtctaaagtagtaacaacatacagtggttattaaagtgtgctgtcagacccaaaggcatcgatcacacagggatttattagaaatgaagatggttggagttctccccagacctactgaatcagaatctctggatccaggacccaaaaatctgtattttaaaaagacattccagagatattgatgaactctaaagtttgagaaccatcagctttaagggttgttgtatgattcggtggcagtgtatgaaaatcttagcacactgcctggcatggtgtgagtctagtaagcggagtactcgagagatagtgcttttgattgcttagcagtctgaatttggcttggggctagacctgacagttcttggcttagctacactttgaattctaagactgttatttataaggcaaatagaggcaaactgaaccatttcaaaggtgtatcagaacaacaaaacctactcacagtcattctaatgtgctcactcttccattcttatacttctatttctcagggcctaaactgtgatgttttgataatatccaaaagcaactcacttaatgatggagactgctgccctaacccacaaagtgttgagcaactaaaatgcaaggaaaagctactcctccataaatagaaaagatctcttctccaacacatcaaaaacattatttttaataggaaaataacaaataaagaacaggttaaaaggtagaagtttctgtttccccaatacaattttttgcagactatttaaaaaggtttcattccaggaaccataaagctcttggatatatgtgtataacttagatcacagagatcaggttcactccctcaataactctgacagcagtgtgcttctcttgttggtaagagatgctaggtttttctcggtatcccaaagtctcattacttcttgcctggattatgtatagatttctaaattgggtgtttcttattcatttctcctaatctgtcctgcatggacttttacattagtctttagtaaatcgtattgtaaccaagtgtttctttctcagaaatccttggtggatctctgctgcatgcatgataaaattcaaaccctttttttgatgtgcaacatgtaaaaaccttaattttatcgcatatctaatctttataactcactggcattattttacattcctgtgtcccatgtttttcctatgtcatgacttgctttttattctctatgctctgaactttctgatcgccatgcctacattctcctgtctctctaccaaggatggacgtaccttctacatcatgtttcaggaaaattatatgatccactgagacttccatgatcctccactttatcttaatttccagaggttattcatgcatctttataaattacaccttgtgttatctttagttttgtacaatttttcttcctcctctatttgattgaaaatgtattgagggcaagcaccaaggtgtataaaattcagtaactctatctcccacccaagctcattcttcgctttgcttaatatattgacccctctagactagcttttataccatttctaaatatcaaatccgatactctttcttctgaaagttaagactactaattaaggctactaattaaactaagatggggaataattgctatacaacacaaaattatgtgtcaaagccaattataaaaaagtaaaatgccagcaaatatatcacgagtactataacgttgcatccttattaacttcatgttgtttacttcttttctgtaggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttattagccatcctagggagctcatgaatttcatgattgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagccattttttttttaggaatactatttgagaaggcaacatttccttgttattttggaggacatacagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaactgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaaaaaggaatggtgtctggtaattattttcaaaataataagggttggaaactactgagtgagaacatgggtgaaatagggttggttatgatttgataactgttgggtgcatggaagtttattctgttattccgtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaatttgaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagaggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacagatagaacctttggcaaataaaaccaatatgagtgatttttcttaattttagtcattttttaataaaatgaggaaatccttagctttggctttaatatacctttggtcttactttgctgaagttggttttttgcatattgtttaatatgtacaatttttaaagtcactgactctgtttcctctcttagattgtcatagaaactattttgttgcattttaaatctttagttctcacaatgttatttgaagtagtgacagaagactcgtgattgaaaactagttacatagattattctagttgtgtgatcttgcgcaatgcatgctgagtcccggtttcctcttcattagaaacaaaacaaatatatatacctcttacaattaaatgaaatacagatggatttgaaagtattaaactgaaagggctatacaaatattttgatgttatattaataatcactattaatatgtaagaagactagtaaggattttccagtgggttccattaaaaaattcaaccatggggctttcaaaagataatgaagaatttttttcaggtggaccttgttctgttagatgtactcaagccatggctttgtttttgaagaggaaggaaataaacaaaatgcctgttgtcatgttggcttaagttctctgtaaaacagaagggaggaggataaaaaataaaatacggtttgccaaatggaaaaggacaaatctggtagggagaggcctgttatttttgagacgcttcatatggaagattgttgatacattcaaaagaaaacgaacatgccctccccttgtgcagaagtgacttagatgtgatagcggcttggtcctgctctggcccaggtttgtaccagctatagaaatgagccatggtagagcctaaagtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgtgtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaactgtgactggagagaggcaagaaggattcatagaaacaatttaaattgaactgaactttgatggctgggtgggaccttaattttcagataggtgagtggatttttcagcaataaaataaaagaattaaaacacagaggaaggagagctcaaagtaagtgtggtaggccttgtgtttctaactgtggaacctactctttgttctgaaaccattgacaatttattgtaggggcttgttattattttaaatataagggtgatatccccagaactgttgttggatgccaagtgatactgttaacataaattaaggcaaaacatgttgcacttgcaggaaaccccatgcaaacaattctgagttgtctggtagacttccttcagatccatggggacttacctgctgacatctgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattggttttctttccccttttaaaaagtgatgcaaagtcagaggaatgaccaggccaggagagagataggtgctgtatgtctcaaggagttgatgagtaaagctactgaaagatgttacttttcaaaggagtgagtaagcacagagtaacatgagctatgcccagaattagtggaaaagtagagaaatgtctgaaattgtttattttaaagtcagcctccaaaagctcttgagcatctattcttgtgaaaacaattcaaagctcatatatgtgtatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctacttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccaggatggtctcgatctcctgacctcgtgatccgcctgcctcagcctcccaagtgctgggattacaggcgtgagccaccgcgcctggccggcactggaatttttgtcttgtgattccatgtaggactatcatggtctcaggtacagaacaacaggattttatttttagacataaggaactcaaacctacagtatggccacattcattcatgaactcacagaaataggcagctgaactggctttacgtgggttggaccaccttatcataaaagtctgtctttctgctgccggttagtgtgataaaggaggaggaggctgggtatgaaaagagatgtcggctgtggagattaagagtagaggtagtggacagtgttgccagggcaaaaacaacatggtcagcaagagctttaatgtattctaaaatgcttgttttcaaaagggtgagaatacaaggatatcttgatccatgaaaacataccaaagagatgattgagatgcttatttcttcctggccctttgcctagttccttttgggtcagcaaaccccagttgatttgtagcttgtttgtgaccctgacagcaacagtagcagcagcagcagcagaagcagcaatagcaggagcagcttgctttgcaattatctcctatttttatggtccacatatgtaggtcattgtgtgtttattaaggctgggtaggctcttagcatgtcactggctctggtcattgtgactttctagaagcgaatgtcacagttttcctggttgctttttgctcttaatcatcatctgattggttattcagataagaagatggacatttttgttgtctggacttgtaaaaacccttttgacagtagccgacctagagtccaggggagtattccaatatttcatttagcattaggaaacttttaatggaatatcatagtttctcttctttactttttaagaacttaaagaggtaaaactttcccctgggattgatagtggagtatgtgtacatatacacatacccacctactcacctatatcaacctgattaccactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtcttagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggcaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttgaacccagtagacagaggctgcagtgagccgagattgcaccattgccctccagcctgggtgacaaaagcgaaactccgtctcaaagaaacaaacaaacaaaaacagtaacgtaaaaaaatcaaacgatgtagattagatattttcaaatttatttctctatgagggaaaaattatgatctgcttatatgtcctgctcccaataaacacgccaaatgatgcttgaacattcttttcttccctgctccatcccacattctattaaaataatttggagaatatgttgtaacatttttaactttatagcaaatctcttttgagaattgtttcttgcattaaattttataaccacatcagtaataaactgtaacttttacctgtttgctgtgctattttctatttactatctttttcttgtattcatcatcttgattcttctcttttttgttctttttttctgccatagtacttcattaagtaattttatgggaaggctacatgcttgatgtatttcctgagtctttgtatatctaaaatgagttgttattgccttcatatttgagtaaaagcttggctataagtagaattctcgggtcaaatttgctttacttcagtattgtaccaagatttgcacactatcatttagtatcatttagtattcagtgcagcagatgagaaatctgatgccagtctgattccttttccagtttagtaaatttttcttgtttggtctataggctttatttgtgggattcagcaattttactaaactgtgtctagacacagctcgctttttacctattctgctatttctactcaagtcaaggttttctttatgtaaatgggattttcttctttcttttcttcttttcttttcctttctttcttttctttctttcttgaactcctgagctcaggtgatcctcctgcctcaacctcctaagtagctgggactaaaggtgtgtaccaccatgcccagctaatttatttatttattattattttatttttgtagagacagggtcttgctattttggccaggctgatcttgaactcctggcctcaagcagttctcctgtcctgatgcctctcaaagtgctgggtttacaggtgtgagccactgctcccagtcaagattttcttataatatgttgaaaatatattttaatctttcattcacctttttcttctttatgaactcctactatatggaattggatttcttctctattcttcatattagttttctttttccaatagttctactacatggagggatttctgttgcttacttcccttttatattcttaatttttgtggtgatagtctgcttttgacttataaatgctctataaaactgaatttggggagagtatttggtaggagtggctctggatatctgttgttcagggtagctagcttgcacttaaacctttatcttttatctgaaatgggaatatatagttatttaaatgcagggtggccatagggtatatacgttcagtcttcaaccatatatgtaattaggggatgcaggccagcagaagaattgcccttagatgcacaggtcaagagcagaccagcaaggttaatctgggtcctcaaggctaatggtttggggattcataggcaggtagcaaagcccctcccttacatgccatacatgtatgccaggtgagggctgcaggagctgtggccagcgcttatgtatattggtctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccattctaaagagccttgccccacccctcaccctttttgttatgacagttcctggtgtcctgctcaggtcctggtgtcttttgctatgtatctcaaactcactttgctgcctgtgaggagttcatcacagaaaacgtgctctctgatagcattatctaagccaaagaaagcttcagagacagcataatgcgatggttaacactgcaagtgctcttccaggcttcctgggtacacatctggcttcctgcttactggctgcatgactgtaacgtgctgctcaacctttctgtggcccacttaaatcctctgtaaaatgggtgattgattgttgtgaggtttcaaagacataatgcacataaagaatattttatgtaattgacatgtcctaaaacttagtaaatattttcactgttgtgatattttgggctagcaggtctctgtgctgggttttgccatagttgtcactgacatttgatttgcaccatgcctcctcagagttaacccgtgatcccatcccttgctattataaggttcaggattttatatatatatatatatattttatttatattttattatatatttttatatatttatatttatattttattatatatttatattatatttatatttatttatatatatttataaatatataatatatatatttataaatatatatatatttttttttgcagaagaaatactcccacaaacttcctctataaaatgaatgattgaattaaataatcatgtagctctcttacagctctaaaattcagtgccttggtaataaaatatcacttctttgtaatttcatggtgatttataatttgcaaaatacattataacagcacaagtataatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcagactccacctccagggttcaagccattctcccgcctcagcctcctgagtagctgggattacaggcacgtgccatcacacctggctaatttttgtattttttttagtagagacaaggtttcaccatgttggccaggctggtctcgaacacctgacctcgtgatctgcccacctcagcctcccaaagtgctgggattacaggcgtgagccactgcacccagcaaacattgctttttttaataaaagactttcatatactttatctcacttgaacctttagacaacttctgcaaagggaaaggtagggaggattctccatcttgtatcagtgaaggctctggggctctgaggttaagcagcattccaggtttccatggcattaactgtcccaggcagggatgaagctctctgagacgtgccagtccatttctctctccattgccatcgctgctgtattgttactctccctttatattcatttttagtgaaggaaacaaaacagcagttgtcactttcctttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcattttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacatgtcctgccttctgggctttttgacattcatagcatttctaaacaagtgaaggatttatcttaaaaaataaaattttagtattttcttcattattcgtgagctttaattctttccattagaaattatgtcatccccatatttagagcaatgaataattgcataacttttaaattgtgtatttgatggtatggtgtatattgaaaagagaatgagaaactatcccctgaatagagatttagtgattcaagccatcactttctaaaatatacgcacttcagagtgaaagttcagtgtcagaacttcatagagtgtctggccagctagagttaggtatttcatggagagatgatcaaacaattgaacagaaaatacagcaaccagaagagtttttcactgtgcatgttcagaagacttcatcatttttattatcattttatatcaagccattttataagtagagatgtgtctagaggattgttttcatttccttttagctcattgaaagtcatacagtgtcactttagtaattctcttcttgcccagtggggatagaaaccagttttgggccacggcaactatatagaagtattttcatagagttacagattcattaaatgagaccctctctcctccccttaacacccactgtgtttctgctataatgaggatttaagcaacagtcccaacatgaactagctcatttcagtactagggaaatggctgttgcatgggtttaccacctctgattctgcaacaattgttctttttctgacagcgtcttctacctcctccaggcaggcacaactcttgatgacttgaacctcctatgttcttttttttcccccccagcttgtaaaattatggtaaaatacacataatataaaatttactatcttcaccgtttaatgttctgttcagtagcaatatgatgaagtacattcatattgttgcaactgtcaccagtatccatcttcagaactcatttcatcttgcaaaactgaacctctataccgcttcaccaataaccccccattccactctcagccagcccctgaaaccaccattctactctctgtctctaagattttaacttcacgagcacatggtaaaattgtaatcagattgtatttgtcttcgcaactggcttattttacttaacataatgtcctcaaagtttatccatgttgtagcatatgtcatgctatatatatgtcatgttctgcttatccgttcttgttaatagacatttgggttctttccccattttacctactgtgggaataatgctgctataagtatgggtgtagaaatcactcttttggaccctgctttcagttattttgagtatatacccagaagtgaattgctagataacatggtagttctatttttaatattttgaggaacattcataccattttccacagcagctgtactgtttccattcctcacaacagcacacgagttctgatttctccacgtccttgccgacactgttttttgtctcgataatagccatcctaatgggtgcagagtgatagctcattgtagttttgatttgcatttctctaatgattactgattttgagcatctattcatgtatgtattagccatttgtatatatatatcttctttggagaaatgtctattcaagttctttattcatttttgaatttgacttttttttctttttgagttttgtaaggtctctatatattctgaatattaatcccttatcaggtatgatttgataatactttctcccattttgaagattgcctttttactccattgatactgtcttttgatttttaatttttatgaaattcaatttgtctcttgtgttatttgtgccttttgtgtcatattaagacattcgttgccaaattcaatgtcatgatgcttttgcatatgttttattctaatctacaattttagatgttacctttaggtcatggatccatttcgagttaacttttataattatgctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatagtctttgtgtccaatctttagggttttctacatataagattatgtcatctacaagaagagatgatttaattctttctttttaattttgacacctttatttttttttcttccctgattactctgatgaggacttccagtattacactaaattgttatggcaaaagctggtattcctaatcttagaggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttggggtatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttgtgtttcttgaaaatttccctgtcatctgggttatcgaattttttgccacacacttgctcatagtactctcttaaatcttttttatttctgtagaattgttagtaatgcccctacttttatttttgtcttttgtagtttgagtcttctctctctgtctctctctcacttcatctagctaaaggtttgtcaattttgttgatcttttttaagaactgttggattttgttagtattctctattatttttctattctccattctacttatttctactcttatctttattatttcttcccttctggtagatttgggtatggttttttctttctttttttccaagtttcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggccaacatagtgaaaccccatctctactaaaaattacaaaatattggccgggcgtggtggctcacgcctgtaatcccagcactttgagaggccgaggcgggtggatcacgaggtcaggagatcgagaccatcctggctaacacggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagaggaagactccatctcaaaaaaaacaaaaaccaaaaaacaaaatattagccgggcgtggtggtgggcacctgtaatcccagctactcgggaggctgaggcaggagaatcgcttgaacccaggaagcagaggtttcagtgagctgaggtcgtgccattgcactccagcctgggcaacagtgtgagactccattaaaaaaaaaaacaaacaagtatattatttaattactgcaaatttgtgaattttgcagttttacttatgtctatttatttctatttttatcccattgtactcagagaagatactttgtatgacatctactttttcaaatctattgacccttatttagtttatgggcttattcatgttctatcctggaacatgtcccatgtgcacatgagaagaaggtgtattcaattgttgttcaagtcctctatttcctgacttacctattgtttggctgttctatccactgttaaaagttggacgttgaaatctctattattatacaactgtctatttcttccttcaattctggtaatttttggtttatatattttgatgatcttttattaggtgtgtatacatttacaattgttacatattcttgatgtattgagcctcttattaatataatgttcttcatctcttttttgtcttttagccttttttgacttaaaatctattttctctgatattttgctagtctgctttttgtgggttactatttgcatgaaatggtgttttctgtcctttcattttaaactgtttgtgtctttggatataaagtctcttgtagacaacatatatttgggttatgtgttttaatttattctgccaacccgtcttttgaccagagaatttaattcatttacatttaaagtaattattgataagtagagaattacttcttattttcctacagatgctccttaagttgtgatggggttatgtcccactaaaactgtcttaagttgaaataattgtaaatttaaaatgcatttaatatacctaacataccaaacatcatggtttagcctaacctactctaaacatactcagaacacttgcattagcagacagttggaaaaaaatcacctaatataaagcttattttataataaagctttaattatcttatgtattttattgtatgttctactgaaagtgaaagacagaatagatgcttcaagtatcgtgtttaatgaatgtgtatcacttttacaccatcatatggtaaaaaaattgtaagtcaaacccttataaaatttataagattataaaaccatttatatttattttctatatgctttatagtttctttgtcctttatttcctatataattttttttgtgtattcaattgattttttgtagtaaaatatttaaattcctacctgatttcttttgtgtatattctgtagctattttctttatggttacaatgggggttacatttaacatcctaacgttataacactctaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagcgtctgcctatttgccttttctgacatctgtatttctttgtatgatttttgagttactctgtagtatcatttcttctcaacctgcaggcttcctgttagcatttcttgcaggagaaatctaacagtaataaagaactctctcacctctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgtacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaattttttatttcagttattgtaattttcatttccacaattgcttttttttctttttctgtattgatattcccattttattcatgcattgttttcttaactttctccttgcttcctttagttctttcagcatgtttaagacagtagttttaaagtcttcgtcaggtagatcccccatcaggtcttttttagagacagtttctgttggtttatatttttgttttgaatagaccgtgctatcctgtttctttgtatgtcttttgattttttgttgttgttgaaaattgcatatttgaaactaataatgtagagccctggaaatcagaccttttctcttccccaaggtttactgttaccgtttgtattttgtggggttattgttgccagtctctgtgctaagtattagctttttttgttaacttgtggtcttaagtattttctgagcctgcatgtttccctggttatgtgccatgactttctcatttcctctgttgttttcaaatgccctggttatcaaggtctgtctcccaaaatgagaaaaagtaaaaaataaaggaagaaaaaaaaaaaaaggactggccttttgagtcccatggaagtcacttcagctggagtgagaggggcaacactaatgatagttgcccctttttctttatgtgtgtgattaaaagcagcaattaatgttcagtccacagatccttgatatatggaagacaggtcctttttgcccagcttggatcatgtaagctgtatgcaagctgcttcaagtacatgtgcacagatgcctgccaaggatctaagaggtggggtataggtagttgctattgtgctgagatgtaaactttacctaaattaaccacaacttaccatctaaagcttccctccagaaagtagactcctttaatagactctggacttccaaaataagttgttgatatagatggtggcagtgcaatggttgtctaggtggaaagacagatttgtggtgcctcctgctttgccatattctcagaatccctttcacttccttcgatttttactaagcagaactaacttccttaattcctctgccatgcctgcaactattccttttctcccttctttaccaccccctcctcctttctccctgtctctaaatttaggttcccactcagagttctcactttgaccttccgttttctctcagtagatgtcactactctaataagatcaactttgatctttctttatctaattatttgaactgcttgtgacttggtactgtgttttcctttgacaagttttgtttcatttatccatgagatcttttcatagataacacctgccttttcactttcaatgtatccctaattctactcatcatcttactcaaaggcttacattctgttagacataccattatattttctagtcttgccaactaaatcgtgttcattgatgatatatcttgctttctttgtatatctatcaccaaggcttacaggattatttcaatctctttattttcttgcccatcatcctagttcatatcttctgggttacaacctactcattgccttcattctatctttttcacattccaactgcatatctgtaaccacttagtggtttaaaaaatattattttcttcctctggcttttccacattaaatttctcctcttggtttatttttcagagtactctatgacctacctcatcctatgtagcacactgtatctcccactgtgctttttatacagtccttgctcttttgaagctcatatcgtcattgtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggagcctaaatttcttaagtgaactgttcatggtgacacagttactaggagagctggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcgatctcggctcactgcaagctccgcctcccgggttcacgccattctcctgcctcagcctcccgagtagctgggactacaggcgcccaccaccacacctggctaattttttgtatttttagtagagacggggtttcactgtgttagtcaggatggtcttgatctcctggcctcgtgatccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccgcagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaagaatcaaaagcaatttggaaagagggggcttatgggaaagagaagagtccaggatgcttggcaggattgtgactttcttcagggagaatacatatccttcctgtcctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttatagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactggcaaccaaattctaggccagcagatttcaaatttagcatggacaagaattggggtgaggccgatgggtttgttaaatgccaattattaggccctgccttcaaaggtttagatttggtaaatctaggagggggcttaggaaaatcttatgttcatggatatcgaaggtgcttctgtcctcaaaggttgctagcttcctttcaaaactccagtattttcttattttaggacgtatctttggccaccaaaatctagcttcacctgagaccaagggctttttatttaatagctgcaaattctcttataacacaccaagtataatcctgtaatcctcttttatacacaacataccaccagaaaacatgtgcagaagacttaccgtatgcttagcattctagtggacacatgatttctactaccttatttcacctggtctccaaaatatccctgtggggttggtattattgctcccttatttcataagaagacactaaaactaagagtatacgacttggtcaaacatcacatccagtttaatcctttctatcttaacctggttaggcatatattttactttaagtttgaacaacaggtgggattctttttggcactgacagagtttgcagttgacagtagagactgtaaactcggcttaagtggacccgtcccataaagaaaaacattcacattggaacaagggagaggtgaaaaggaaagttggaagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgttttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaatagtgaagcttgagacgacattattccttgcctcctttagactttcttcagcctccacctagcaaagtaaaagtcttgtcatagcagtctgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctcctttctttccctcccttcccttccttccttgccttcctgccttactcccttccctttcttcctccctcccttccttgcccctcttgcctgcacctcatatcaccgcgacctgactattcgccaaccaccttacacgaaagtccccgacacctatccttaccgccgaaccccctggcacaaagggcgtgccccctcggcttttccgctgaggtttaagccccgcccagttcccgcagcctcacagggcccctacccctctccatgacgataaaaggtacgaccccttcccctttccgccattcctttcccagcctcctcccccgctccccctttcgtaatacccgctccctttcgaagatcaatcccaccctgcccttctcccccccccccataatgacccgtttgattccggccgccccgcaatccctcctcgtcccgcgcccacacacactctatacctcagcaacccgctacgacccccccaccaaacacacgtcctccccgcgatcttcgcctccgccccccccgttggggccggcccggccgcgacggccccaccccaccccccccccgtcacatccccnnnnnnnnnnnnnnnnnnnnttggtaatctaataggcccatataatctctgcttggtgttagaagggaagacctttcaccttttgtgttttcttcctaatgtcatgcaaagtgctagagctttggagcaaaacgtttgatttccaaattccaattcttccgtttactgcccgagtaaccctagaaagttctctttttctctctgatccttgggctatcctcttttgaaaacaggaataataacatctactaatctctaggattgctggaatagctcgatgagatcgtatatatgaaaatgcttttctaaacctgagcacttctctgtgataatggccgtacagagggagctatgatattttccctcttgttttcccagtagtgactatgtcccaggctgtgtgcagtggactgggtagctgcctagtaatattgctggcttgtaggatatttcctgttttatatgttcttaagaagatcagttgaaatgtacgagatgtcgttttggaaaagatgtttcacagtgggaggtgttaaagttttagtcctacttcagccccttcactatacaaactaccttacctttttgggggaattgtattatctttaaatgaaaatgatggaatagcgacgtaaattccccttctagttctaatattttatgagccttatttccattttctatgcttatcaactataaatgattctcttgcagttgttcaaacatcttttatctgcacatcctcatcaatggtatttaacatatagaatcagaaccacaaatgtttgaagaaaattctcggccagacatggtggctcacacctgtaatcccagcactttgggaggcctaggcgggtggatcgcctgaggtcaggagttcgagaccggcctggctaacatgatgaaaccccatctaaaaatacaaaattagccaggcgtgttggcacgcacttgtaatcctagctactcgggaggcttaggcaggagaattgcttgaacctgggagacggaggtggttcaatgagccaaggttgcagtgagtgccattgcgctctagtctgggcaacaagagcaaaacccggtctataaataaataaataaataaataaataaataaataaataaagttcccaccctctgtacgtttccatggcatgacgctttgctttatatctctgagtacatgatatggaatatgggacatgggaattgaatacttttttatggtttccaattttggtaacatttaaggggtcaaacaagagttcaagaaaaaaaatacttgaaaatgatgagctaatgtataaagttaacatcacatttctaactatttgaattttggggaatgtgagaaagtggcttttgaaatgtatcatgcctgagcttattaagcctgtgttaccaaaatgaaaaataagaaacatgtcttccttgaggttttaaaaaacaaaatcaatagcaaaattacctgacaagttctgtttgattcataaatccacacaattgttgcacatctccagccccctcaccacatatgaaagttttcttaatgtaaaagtaaaccttttctcccctacctctaaaaacttctgtctaccaattttattatttcatgttattttgttatgcaaaggattcctggaaaaatatccatgatcctagatgatcttatggatatctttataggtatttcaatgtagaaatttcaaataaatgtatttcccttttatgcacaaacacagagttcagaaaagacagttcatttagagtttgctaaactgtgtgtgtggactaactggtaaggtgacgctctaggatggcacagcttgcctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttaattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctacctcccgggtgggttcaagtaatttttctgcctccagcctcccaagtagctgggattacggttacccaccaccacgcccagctaaattttgtatttttagtagagatggcgtttcgccatgttggccaggctggtcttgaactcctgacctcaggtgatcctcccgcctcagcctcccaaggttttgggattacatgcatgagccaccgtgcctggcggcagttttgttacatgtttttcagtccaaacgcataagagaaggagatttatttgcccatctaatctccttgtcactgtccaaaagttaggttcaccagcctatttatggacccttggttctgtgggcctcagtgttctgaaatggagtcgcatggttgaaaacatggctgttttggcaacaaagaatgggggcaggaccatttcctttaaaggagatttgggttggccaaacattgctaacactgggtgagtgtgttagggctgaaaaggatgaaataatgtaaattgtgaggaaaaaaaattcaagcatttatcaagcgtagcatttatgttctatgttgacgtttgatacggcttggatgttttttccctccaaatcatgtcagaatgtgatctccagtgtttgaagtggggcctaatgggagatactcgatcacagaggtgaatctcttatgggggtttagtgccatccccttggtaatgagtgagttcttcctctgggttcacacgagatctggttgtttagagagtgtggtacctctccccaagccttgttcctcctctcgccatatgacatggtagctccctgttgccttcattcatgattataagcttcctgacgctctcatcagaaactgactggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaatgcattcattttttccctaacttacaacagtttgtatctcattccataaaatgacatttctattagataaaatagatcatattttctgcaattctcactactgaatacggcctgtgtccactgaacattaccaggatccgtttggtgaggctgctcatattactatacagcatgagagattatattaaatagaaatgttactgtcttcatttttatttttatccaaatacctcttagctattatttggtgtgtcaattggtattttcatggcatcattaaccatatatatgacataatataggttgtttttaagggaaataaactataaattcactcagtacccacccttactccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctaggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaaggtcacaaagccagcaattgggagatacaggtattacagcctgactccaaagctttcaccagtattcttttttattagggatactttgaggaaattacttaatacaaatgattatagacaaataaatattgattgtttccccaatttcatcaaagacagatgatggaaaaaagattgatctaacttacaacaaaatgattacactttcaagagaaactagatagaaatagtttggatatctgtcccctccaaatctcatgttgaaatttaatccccaatatttagatgtggcctagtgggaggtatttaggtccctcatgaatggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacacggggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagatggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacaattgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataaatacaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattagtcaggagaatcttccttgttgctggcattgggaaggtcatttaccagtcaggtaactagcacagctacaaagatagggagttaggagaaagacatgttggtaagtctataggattctgttgcttggttataggactttggatcctggtatctactataagggattgagagtagcaagatcccctaaatcgaaaggtaaatgaatatctacagattcgtggcaggacttgggcaggacaacagttatttgaactgagatataaaattgagactcaagagtgaaaaaaaggcctattctaattcataatggaattgaaatgtaggagtaaagctactatagtatttgcacaatcttctcccctctcaccccacgctcccctgttatccagtttttgtgcaaaatcacacagcattagactggaacttgtgataaattgcatcaacctaatttgagaaactgaaaatagggagcagtctgaacttagagggtagggagaataaggaccctggaaactaattgatgtcttacaagcacagactggttgcatatcataattacttgttttattgtgtagttcagggtaattctgtgacttgttgagtctcagtggttagatattgcagtgacttcaggcatagtcagttgatgtactttctgcttcagtaaagtacagatgtagaagacctgattaaatcctgtctctttactaataccccaagggaacacttaatgaatgatgcttccctcaagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttaccaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctatgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggctgttttagataatgtgataatatgaaatatatatatatatatatatatatatatatatgtgtatgtgtgtgtgtatgtgtgtgtacgtgtgtgtatgtgtgtatatatatatgtttgagacatatatgtgtgtgtgtgtgtgtatatacatatatgtatgtatgtttgagacagagtctcgctctgtcatgtaggctggagtgcagtggtacgatcttggctcactgcaacctccgcctctagggctcaagctattctcctgcctcagcctcccaagtatctgggattacaggggcctgccaccacacccagctaatttttgtatttttagtggagacgggtttcaccatgttggccaggctggtcttgaactcctggcctcagataatccacccgccttggcctcgaaacctgctgagattacaggcatgagccaccgcgcccgtcctgaaatccatgtttaaagagggctcacaaacaaggaagccaactgcctcttgaagtaggtttggctccaaggacctgggccacaacttcatagacagttgatgttactgtgcttgagagagatcaggcccaggaaggattaactcaagctgactaagttcccaaaagaatgaccaaaacaccagatccctttatgtttcttttacacagatagttaaataagctccaagactcaggtaaggtggtttggtgagtaagctactagggcatacggaactagtggtcttcacaggccattaccctttacgcttgcttcaacatattcactaaaacgacagattgacttcaagggttataagatttagtgctagcctgtcatggcacgctacttgttgttgttactgaagatattctagtttcttggttggttaatgctttttctaaactcttttgcagacactagatactctcttgatattttacgtccttagacaagtccagtagaattgattagattattgtaactttccactattgtattgccattgagtcttgctgaagatacactttggtctcttaatgaagttttaagagcttcttccatattcatatatgatcattattaaattgtcactttaaaaggttatttttttacttcaccctgcctccaaatactagggtcatctcactttataatccagacagattctttgcttctttttcccaaacctgatcataattcctggaaacaccctgtgtcgatgttgttgtcctctactctcctgttgattctgactgcaggtaatacgaggttctgacataggaaatccggagatcctgacttcattgtccatgctcactgccacatgcttcccctgcagccccttggcagaaccctaagaggtctctttccagttcatgttctaggtgcatctcttgggtcttgccatctctcgcacacatgcatacctaataccccctggacctgagacttccaagcactggcatgctccaatgtcttcaagtgctgattcctctttctggaatgtccgtgttccttccctgctccttgctactccaataaatattattctaggcagtggtgtctaaacaccaagtgcttgtgagctctcttcagctggttctgttctttaggtgcaggaatggagacatttattttcctttacttgtatacttattttaaacaacaacaacgacaaaactgctaaataagtgtgtgacctgagaaaaatcatcttttatttttcagttttcatatctgtcataaagtgataattctatctcagcctacctcactgagattttatgaaagcttaattaaaaaaaaaagaggtgcagaaaaacttggacaaagccacattataacttgagaaatttgaacttataatgatatcaagggaaatttcctttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaatatgacttagcttggctatgtaaggttaaggtgaagggctgtgtcttttgcaaggaaattagttttgttggatattaaggtgattttcattatttttgtcatggttttaaataatgctacaggggacatatttgtgtatattttctttggggttatttcctggcctcagatttctaggagtggggttgctacattgatgaatgagaccactttatttacttttctttcctaaggttgtgaatagttgatactggtaccaccagttagtttgaatatatcagtttctcctcaagttcactagaatgtgatggttgcaattaatctgtgttttgtaagtgcaaatggtgccttgttagtttttctttgctttttaatttttttatttttgcctactttggagcttggctatttttcagcatcttcacttaatatctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctgtcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaagtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttgtagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccaggatcacgccactgcgctccagcctggggacagagggagactccatttcgaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcatactttctgaccattgcttgatgttcagcaattttttttgattccacccaagcaaatgccccaaatctcatctcatatctgaagacaggaaggccactgactttgccactggactcagcagtatcatgcccaaatgcttttttgtgctccctttccttttttttttttgtaatgggttttcactctgtcacccaggctggagtgcagtggtgggatctcggctcactgcaacctccgcctcctgggttcaagccattctcctgcctcagcctcccaaatttagggaggatagcaacagtgtttctggctgcagtaaatttggggtaatgactttagcttacatctactttataaaaaatcctccatgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggctgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcaccgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactacttaaaataggctagtaggtctgtgatttctcattagtcaaacatgtgttgtaagcttttttgaatccatgtctctatcatctttggaaggctgctttgactcatggtctaggaaaaatgatatatatgtggaatgtttatatggtaagaggttccaaggagctccattctcaaaacaagtctgaaaaatgtgagctcttgaaaataggttttgctaaagcattttcttccttttattctagggagtattttccgctcccaaattttctgactttagttatgttcacttactaatccctatattgattttggaaatttggcttaattccacatattcattgattcattgattcattcacctaacatttgatgagatcctcctctggatcagtcattggagatttaaaggttagtatcaacaggtctttcctttagagtgatatttaatcttacagaagagataagcccgtaagtaacccaaagggacacaggagaagggcttcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtacagagaggtttcagattgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttatgtgaacctgtccacgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttgggtgcagtgtaatcagggtggagtcttgtggtgccctggatcttcccttctcatgtgttctgtgttctagcttgcaaacgccatgaggagctgcaggggagattaattagtaattaaaatgtttaatgcttcatattattcaatgcaagtcaaacatgtaggctactgggagatgaaaactacaacatgctgatactgtgtgatgagacatagactgtccctacagactagaaactttgctgtttctggcaaggctgcttgggacttgagataggaactgggtaataaatactctgttgaaaaagaaaataggtgtggatagtggcatcttcctcctcctatattctcttaggaaaaatttaggagcttttcatgatttgctgagaaatagatttgtctatgtattggcattgtctgcttaataataactttctttgagagctatggtaaaagttgaaaccttgtagaaacctctggtatgtgatgttaagtggaatacagtaaaataaaatttgcaaaacaccattttaaaagagaaagggatcttattcttcacaatgcccatgttttacttagaggatctgtgttgttttgaattagcctgtacccgccagaaaacttcaacagttaaataacaatgatttgggggtggaggagtggttagctgactcagagttgcatgccatgacttttatgacaggcaattaatttttagatggtatataattgcatttcaataacatttatacctcatcatttttttagaagatgatgtgtttgtgtcatgcgtaataagcataatcaacgttagctttaaataaattttgttttgagtgccatgaaaatgtaacattttcagagtggaaatttagcctaaaaatctaccttgcattgcacctctacaaagcttttgcccaaaaatattcatttcatttgtcccagtgtaagagctggctctgaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccgagatgattatgttacattacactgaatcactcaatccaacattggtttgaaaagaaacgaacaaagctgcctgttgagtttctctattttacaacagtatctcagtggaaataattagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcattgttttgtccattttgacatctacttctttatatactttatagccaaactagagtatagtgataataaggatgatctctagacagaaggttggaggtggttaataactcatcctacatatcacaatttttcatggtgagtaactggtttgccctccacacaaaatatcacattggaatgtaactgctaaggttcttcacactatggaaaaattaccagtaaagttaaacactgcctttcagtgggtatattaattataaagacaaaactatagtttatgttgcataatttgaacatacatatttccttatgaatctgtaagctggaactattgaaatgaaatatacaaagtgagcacgtgttgctgttgagccagcagttacagttttcatttacaaatgcggacagaaccatttgctcattttggtctctctgctttgggtcctgcactcacactccaatatgcacctaagttatggggtcatgttgaggttccagactgcagaaggggatcgaattatgtttcattgtattgagtcacaaatatttcaatgtaaagtaaaaattttggaagttttacgtaacagaatataccttacaggaacaatagataggtataaaatgacttcggtttgcataacaaagaaataattgtgatgagtaccagactgtgaagtccctgaggcaaggttatcatttgttttctggcacatgagaggcatacaaatttatttttgctgaataaataaatattgtcttcaaatctttacatttccattctagaaatatgctaaaaaagctaatctgtaatagatatagagttagcacatgacaaagttatagctgctttgtgatttttttaaaataaagaacatgtatttgcattaagaaaaataagtgtggccgaagtgaatatttttttataagagcaacctaatggtaaccaatgtttcatccaaaattttcagctatactcttatattgccttatatcacttgatgacaatgtattttgttaagaagatgatgttatcatgaggtataattcaatattatatcaattctgttactgttgagataacataagaaagaaatatcaactctttttctatattctccacagaactgaggaaaacagaggactattatgttattatttcctaaataaagaccaatatgataaattccttatattcagtgagaggaaagaagttgcttaccgaatgtactgatatatgcttccttttttcagaaaacaacaacatcaaccaaaacacctgtataattattacatgaattttttttttttttttgatacggagtttcgctcttgttgcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatttcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaaagtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaacttatgttaacttgatgcttaccaaggcagtccaagccaggaaacaatttttataaacagcatcctggatgacttaatattctatgtaatattaattttagagctttttctcccatcatctagtctagcatagctaaaattatgatgtttaactttgttgatctacagtcacttgtgaatgagatctcccaaccaggaaggaaggaaagataggaaaatcagagtggtctgtttgcagctgtgctagcacatgtttccttgagtgccttctgaaggaagagtggatagagatgtatctttcagggccattgcctttctagcattattgatcgtatcacatgggcaaaagaaaaagaaacaatagattttatgacaaaagttatgtaaaaaggggctgaaatcagtattttgaaagttgtgactaattaacagtggctttctgagaagtgagatgggattcaagacagtggccattgtgtatgtatttctaagagccatctggatgctcctttttatttgtgtttttggcttattcactcatttattcctttattcactgattactaattgaatacaaagtctctgtcgatttgttcaaagatattaaagaagccctaaatctatggaaagacatcttctgttgattagttgcaagatgtaatattgttaagtgggatactccccaatttgatatatagatgcaaagcaatccctatcagaatctaagctggcttctttgtaagaattgacaaacatccttaaattcacggatgttcaagagacccagaattgccaaaatcatcttgaaaaagatgaggaagtttccgacacacacttcctagtttcaaaactttctttcaaatgacagcaatcaagcagtgtgatattggcctaagatatacataaagatcaatggagtagaattgagagtccagaaataaaccattatgtttatggacaattgattttcaacagggtgttgtgacgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaaatccagagacccagaaagatgagtggttgccagtggccagggggaggggacaatacagagtggctactaatgggtacaggatttcttttggaaaggtgattaaagtattctggaatttgctgcacaattctttgaatatactaagaatcactaaattgtgcatttttaaagggcatattttatggtatgtgaatcatgtcttaactaaaaaatttgttttaaaaggctctgtattgaataatttgcctagaatacacacatggcattgggagtggcctccactctgaataagcttacaatctcttggggaaaaatgcaatctaacagttatagtacttaagcgtacatggtaagaaagaagcacatggagggtgcttattgaatgggaaaaggaagaaatctacctggatgatcacagaaggtgtttggtggatagggagtatttgcaagaagaatccgactctcgtgtagcttgagaaagcagaatgaaaacccgtatctaggaactgaggaaggcagtcagcaatgtaaggtcaatatttttctaaaagtaatggcagctgaagtacaacttaggctgcctgagaagagagcaagttttccttcattggagcatttgaaatgacactctggtatttacaaggtgaattattcacactctttaaatctcagtgttctgagttgataacacatttcagagttgacatgaggaccacaaggaataataagtgtgtgtttaatgtgaaaatacaatatcttgtacataataaacagttattactgttggtctcaccaccaacatcattatcaaatgaatcttggcagtaattctgggaaaggaatttaggcaacagatgggagctcatttgaatgatgctaggatttcatggtactcccattgttggttacagaactccaagaactctcattcttggagttttctgtttcctcatataaaacttggaaggaagaacagaagaccttcattctgttccaggcccttaaattgattatttctgtgcctaaagcaaactgctcagcctcaatcatgactttgcacaatttgctgtgatacctggtatagatgtttcatttgttaaagttgttactgacaagaacctccaatgaccttggaacatgacctggcccctgtgggtatcagtagaattttggtgaacactgagaagtctctgagtttctttcaatctgggcttctttcagttggtttgcaaactggacttgtggaattagatgatctctcatgcccattctatctttgagttggtattatttttgccccgtattaaagaaaaactatattgatatttctttctttgcttttgttatttcactatagaaaattttgttttaacattcggttggagttgatgatatacaacccaattatatggatttgttatatgcaaacataaggaagtattcacaaatttaaagaccaagttcatgttgttcaagataatgtgaacccaaattcattgtgctcaggataatttggaactaatttcatagagtttaagatatattatagtaattaaaatcatggattttgggagcacactcccctgactctaaatatgtggcctgggatgtcacttaaacattttgtgcctcagttcttttatctctataatgaagaccattatagtatctatctcccaggattgtaatgaggactaaatgagtttccatgtataaagcacttgaaacagtgtttgacatatttagcaccatatgcattagaagatcttattgttagctgcgtgcttattcttaaattgtctgagttactgcttttatataagaagattgacttataaatttggcccatgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctgtctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgagccgagattgcacccctgcactctagcctaggtgacaagagcgaaactccatcacacacacaaaaaaacaaaaacaaaacaaataaaaattgtatagatttatggtgtagaacatgatgtttgatatatgtatacattgtgaaatggctaaatcaaactaataaaaatttgcattacctcccatatttattttttgtggtgagaaaacttaaaatctcccaacaaatttataatacacttgcatctgcaattcttgaaagaactattaggtttggaaaactagaattccgaattcagttctgccatacctagaaacgtgaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattagcccacactaagaaagatggcattgtaaaagaatgtgaagcccaggaattaagaatactagggggaatcttataaacctgccgatcacaaaagagagtgaggttagacttactgtccacagggatttagtgcaaatgtaagtttatttgtagaatctgtcaagtcagaaagcagaggaggcatgtggggtatcatgagaagaatagaatctggaaggagtaacaggtaatgaaaggtactaacagatgtaggaagaactccagaatttaagaaagttatacctgaatgtggtttaggaggtcttttgatctaaccacctccatttctcaaggagtccaaagcatatagagggccttactcaggccagaagttgtggctgaacaatgagttggaacaaagtccacaaactcctgacttagtacagattttcagcttgatgtaatgaatatagctctggatttggagtgaaaagatacacatgttcaacttttgatttgcctctgagtggctgtgtcaccctgagcaagtgataagtaaaggaagcttgatatatggttacccagtttataacatgaagctatcattatcatgtatattcatttatgtctgatgaacatattaacttttctttatgaaaattctttgtaagctgacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttgatgggactgtaaactagttcaaccattgtggaagtcagtgtggcgattcctcagggatctagaactagaaataccatttgacccagccatcccattactgggtatatacccaaatgactataaatcatgctgctatatagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgtaccagcatggcacatgtatacatatgtaactaacctgcacaatgtgcacatgtaccctaaaacttaaagtataattaaaaaaaaaaacattaaaaaaaaaaaagaaaattctttgtaagctataaaagcctttagaaaaaaaagtaagctttgtttaaattattaatgtgtaggttgaggcaaaacaagcactcccttttgacagaagggataagtactggttcatataaatacaattttatctccatctgtatctgtatcagccatttatttctgcttgataaattatcccaaagcttagtaatgtctaccttactcacatatctgcaattttgatagtactccatgaaaatagcttaactctgttctgtgaaatgagcccatgtgcctcgatttgggtgcagaggattcactttcaagatgctttactcatggctggcagtttggtgttagaagtgcgactagagttgtgtgtcaggaccttagtttctcttaatgtgagttcctctacaggctcctagggctttcttacagcatggtggatgagttccaaggccaagtatcacaagagagaaaggtagaaatgccagcattgttatgacttagttttagaacttacacagagtgtcctttctactatacactgttgattgaggtccacctgggctcaaagacagggggttagtctccacctttgttgttggggttgtagtaaggctccagacaagtttgtgggcaagagacactgtcgtgaccatctgtgtacagtacagcctgccattatattgtattttattgcattgtatcacattttactacatcatattttaatgttttatgttgtatttgtttccatttgtggaggacttaatatctgccagacatgtatattctgtattaaagttgacttaattctcacaacaaccctgtgatgacgtggtccttctcattttcaccaacgagaaaaccaagttataaagatggtaagtaacttgcctaaggtcaaaccagctcataagtggcagagttcaggttcaaaaccaggcaatctagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccatacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattctccttctgatcctagcgtaaattcctgtggatcaaagcccagcccctgagactgtaacagagagaataaaagaacaagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacagaagtctgtatagccttgttgtattttaatcattttatctttttttttggcctggaaaatattaagttagaatggctgtgctggaatacatcatccccacctgtatattaaagctctgtgttatttaaaaatttgtctaagaaacctataaattgatggagcctcactgtggtggttctacttctctattttgtgtgtttgtttgtttgtttgttttttggtctggtgccattgagccactgtctataggaataaaaggatgttagcatgactgatagttcagtgacctgtaagtagcgattttaaagaaaaattttataggtctttgttagttccaaatctgactacctgttaattctgctttatagtcatgctctgactttaccatgaaggctgtagcattgtgctttatctccttgtctccagagtacaagatcttggtaagagaaaagagtgataaacccaaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttgtgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacagttccacatggctggggaggactcagagtcatggcgggaggcgaaaggcacttcttacatggcagtggtgagagaaaatgaggacgatgcaaaagcagaaacccctgataaaaccatcagatctcataagacttattgactaccacgagaacagtatgggggaaactgcccccatgattcaaattatctcccactgggtctctccctcaacatgtgggaattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccagaattattacatcttaacttctccctgagaattatttactgatcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgagattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagacctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgcagaagatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttttaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatttacagtgatgcgttcttttatttagatggaataggagaacccatagagttgaagctgtttgtctgaaggtttgcagcagatcagtggctctgccaagcctgcaactatcatcacctgactccaagttactctctttctagtccagcacagctgcctcccaagtttaatagtctatgactcacaatccaaatctatggtgacatataatattttactttgattccaaatcaacaagccagttttagaagtgcttacactgctgcattactttttatactattgggttcttcaagttgagtcttatttctagaactccaataagaataaccagaggagtcatttattttgttattatgacatatttattgaagacttattgggtggcaagctgtcttatagagggtgagggtacagctatgcataaaacaatgtgtattttcttaaaagagtttatattactgtgggagaggcatagtaaacatgttaggttctatagagaaaaataaagcaagataaaagtgaaagagtgctttgggttgagtggagccatagttgctattctgcacaaagtggttaagaaaagccttaagaggaagagatatttgaggagagatctcaaggaggtgaggaagtgagctctgcagatatttgggataagcatgttatagacagagggaagcacaagcgtgaaaagtctgagaagatcatggctggcatctggcatttttaagaaagagtgaagtagccaagggtgcctgaagccaagtgatcccaaggaagtgaggaaaaataaggttagggaggtagcaggggccctcatgatcacatagaacctcataggacctcttattcttagtttaagtgagatggagagcatttggagtcacattatcaggcttatgttaaggatcactcaggcagctttctgtaggctatgtggtaatccaaaccagaagtgacaacacaaactagaaattacaatcaaactcaaaatgatagttggttggacttggtaggtatagttggtgttggggaggggataagaagtagtgggattctggatatatttccattgcagcctcaacaactattgtgagcagatcagatgtggaatataagagtaatagaagagtcaagaatggctcctaggtttttaccctgagcaaggagaagaatggaattgctatttagtgagatttctggagacaggaagattaattttgcttctgtttttgttgtttagaagagaaaggagaaaggatgatcagccatttggctttgaatatgttatatttgagctatcttttagagattcgagtattggttgagtagacagctgtatatttgagtctggggtacaagggcaggctcttgacttgatataggtgtaggtgtcagcagatatacatttagagctttgagcctggatcatatcacctaaggtaatggaggaagccatgaatattttgatgtcatggagaaaatagaggaactattaaagaatgcttgggacaagaaacactgaggtgggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaataatggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtgaagtcttccctccctttctatttctgggacctagaacttaaaatggcctcttatgttgaattcttctcattcatatttctataaactcaaataatggtgcctttaacatcttcagacgtgccttcatgcgttacaaaaaaaaagatggtttgatatttgtttcctttatcttctttgaaatgcacgaataaaggtaactatttacaaacctgaaataaagcaaaactgtgtttattagattcttgaaaagcggttttgcaaatctaaatcaagcaccgggctaggaggactacattaagcaacaacaccagcaatgagtggtatattttaggaactgtgtccatggacagaatgagatatcatgagcaaatatctgttgcaattcctgtgccaattcataaatggcaacagctgattcttgccttgctcacatagttgtagtctggatggtaaaaggtaatattttcaactccttggtttactttgtcaggagtaataagtttctaataaagaagctatatttatacttctcacctagcctctctctctctgtgtagtccatgccacaaacactgtacattggctaacatatttgtctgagtaagggtgagagacaagaagaacatgagggaaactagaggttgtacaagtaaattctattgttgctaatgccataatttattccagatattatctagtcccagaatgtgcatatgaatgttctggcgctctcttttctgtacttgtaataaacaagacatcagaagacacaagagttgagagggcccagtttcagtacctcttgttataaatcatcaagcaggtaaagagaagatccctgatgttatcagtacttttgagcagaaagcatggatgttatcagtatttttgaccagaaagagaatggatgttatcagtatttttgagcagaaagcatgcgtgtttgtacaccttcttgtttactccacataggcactccgacaaaatagtatctctacctcaaccagtaagttccttatctgtctctgagttcttttgtccttctacagaaacaagagtgtttctcttaaactaactccctcattctggataaactgatataataaaaacaccagaacgaaaacgcatgtattcataccatactttcccacctcactgtgctgtactctgtagagttcatatcctctcttcttttacacctcttcagtgagctctataattttctagctcttggttgtttctctgttcgtatcatctacctgcaatgccattcatcacttcctacctgccactctcacccttcattttttacctgaggagctgcctcctaccccgtatgagttgctgtacacgtttcttttgacacttgtcacatatataccctgttatggttgtggtcagctgtgtagattcaacttccttgacaaggctggaaaattgtgaattgtaggaagtgtgtttgagtgtgcttccgtttctgggattcccactgtgtctaaccctgtggtatctggcatgggttaggcaatcaacaaatgtttgctgaacaaatgaaaacaaatgggtaaaaaactcaaacctttaatattcattttttaagaaaaatagtaaatagcattaccatgactgacagaccacagttaatttgccatttctacctcccacttgctgttctcaaaaaaagtggaataaaaccacagatttgccaatggtcaaaagatgaatctaaagggcaatgatgttacaacttattattaacttatttcatttctgcctaccaagaaatgtgtatgactcagcttttgtccaagcagcactgcttttgttctattttgaattcgtggtggaaaggatgagtttttgataaagatcttgacttttttgtatcaaatagaggataggacggtattatagagattaggtaatgaaatgcatgggttctaatgcctgcactgcctctacccctgtctagctatatgaccttgaacatttccttgcctctgtctaggccttagtctccccagatgtaacatgagggagctgatgtagttaattgtcagtggctcttgcagccaagcatcctagactggaattctaggtgggattcagagtaattccttgtgatgacatatgactcaaccttcagctgttaactggctcaccatcgtgacaacaggcaccagattattcacacatttttgaatatttgaattgcataaggctgctcaatgatggtgaaaattgggtcctaaatgttctatcagatatatatgtagtgtaacctgttcaggatctcgtgtgagtgtaaaatgatgtgtgaaatatgcaccaagcaagaaacactttgcacattatgataaggcagtaatacaatttgatttttatgagttaaagatgatggtactataagagctctagttatatgaagcctggaactatagtatgtcttagtctttatagaaaggaaaacaattaaaaatgttgtttctcactcttgtatttccgtgttcgtagagtcaatagtttcactcaaggcaggaagacaagacctgatgttagcccctctgtccgagtcattcaacacctcaccccctccagttatatttatatttatacatattttattattcttttactatgccagtaccacaatgggaaatatgtttacttttaaaaagctacccagaatcctccaatttctcgtccgagaatataaaaacacttacctcacataaactcacttaagaaaatgtgaatgtaacactgttcccccaaaccgctttcttctttgaatgccagcttttcacatagcagctttcctgacctcctacttccaggacctcagacccctctgtctgtgggctggcacttggaatgtggctgtccacttggcaaagtggaaagagcttctgttctcactgtggcatctggggcctcaattctggttccaccactcagcagctctttgaatgctaggaggatatttcacttctccagatcctaatctcttcactggtaagagaggaataattatatttactttttgacatggctagaataattacagagaatgcatagagagcatctaacacagagactgacaggtagtaggtgcaggtttacttccccttctgtagatggtccagggtctctgacgcatctctgcttcttcactggtttatctctgtgctatgctaccaccaaggagtcgtctatgcacagataaagagggaaaatggtctgcagtcatcacttgggattctatgcaattcagtgaggtctcaaatcactactcaacaaccattcagcagcaatgcgatgtcaatgtccttatctgtttctcatgctactactgtttcatatctcctacgtaatgtagtttaggagaaagagtcatgaagtgggttccagtagtcctggcttccagttccgattctcagataaacctactctttgacccatgccaagtcatatccttccacatatttaaatgacaatcctataccttagttctctccagagatacatagattgttcaggctgatgcacttatgctttgatttactggatattcaagtaatgaagcctatctttttctatgttttcttctttttctggaattcaaagtctatgtgttcttgccattgcccctgaagtagtaacatttctgagcctggctgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagtttgaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatcgctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagataaagcagtttgaaagtgcactttctaatgagaacctggagattcatggagaatttgcagcgcatggacttgtgagcagttggcgttaaggttgagaagagggcagtgtggactgaatgtggaggcttctacagtgtgtactatttataatcacgcacacacagacacacacagacaaacacacacatacaaacacacacactcatcccttttcagggtctcctgacgacctatactgcctgttgctctttttacctcagccagcaaagagataaattgtcaagattaagtagatctgaacatttgagaaggagttccataaaaaagacaatgaaaatcaagtgtaccagcatctttgattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaactgagcctcactcttggtcctgttgattttgaatggaatagttcctctaattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatgtgtgtgtgtgtgtgtgtgtgtgtgtttgtgtgtgtgtggtatattatctattttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgttttttttttgtttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggtacttaacgcaataaaaatatctaccataatttaaaaatgcaaatgtagcaatgcactaaaaaatacctttagcttattttttgttaagaaacaagtgttttgcataatcaggctttaaaaaatataattgaattctctatactgattctatgataggaaggtccagagtcaggtccaccttccatgccatactccttctttccaccattcgcagctggtcctactgagggtaattagtaggggataatatctgaaaatgtaggtatgtaagagaatagagctaatctgcctagcttttatgatattacagatcgcagaggagcatcctcacggataattcccaaatcacagataatgtgttgttgtgctttataagcagagagacacaaaataaactctctcccctatccttctcttttatttatttattttccttctgttaatagatttagtcattttttaaaaccataatataccaggatgagccagaattatgtgtgtctaagttcttttaaaataaagaaatcgtttcttgggtctgttttagttaggtcctttcaggttgcaggaaccaagatgtgcttaaagttacctcagatgactttagatgatgggaatttatggtaatatacagggagaaggaaggaagtccaaaaacccatgtcagcaactagacaaccaagcctcatggagacttggaatatcattgaggacacaacagcagctgattttgtcattcctcagaaataaacatccagtgtttccttgtccggtgggtctttgttggacaaggacttagctttcttcaattttccttctgttttctgtggcagctcctgttagtgattctgtttagtcttcttctgaacactaggatgttcgttatatgatgtcctgctgcctcatggcctcctcatcctacgccgtgtgtctctggcttttgctccattccatctctgctcccagcttttctttttctgtatccttacactgaaaagcctgaaccaacaggaccattattttagctggttcttctccagtacacatggaggaggaattcttcctccaacacagctcctgggtatctagtctggtttgggttcaatgtctgatccaactagctgtggccagagtgcagaattacctgttacaaaactgtggcaatgtagttattaaaacaagcaactttttgagggttttgcttaaacagagtggttggtgtggtagagacaacattgtatgtacttctctatcacagagagaaatttataaagtcaaggcaaaccaaatatctgaggctgggacttcaccccagatgtttgcaagtaaacaagttgtggaccttagagatccgctcctctcactttctgactgcctcttgctttggtctgtagaccaatgttccactagtatttagttttcattctggttttaaaacggtttatctgtaaacctgtaatttaaacttctgataagcaaaactaacatagtaatgagcccattagaaagcaatcgtgagatactattagactttgataactttcaagaagctttattctatttttgcccattcaaagctaacatttttggcagttttaaaactgaatggggtttttgttttttcctaaatatgtttgtctgatgtatattatatcttattatggcaaagaaacttaaagtaccaaatagaatgaagacatatttgatattaaaataatgaaaaacattcaatatttgataacttcagagagactttgactaagcttcaaggttatttttataaacatgtactactggacaatgtatagaagtttcttagctcacagattttcactttggtagatgaggactaatgtgtttgccagaatgtgcacctcttctctatttaccgtaaagagaggtgtgggtaggagattgcacagtgtcacttagggcttagaggtgagggattttggaatagcttttagtttaacctgcgtgtgagaaaagaaggtttcatcgtgtggttaataggaattttcatatgataggaaaaggattaacaagatttaactttatattctcaataacttcccaattaaccagtgtctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattagttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggatttagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttctcgtcattaaagcttttatgtaaccttgaacaagttccttaacctctctgcgcctcaacttccacatcattaaaatggggatgataataggacccatctcataggattgttaggactattaaatgtattatactctattacttgtatcctataaaatatctttctcacagtttaatttcttgaaaattgaaacacatcctatgattgatgtggtaagaaaccattgtaacacatattaagtgacacctgttggttctttgttagtaggttagtagggaaaaaaaaagatgcagtttatagtcaaagccgtgtgtaaagtgtgtctaaagtgcttaaaacaaagcctgtcatacagttggtcttatagaatgatgctgttatcatcattgcctgaataccatatttgtggtatgtaaaatatttgtctccaatttcactggcttctgtcctatgaagcagatatacttatagttcctggtctttgagtaaatagagcctagaaggattatcagatattacacaactgccaaataatgacttacatcaaaccaagagtttattcctcttctcatgcatatcaacacctgtttaatctgatcatgttttcaaaaacccactagtgatctatttatttctagctatagctttcatcacctgtatttggtgatttgttgctggcagagtccatactcataacactaaatctgactactgtgattacaacagtctttctaagttagataccactaatgatattgattagggagaaggcattctttgtgatcctatttgcacgatctcgggtaattcacttactggacccaattgttagttgtgaaatgtgaatgttgaaagcagtgaatcttccagctgcttgatttgtgatatcactatcaatttacctactgaggagcttcatataaattggtcatttgtagaaagtagttcagtggctgagaatctggcataatattttatttttatgaaatttcagtaaacattattgagcaacttgtaggtttcaggctccacgatagggatgcaagcatgtaagacctctgtccagcaactgagaggtaaaactacaatgagaaagatagactggtaattcagatttatttttaaataatagctttttgagatataatatacttacccttcaatccactgactctggttttaaaggagatgattaatacattcactcaaccgatattgagcatctgatatgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttggggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaaattgcaattgtgaaaggaagatttgcgtgaaagaatggtgtttttggctgagtgaggaatttgaagtatctggaaaatggagtaagtggcacagagaaagaaaacagccaaataataataataataataaattggtgagggttcggagagccgcttacaattggattcggtgcaatgcaatgactttatatgttctgtaccttgtccttgtaggcagttgcaggcactagggacaggagtctggggggaagacaggagcattgaaagtttgaggaaaaaatgagaagcatgctttagaaagataatctgaatatacttgaattggaggggccctggattgtgaatgaaaattagaagtatgtcatctgtattgtgtaggatagtgcttatctacaaagaattttatgtagaattccccatcagattaaccctttgcagcaatagccaattatttctgatattaaaaattataattaaataaaagatatggattggtaactaaacatttattgagaagttactgtatcacttccacaaatcaattcacttatttttcttagtaatccaatgatgtagcctgtcatttctcccatttttcagcagaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactctaaccctagataacctcaaatctactttagtggtagtcagtttgtatgaatggcaacttcagtttaatggcttttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggcacatagacaaactattaagcaatattggagaaagaaattattgtagaaatcctgatgtttttggtgaatggcttatgttaaacttctctctcctggaagtcattgaattgtttttaaaaacttagtatgtatgaagcatttggaatgcttggcattttgagaataaaatccacatcaatttaaaataaaataaaactccccatccagaatagagtagtaattgcaaggcataaaatagcccagctgtggagtggcttaaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttcaggaagattttccttctgggcaaagattaagtcttatttcatgctccatgaggatcaagcacacatttggccctcccatgtttagtagtggtgatttctttgcctttctcacattcatgttcatgtataaacatagacaccaatataaaactaaatgcaataaaagtgtgttttaagatctaccacatgtatgtcctagtaggtatagatagatgttatatatctgtgttcactgcacttacatcccaatattttcagaagataggactgtatgcaaatgtttccaatatctctttctaggatcacaaaaaaaaaagagcccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttatgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaatatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagatacattattagagttaagggtcctaaggctttttaatgtgagcagagtgcaatgaaagaatattttggattgaccaaaagtctagagaacctgatttgtaactgtatcattatgacttactgaatttcattcagtaaatattgcatgaaattgagctgaaattcatgtctgctaaatatgtgtactctgcccttttctcttcattatgaggattaaattgaatgataggggtgtaagcactttgtaaatccaagtaagaattattagttaggatagttcaggtagtgctgtagtaacaaatacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaatgttcctcaagtgctttgagctccctgtttggatagatgtgactgaaatgtaaaatacctttcactgccttatttattgctccagcgaacacgctatatgctggcaccatttatcttcattttaattttatctcccacaaatataggcattaatttaaatcacatacagaacataacagtttttatagaggcaaacttattccagtgtgctgcattttaatatcgcactttaccatcttttctcacttgattcaagaatagtatctcttcctgcctcagcatttaatcttaggacaacagaaacttttttgtgtgtgcatgttcttgctctcaaactttgtttctcactgctttgctgcttgttgcctgaaagttgttctgtcagtgtgagcacaggtgtaagtaattccatttctcttttgccagcttaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaatcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgcaaattaaaaagaaaacaaaacttattttgattttttgtttttagttttcctagtctctgaatgtctaggtttagggacatctgtcatagtcttatttatttattttacgtttagtctggatttaaaatgtacaaattaatgtttaagttctctgttttattcctgtaacaatcctacaagaacaggttccattattgtgttcatcttgcagatgaggaaacaaggcctagagaagttaaatatttttttctgaaatggtacagctagtacgtggcagggctcagattttggatccggtccaccttaactaaatatgcttttgatgtagctctcttcaggctgaattcttgacctctcatttgatgctgactcttctcaaacccttagtctttgtgctactaggtagattttatctgtggcaagaacacggttaccctggaaacccactagctagaatggcaagccaattatagcaccaccgctttttttaaattaaattagcgctgctgatgacgtggacttcttgattgaagcatgctgagaaatgggttctcaccagttgttcctgcctcttaggatcatgtgggatcattctcatctattctatcaagccaaacaagaaaatgcctctatgtgattgactggatttgaggaataaaatgtgatgatcttttaggaccctgagctttcagtagtgagtagacatgcatggaaatgtttggaaagaagccctattggagaagaagcctgtcatctggatactttccacccccaagcacacaaggtccactgatttaaagccctgctcttaactactgaggctaatgttctctattttagtatttcttattttatttaaggccattggtttaaatccagacttgattcaggaaaggttgtagccctttgatattctttggtctttgcacacttctaatagggcaggaatttgctttagttcaaaccaattggtgcatttcctttaagtacacagaatttaaacaattgaattgatatggccactgttgaactgagtggtaccaggttggaggaaaggacattcattatatgttagtgggttgtgggctcactctctgagatggtaaacggtaggctggtagaatgttgagtagttcattctgcataacacacatggcgccaggcacattacctagtacctctatgattttcatccgctttattttctgttttgtagagtaggtaaaggtaaggagacgggcttgctcatttgcaaggctattctgtgatgcagggttctgagtacaggattccttatttgcagtccagtgctcttcactttataccaccaagtcaccagagtctcagggcctgtcttctgtatcgcagaaaacaaatcaaggattagcaacactgaatcttaattcttgaagttctaacaggaaaattatgttagtcttgctacatatcgtaggcatattttgtccaaaatgagagtaatcagggaggagaagaggctgcatcttactgtgtcctgatgggtgatacttccgtgactatctccatcaccagtgagcagatttccagaagtcatagttcaaaacgatgaagagaattacacattttcagaaaacattgtacattctttgttaacttttccacttgtaaaataatttgttttcagacatccaggtcctttctccatgatttactgcgttggtgacattaatcagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaatagcaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgtatactatatattttaataaatttatataagtatatgtatgtatatacatatgttttgcaagtaaaaaaactttagtaataaatatctacaaaggcaatgagagctcgtccaaannnnnnnnnnnnnnnnnnnnttccttcttccttcttgccctttctttctctctctctcttttcctctcccccttctgtcttcctctccccacctccatctccctctctctctcctccctccctgccgccttccttctttccagaaagtcactaaccagaatctttcacagaataaactgtgaaacctagatcttaaatgtactacagtagaaaaagagatgagatttttgaaagatgatggcttgtccttgtctctgtacttgaatctatctcaaaacaaagatataactattgtttttaataataatttcaatatagagtgaccatccttgcctactaccctgaagagagagagcatttacacataagactggtggttgcagtaaacccctttcaagtggagtggccactatggtccttcctcttcccttccttcctttcattcccttgccctttccccactttccttctcttcctttccttttttcttttaaggttcataaaatcttgattggcctccttcctagcagccaggagtttgggtccctaatagctaaagcttatatactttattttcttctttctccagatggctgtggctatgaattttactccccatcccaggactacccctgctatactgacactaattttcattttataatactgtcttcatcagtccatgctatgctactagttttagttattataatattaacttaatccacaatgaaggcgacaggtttttttgtgtgtcttactttttaaaggggaaatattatctctcactttaaggaaactaactttagcaactcattccctcactttttttttttctttcaacttgatttgttcaactaaggagaccacatttagtacttgctagctgagacttctgttctacaattctgagttagttcctcatccgtccgaccctctctccccgtggtgcactgagtcacaatgtgatcaccagctgcatgtgctgctattacacacaacacattggctagcagaggagccaggattcagccttggaagtactttcaggcaaaggtgaagaccctttccccactctaagcatctttcagtagtttagtgtagctgatattaatgttataaatggtcattcctaatcctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaaggtcttaacatgttgaaatgttaaaaacattctgtaattacttaaattatttcaaaacagaaagatcatacatgttcatcatgtttctgtgttaactggacaaaactacactaaaattaaagagcaataaaagcaatcgtgttaaaattttatttttaaatatagtacttctagtaactgaatatctaactttattaacaattctaaatctcgctttttttttttttaaaccccagtgaggctgggcaccgtggctcacacctgtaatctgagctctttgggatgctgaggcggtatgatcccatgagcacaggagtttgagaccagcctgggcaacatagtcagatcctgtctctacaaaaagttttttaaatagccaggattagccaggcatgatggcatgcacttgttgtgtcagccactgctcattgggggttgggggggttgggggtgggcctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctactcgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggctcagggcccaactcactcatctgtaactctcatctccattcagctgcagcctctacagcccctggttataccctggatcttatcattgcttcgctctattttacctcctaaatcgtaaaaattaaaaccagcctcggaacacaacccctcattcttccagcactctctctcattcaggtaactcctattctacttttcttcagcatatttaccttctattacctttctttttcctcaccagtctcttatatttcctttattatccaacttacagtctgtggttcaatacttcagccgactcttccaacacatgaccttctttcggtaggcttttttcagagtttcccttttgtacttgcccttatgtaaatctgtggcacagtcaggccatcttgccaacttttcacagttattgcacaccacactctgttggttttcttcctaccattctgaacaatttcacttcagggctctccttagtggctcttcgtctccctctccttgaatgtcgttttacctttttctttttcttttttttttttttttttttttttgagacagactctcattctgtcacccaggctggagtgcagtggcgcaatttcagctcactgcaacctctgcctaccaggttcaaacgattctcttgcctcagcctcccgagtagctgtgtctacaggtgtgcaccatgcctggctaatttttttttcttttttcttttttctgttttctttttattagagatggggtttcaccacgttggccagtcttgtctcgaactcctgacctcaactgatccacccacctcggcctcccaaagtgctgggattacaggcatgagccaccgtgcctgggcttgaatgttgttttcctttggtggggcttggggaggggtgtctttcctagggcctgctcttgtttcacttcccacatttggttaagagagcctttaactactatggcctcaactatcagctctacaatatgatataaatttgtttcagtaaacttgctcttcagattcaattgtttctaactgcttatcgctcaggtgcatttggatgtattgcagaaatctcagcctcaatgttttcaaaataaactcatccacttctctcaggaattttttccactccaatgttgttcggtatgtggcatcaccatctaaccagtttcctaagccagaagtttaggtattatttctaagccctctctttcccttattatcaattttacctcctaaatatttcacaatctttctacttctcctcatttctgctgcggtacgtgatttcagatcagcatcatctttcatggaccattggtgatatccccctaacgggtttccttgtatccatttccccaccatcgccccaatctatccaccaaggctttcctaaaatgcaagtctgactgtattactttcctgtctaatatgttatctccttattcctgtagtataagacagtgattaggaaaacaggctctgaagtcaaatagaaatgagtttgaatctcatataactatgtgatcttggacaaaataaccttttttggtttgttttccacgtgcgaaataggaacagtaattgaacttttctttttagatgttgcatacctctctggtatacatgaagaagatgtgtagtatctcattcccaccccgcttatgcaccatgctatagtcacacactgcctttgctctgatccccagagacattgagccaccactggagagtcacatgatattgtttttagcctggaacattgttcactacctcagtcttttattgccttgtctcaacatagacgccatttcccttaagacattttcagcacactcctctggtataatttagtttaaatgtccttgctgtgttctcctgtgtttttctccttgaacttcctaatccttacaccttccaccctgcaaatgatcattatctcactgcctctcccaaatgataacctctttccacccattttaagttccatgaggacgatgaccattgacccggaccgcgttgttaaacttcttagtctcagctgccaagagcttagcacagtgtctagcagagatcggacactcagtaaatatttgatgaatgtttatagtgtgactgtctcgccagtgcacatacaacaaagtgatcccatctttccttctgtatcataaaatagaattttcttacctctgtaatttctccctaggaaccagactgcttctagagagcttcttcacaaaatcaaattaattggtattttacaaggagggaaagccccaggacaagtcccttctcttgaccacaaagttctgtgtttctcatctttcctcttgatgtcttggtttcagcaaagcaacatttctatccctgccccctgctcccccataatcctacaaatgtactatagatatgtgtaagtactacatccccaatcaagtacagcgtttggcctcgggtgggagtcaaacagcaagctgatttttaacattacttggaagaaattttctaggtatataactgacaaacattcatggagagctacttcatttttctgtcaagcttttgggggattttttttaatagttctgcactttgaaagaaagttcacaatttttaaaaggaaatgtggcccttttcattagctccttttacctcatgctgagtcatggatgagagagaatttgtaggcgggtgagctgcaggaaaagtaatactgtcatttacacttgcaggctgttatgctttccagaaaactttttccgtaggttgcgaaagtgattaatctgctgttaaaactgacaaagaaggttctctgataagagaaagaattaaatgaggaatttttctttaaaaagtaagcgcttctttcccattttagattagaaaaataagtttaaatgtttcttttaattttagtcgtgtgtgtgtgtgtgtgtgtgtgtgtgtgtgtgtgtgaagttggccatgacttaatacaatctcaagccattttctatttaaattatgtttttttacttattggcatggcttattcctcatgctgtatatctaaattattcatttctacatcctgttcccttgcttgtctctctttcttcttctttttttttcctttcattttctttatttgggtcttttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaacttggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaagagaaatggtcccttctgcaactgaagggaccagcacaggggacttggcattcttcttttagtcctaaagcttagacatacatactgctttcgcccctgggctacaaatacatgttttaaaattctgaagttgaaaacgtcaaaaccatttacaattaaaaacctgctattactgtatatttatacaggtatttcataagggaaaaagtagaaaacatgtaaatgtatttgttttatgtctgaagttccaagattatttctgtttctttactgaatgtgtttgaaatatatgcaaacacacatgtaaacatacctgtatatttatgtacagatataagtctacatggagaccagcatttttagataacactgttttacaggctgtgcatccatctttaaggtgctatagcataaggtctatgactgcattttgtaataaaagatggcaggctttctggaaagggtctctttggggcaggaagaggtgtgaagatcttttgcattctacttttaaagtacaacaagttaaattgctaccagatacattagctttatggaggtttgtttccatttttatagcaaaatcaaataacttttaaatcagaggaaaaaaatattcttttgttgtttttatttttgttgttgagattgcctgttttacgttgagtgcagtgtttttcaggtggaaacatattggtttgacattttaagaggaaaatgttctatatgtaatatgaaagagtctttttcttaactaaatgccagcaacaaaatttaaaccaaaaaatgtagtaatgaaacaatggtaatgagatatgattatggtttagtgagagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgcaatatgtgacagttccctgggagtttctcccctcctcgtaggtatttttagcaaaatagtccttaaacattgttttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacctgacctcgtgatcctcccacctctgcctcccaaagtgttgggattacagacgtgagccaccgcgcttgccccttaagtgttgttttaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcataaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataacttacctactcgctttgtgtcccccaaccctactttgtaaaaacctcaaacaatacaaaacatgataattccaaatatacagtacattgggctatgatatttcttaatgaatggaaagtcatgcatctggttctgtggtcatcattgatgttttaattttcacaatgtgttaacctgatacttaaattcccctagttgtcctgtgaagaaagaattttaaattcacatttcacatgcagacaaactctgatatttaaaaataatagttatcttttaaactgagatcctatgtggatatggaatagcgtatacagctctgacaatagggcttcagtaaaataacattttgcaagctgtgtttttcaagacaaaatgtcaccctcagctaaacagaagtaatttgcatcagaggtgtgtgtgtccttactcttaatgaaaaaacggtcccctctcttcagaaagtatttgctatctctacaatgtattattttcatcactgtgtccctcccctgcccttcttatgccctaatatttgtcccttaattctattaaattagttgtcaactaaaattaaaggtagatgttatccttcacaatctgtcctggtctaatttttcagtcttgattcgtcttctttactttatggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagatcgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtgaacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttactgagtttcttccctaatttagatctcaagttttgcaaaagaatgacaaattcctttatttaaagaaaaatgaaagcagatctgttaccttctgtcctatgaatgccaattctctatcctggataattagataaataagatatttataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaaacaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttgcaacagttttgcctgatttttgttttccccttttgctctgtttttgtagttcagtttgttgcagcattgttgtcatgtctaatttttgtttacgttgcactgcacagcactctttcgtatacttaagtaacctttcttgttctgcactgctgaatgacagctcatttattctagggtggtaattgcagtgtagcagacccaggtgagcaatgtaaaaagttgaagcagataaaatgtatgatttcttttataatggtattgtgtgctgtgttctcctcatatagatgctttttgtttacatagagaatatctaggaacaatctacatgttcttcaagatcttttaaaataaatactctttcatttttaaaaaagatgtattcttggccaggcgctgtggctcatgcctgtaatcccagtactttgggaggccgaggcgggtggatcacttgaggtcaggagtttgcgaccagcctggccaacatggtgaaaccctgcctctactaaaaaatacaaaaattagccgggcatagtggcacatgtttgtaatcccaggtactcaggaggttgaggcaggagaatcgcttgaacctggcaagcagaggttgcagcgagctgagatcgcgtcactgcaatccatcctagacaacacagcaaggctgtgtttaaaaaaataaaaagacataattgcaaaagaagtatttcacttcaccctttattataggacagaccacagtgcaagcaagaagataaatggttaacttacaactgacctctgattggagaatactagagagtggtgaagactgtggcaagcaggagggctcaccaacctcccagatttaacccaggctgcatgtaggaatgcagacccagtgttgctaggtctctggaattaagttatatttaactagcctgtgatctctaaggccttcaattatgaggttcagcaccactggaaaactgagtcagtttagtgctttatttcacaaaggcaaattgatggtcctttctgaccctaaattcccagttttacttaaactatttagacaaatctaagaagtgtgtgaaataaatacagtggagcttgaggatttttgttgttgatttctggtccttttatatttcctccttccctctgagggttcacataggagcctccacagccagaggattactttcagaatggaggcaagattatttcttggaattttggtctgaggaaaaattatttaggtcacttggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttaaatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcctagctctctcaaaagtctaagaaacaatgaataatattattttatttaaacattatttaaaaacatgaaaacagtgaatacaaagttgaactctcctcttacaataataaaaattcttcttgaataattctgtatcctaccattccatgaattgtatccatggaaaagtgtatgtttttctgattcatttatttatttgcttctaggttattggatgaagaaatctaggaatagaatgaataactgtatagattacacctctgatgcctggtgtgtgtgtgtgtgtgtgtgtgtgtgtgtgtgtttcttcccttgtgattttctctccttttcctgcctaataatgatgtagctgatctgcttatcatgttcctttatttctataattccaattgttgtagatcccatagaggtgttcactcttgctctctctctctcttctctctccctctcacacacacacagattaaatagagaaaattaagtaaagagaggaaaatgaggaataatttcatactttaatatattcattcattcattgctctttgataatttttttcttttttaattttatttttccctaagttattggggtataggtggtatttggttacattagtaagttctttaacggacatttgtgagatcctggtgcacccatcacctgagcagtatacactgcaccatatttgttgtcttttttcccatgctcccctcccactctttccctcaagtccccaaactccattgtatcattcttatgcctttgcgtcctcatagcttagctcccacatatcagtgagaacatacgatgttcggtttcccattcctgagttacttcacttagaataatagtctctaatctcatccaggtcattgcaaatgctgttaattcattcatttttatggctgagcagtattccactgtatatgtatacaccgtagtttctttatccactcattgattgatgggcatttgggttggttccacgatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatgatatatgtatgaatttatatcctgttatttttctgaaacattatagcataacaggattaagtatcctattacctctacagttcctgatatttataaagataaattatgaaaataatgtttgaatgagaaggtttttctgtttatatgctgttccaaagaaccttaggtatcagaatttatctgagcccaaaaacgtcccttaggtaccttaagctacccaaattctttgaattctttcaatcaaatcccctaattttataaagaggaaattgaaacccaagaaacaatataagtgaatttgtttgaacccaggaatttcagtacttgttgtcctaatttaaaattgtgtcccaaagaatatttatctttgaatttgttgatgtttgctcttttaaaaaggaaagaagaataataaactaattcctcgttttacctttaaaaggaagtttcactggaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtgcagaattgttgaagggggagggttaaaaaaccagagccattttagtgattatgcaaagttagaatgtgagtaattttgctgcagttagtcattatgtgctttcatagcttgttttacagggataaagggatgtgtacaggtttggtgaatagagctcttatttgttcctaatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatcttttgtctttttatggcttccgagtagcagtaaaagataggaatggttggttctattacagtagttgattataaccaaaaactagtgaaccacactctccaaatgtcctgctacctacagctaagaaacccaatgtttataaactaactcagaacttttaaaattagattgaactacagaaccctctatcatacttaaatcttcttagatgaatggtgcacaaaactgatgggggatgggaagtgtgggcaattctgttaccgaactatttcccttattgtttcatttgattaaacacttctctcttgtatggaatttgccaataatacattattgaaaaaactgatttcaataatatgttattgaaaaaactaatttattgaataaaaacatatggaaaaatctctttgctagaccctaaggatggaaagcccaaatttctacccacatggagtttagagaggaaaggaacactaaataagtaattgcaaaacaagacgtaagggttatcataaggataatgcaaactattaaagagacattaatggtgggcaccttgtctaattttggaggttccagattggcttcctaaaggaggcatcatttcgtttgaaatctgaaggatgaataaccagttagaagttgcgagatggaagcaggttggaaagtgttcaaatcagggcaaccacaggatagctggagtgttgactcctgtgtagaggaaagtaagagaggaggctaagaagataaacagtagttctatcaggaaagaatttggacttcatggtaagagcaatgagaactcttgagagattttaatacaggaaggcaatgatcatatttgagttcttaaaatttgattttagaatagagtacgtactagaggacaataagcagtcagtttctttaaaaatacacatatacgtgtgtatgtgtttgttgcagtaagctaggtcactaatcatagtggactggactagggcaccaataagttaatagaagtagaaacattgacggtaactagtagagagaattaacaagctttactgcatcaagaggagaaaaaaaattgtgatcacgtttataacatataatcacattgctaaaatctttaaaatatctgttaaccttgaaacataactgatttatatagtttttgtcaatatacatatgaaccattatcttacttttcttttaaactggtatttcgaattaatgttttctggctttccagctgcataccattccattagctcaatgttctaggattttctcaaccatcctctgatttttcctttaatataaacaagtaaaatcacttatgtgcgttttaatagctcttcattgcaagtttgtccaccaaaagaatcatttcaattttcagtgctaccagtcatataaaaacgcacctgtaatattcccactgggattgagttttattatttcttgcctaattggttgaactcacagtatttttcactaaacccctggcctgattggagaaaagtgtctggtcccttgaggagatgcttcagcaaacgaggtcgcttgttatggaaataggctcttctctcactacatttctagatgatagaacacactcagattgatttcaccttcatcacaatggcattttatccagtgctggacacatgcatgctaagaactgagtgtactgtatgggtatttataatacccatattcattctaggaaataattatacatggctgggtatttacataaacaggagccttggagacctctcaagttcaaaaccgatggcattctatctcatttgaaagtcattggggtgggagaggacactccttaaaatattggatttcttagttttaatctgatgatatgctagctttatgaagatgtgagtgcaggccctcacctggatcgttgcttctctttttaataggaactagaaaatgaagattttcaaggtagcatctgggtgctcctaattgacttgattttatgtttgagaaaactaccttgacataccaacattggggtctctagaagtccagggagatgtttttcttcacagtgtcatataccctatcataagtgttgtgaggattaaatggaaaagcttctgggacaaaaactgctctgaagtgccacaccagactatactgttttaactatttctggctctgaagctattaagaataacccgtcactagcagagcacaaggctgtgaaatgaataagtgctgatacatttcaaagaagtaagatatttatgtgtgcatctctctggcaaaaactatcggggactcgttaggggtgtgtgtgtgtgtgtgtgtgtgtgtgtgtgtgtgtgtggtgtgtgctttatgtgttcattgaggactaaaaattagtattagtagtatattggcagcaatgttttgaactcggtggcaccaactaaaattgtgtgatttttatttcgtgcataatatttgagattattttaactcatcaccagatttcagctactatttatcctcatttataaggttactttttttctttaatgtggaaaataaacaaaaacataaaatggagaacaaaattttctcttaactgcctcacctagtgtaaaactgtaaccttttaaaatacattgaaaccatttttaattttctgctatgcttcttcctttttttgtatgtacatacacatggacattggaataccacaatattttagagtgtgtttgcttggtttttaaaataatgtatatatttctgatatatattatgttaaatatatatttatttttatacatttatatataagaaatgtataatatatactatgcctatataatatatatttcttcctttgagtgaaaaagtaatatgtggtagacacttagcaaaataggaaaagtatatagaatagccaaaaataacccctttaaaataaccaatgttatcagttgggaatagatccttctagccatatatgtatgcatatgtatatatgagatatagatagatgcattacttatcaacaggtataaaacaatattttctaactgaattttaaaacaaagaaaaattttgatacatattattatttttattatatagtggtaaaatatacataatacagaatttcacattctaaccaattttaagcgtataattcactggcactaagtacatttacattgttgtgcaaccatcaccagcagaactgtatctattcaaactgaaatgacatatccattaaacaataatgcactagctacattcttccttctcccatcccatggcaatcaccattctgctttctagctttataaatttgactcttctaggggcctcctatatgtagaaccatatggtatttgttttttgttttttgtttttgtaactggcttgtttcttcaagcttcaagcttaatctcttcaagcttcatctatgttgtagcatgtatcagaattttcttattacattgtgtgtgtgtatatatatgtatagatatatagatagatatagatgtgtgtgtgtatatatatatatcacattttatttatccattcatccatcagtggacacttgaattgcttcttcctttggctattgtgaataatactgctatgaacatattaccatgattgtacaaatagctgcattcctgcttttagttattttaggtatctacccagaagttgaattgccagattattgatatattttgaaatatttttatggcattgttttaatgactgtgtagtattctattatatgactatactgtaatgtatataaacaatcctcatgtattgattatttaaattttccattatcttttagttttataaagtacactattaacacggagcttcttgaaactaaacatttatgctctctggtcatttccataggctaaattttaagaaatgaaactatgggtttaaaaagtataaactttattagggcttttgttacatatcaccaaattacaccactgatttcccataaaaattttatagaaacaaacattaacttcgtccctaaatctaaattatataatcagttttccttctaagacaagtggagtcacaccattatgtcactcatagcccctaactccaagtgggatttcctgttcggctttagcaacagtatctaaaagtagttttgaactctggttttaactgacaatcacctgccccttcccttttgaatttccagatttcactctgttgagtgggtttatctacaataacttgcatttaaaaagccctaaatgattctgttgtgcagtcagatttaagaaatgcttttctaaatgtgtggtattatgtttatatatcgcactcttggccaggtgtggtggctcacgcctgtaatcccaacattttgggaggccaaggcagatggatcacttgaggtcaggagttccagaccagcctggacaacacagtgaaaaccccatctttactaaaaacacaaaatgagctggcgtggtggtgggtgcctataatcccagctatttgagaggctttgacacaagaattccttgaacacgcgaggcagaggttgcagtgagctgagatagtgccactgcactccagcctgggtgacagagcaagactctatctcaaatatatatatatatatatacacacacatatacatatacacacacacacatatatatagcattcttaatctcatatatatataatatatataaaatatatatatataatatatatatatgacattcttaatctgttaggttgttttccaactcatggggtcatctatcaagtggatagtgtaagtggcctggttggatgaggaatggagatatgggtacttaccctgaattatggaagataattagtgagatgactcaagaaagcaaatttagttattcttctagtcatggttaggataaaatgatgatgtaatttttgcatagagccaaaagaagcagcaaattagggatttcattataactgaaataggttagctgtgtttccatttttgctcattgtacaaactcagaaaccaattatatttatttatccagccattatttattaagtgcctacctgatatgaatccctaataatgagaccaagctcttcttgggcaataaaactctgaatattgcacatttactcttggaatcactggatttttgagagtcagagtatcttcttttataggtacctcgaccccagtgaagctctttttttttctcctgagtgatatagaaatatttttttatttgaagagaaagattatttattaaaaaaaaaaaaaaggagaagagtaacttagcatttcccctcctttgttgttcagatgaagagtcagtctagagaagtcacgtgactttcccaatgtcactaaattctaaacagtggtaaagctggcactttttttctcggtctcccaagttccagtgcacaactcttcaattgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattcaatttttcttctaggagagagaaagattttccagtgtctacattttgatcacttatctcttaaaaataggaaaactacggatagactgataaagaattttgtggttttttttttttaacatgtcaactattatatttcactgttttattacctgagagaggtggatggtttttaaaaccccaaactatgcagccagatgacccaggcttgaaccttcgatctgccacctactagtgatgtgtccttgggcagttacttaatctctcgtcaatatcttcttctggaaaatgaggattggtttccgtctcaggagtaactgtgaggattatatataaattatgttcaacacaaaatgtttgcaccaggtaatttctatataaatgtttgctattattacacatttttggggttaccaataggtattttagcttgtgttttctgccacagggatgtccagacaaagtagataactgaaagtgaaaagcacttgaggtattcttcaaataactcaaataattgtcatgaaaatataattgaaatggaaatattcatcatcttaatcttctagcaagtcaaccatcccccttttgatattttgtatattccttggccatatgaaaatatcattctctatggcctcaattgtattgtacaaatgaattcacatcatgtgtttttcatttaaaatttacatttaaatcttaagcagtttcccatgtcatgtagctgaaattaaaatgtaataaaatgattttgaatttcgtgctgctgtttaaacgttgaccttttgctactgtctattttctccttctgttacattggaaaattttctaagtagaaatcacttttactcatcacactaaattttgccccaaatattctgtaactaagaactttctgagtgcaatgagtgtgactttctttgtctcatagtgaatctagtaagcagctcaatgcctgttacatagtagactttcaataaatttctattgaataaataatttggattgaatttctgggatttgtggtattgtgtttacttggcagtaaattcagaatgtactttgttttagtacatgttgttaaatactatttttaaatgcattcgtctctttcctttcttagtaagtttatttaaaaattgccctttatttccagaggggatttgagtcagcatcaagtaaaacttacacatatagtatggccataaaaatgaaaacaagtacctcaaagtcttcctggaaaaataatagtatcaatacattccaaattaaaatcattaaactatttagaggtggaggggcactaatgagatgactgtaattaggcacacattacatattttacagaatttcttgattgtcaagtcaataaggaaaataagatagttcatattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcacgttgtggccatggtcctggagacaatcgagagacaaaagcagagatctggtgtcaaataaagggaatcattattcagcggctattgagcaatatattgggtattgtcattagtaacaatttcacagaaagatttaagaagcattttatttttcgtaagataatattccatttgatgcagatagatagctttctggtaaactaggttgatccagagataaagattaaaaaattcccagggacatttggttaacattttacttccaatggttctcaactagagaggaaaccacctcctgatggggagtttggaaatgaatgggcacatttttataaactgtcacaatgactggaggacactgttatcatttatcgggtagggagcaaaatacattactgtcaaactcaagaagaccatagtactctgttgagagacactgataaactcttgtgccacatatgtttctctggcttgctgattgtgaagttccgagctgactgtcaagaacggtcacagaccttctctagattttcacctccacagtactctctttgtcctgaacctagaggagatgacggctctgcctctgctagttccatattatttccctgtccttcgtgactcctctgcaattacatggggccatgtacataatacctgtgtaaatcagatccttgagaagacctagttggtgtgtgctgtcatttttatttgaatcctgactcttatggctatcttttccacatatcatttgtctcaaatatagtttcctagggatctcatagttccagatttagcttcctgttaagttacaagaagctggatagagtggtatctttttgtttggttggtttttgtgttttgttttgttctgtttttttggatattcgtctttaaaagggtaaacttgtcatttacttttgtaatttaagcagcctggatattcttgtcttgttggtggaggggctttacctttctgcttgaaggtggtcccaatagtactaaatagaaacatagtttcctcattaagcaatttattaaaatatgtatgttcaagacattcctaaaaaatactcagttaagactccaacattctattacagaggacgtggaaaaggcgttttgaacctagaaaaaatttaaggtcagatttttctcgtcaataatgccagtcataaaaaagtcagcgtagatgggcattgaatgaaagagggaataaagctttgcttttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtttttgaattaaagcaacagggcacaatttcaggcagccattgctttcttctaggaaatacctcactattagagctctctttggagatgagaagatttttctcacctttattatgaatcccattgtgtatgtgtgagcacgtttctgaatattttacatattataactgtatgtttgaaaatagaagatatatatatatatatatatatatatatatatatatatatatatataatttttttttcctttgcagttttacgtgccttacatcacgggagctggaaggggtagagaataggaataattttaaagcatatttatttatgttcttcatggttaaagaaaactatgccaacattcttctggcccacatattcaattaaatacatagtgaatcttttctacttactggattatttggtgcttccaagcatttatttttggcatttcatttcgtttttgtttttgcaggaatttttgaagttttattatgatttaacatttttattttgaaaatcgagcacattttaaaaattactctgctgtagctgtagtctgcccccaaaaacagatacttcaaaattcacctattttgaaaataaaaatgcaggtatagaaatttacatatacagattacttatttatctatgatttgttatgtgtatataaatctatttatacaatcatctataaatacagatatgcaaatatgttattttttgagacttaaatgtctgtagcaatcctttttttatgtggtatttttccattagtcattttctaagcctcttcaacatgtaaagctctgtgaggttaatggggggagagtggtgtcctaggatgatgaatagtgtgtctctccctgtcccccagtctggtagagaagctgtgcacaatagattagaccaaatagatttctacattttcaatcagaattagctgtggccaggagataagaacagacaaggtgcacccctgtgtgtctgccttctctcttggagcaggccctccacttccccttttgtttaagttcagataacatgttacattgtttatgtcactattcttcatgaccaattgtcacaaaacttttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttctgttggtctgtatatcttgtttttcatgccagtaccatactgttttgattactatagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagtatataatctttctcctccttagataacttttttccaagttttttatgctactgtaagtagaattttttcctttctttccttttctgctattcgtcggcagtgcacagatatacaactgatttttgtgttcatctgtgaacactttgaaggcaagattatgccttatttgtgttctacatagtaataaataataattagcagttattaatatttttcatttattcatttttattgagtttcgttggcagtaatttttgctttctttctttcttttttttcctattctttttagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgatcctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagttaacactctctgttacttcgtctgaataggtaaggtgtaatactacacatgcccactcaccacaacttggatttttcattagtactggaaccaacacgatgttgattcctcccattatgactagaggaaccaataagaataacttggaatcggtgaaaatagaggaactgagccagtttccagccacttgggttggaagagtgcccttgcttcttttcagttagaactgtgagaaatcagaaatttgagagccctcaattagctagaagttcaatggtagttttgggggatggattgggtagaagtttggactgtatttttaaaaattctttccacatttttacaagattgtccatttcaagacagatctattcacatattcaacattgtatcaaaaatttccttatagggtatttactaaactgtttttcttatatgaaagcgtctgccatattaatggtgtcctatgtgaatttcacattctataggggaatagagctcttcctgacagtggggactgtgaagagctggagaaatcctatagccttatgtgtgaccactatatgaaattggccagccatgatccctttccgatagatagattccaaattagaattttaaatgattttaaacatgactcagtttcttaagtctctctatgaaaagaaatgttattacagttttttatttctttttaaaatgaatttgtccataatagccaatctggacagccttgctctttgttaatgtcgcagtatatttgcaccagtgcctcctggcccagtcaaggggagtctattttcaaaacaaccagttcagagaaacagattattcaacttaaccacagtttttgttttcaacaattgcaacagatttacccagggaagattacagtaaaataaaattttaggtcagaacaactgctgtcaaggtttaagttcaactagacagacaatttagccctgcccaaaacagggtgactgaaaggatggctgagtgatgttcctgaaggaatgacatggtgtctgccttgttggaggattgtgttatcccacataggaaccagacatgagagaaagcaaaactatgtgtcttgatgagactcacctggtgagaggtactgagctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatgtcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattctactgcacctgtgcacagaggaccttattgtccttatattgactgtttggcttaattatgtgactacgggcatgagaaatgagctccgaattcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaaggaaagaaaaaatgaaaaggaaaaaatgaagaaaggaaagaggcagaatgagaacctgcaaggcttaggggatcatgattatgtttatgttcccataatgtgctaagcagtgaatttgcatgctacagtgggccatactgtatttcctataccatctgagcagagttccttgaaaaatagtgttataaataagtctttataaggtagaaatgttctcttctcactggaaatcctcttaaagatgcagtggaatctcttctctttgctgatttataaaagctaatgtcagctacatcttgccatgtagttcacagaactcgtgtcctgtgcattttatatatctatatctatacctatatctatatctatatctatatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttatgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcatcatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttaatttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacagctcaggtgcattttcctttaaggatgcatttaacctgctagatgtcatctcatttttaagaccagagaaaaagagagcagcatctgttgtttcttgactttttaataatagccattctgactggtgtgagagatggtatctcattgttgttttgatttgcattcctctaatgatcagtgatgttgaactttttttcatatgtttgttgaccgcataaatgtcttattttgggaggtggctgctcataccctttgtccactttttgatgaggttgtttgtttttctcttgtaaatttgtttaagttccttgtatattctcgatattagacctgtgtcagatgggtagattgcaaaaattttctcccattctgtaggttgcctattcactctgatgatagtttcttttgcaaaagctctttagtttagttacatcccatttgtcaattttggcttttgttgcaattgcttttggcgttttcatcatgaagccgttgcccatgcctgtgtcctgaatggtactgcctaggttttctcctagggtttttatgcttgcttttgggttttacatttaagtatttaatccatcttgagttaatttttgtataaggtgtaaggaagtagtccagttttagttttctgcatacagctagccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcagtaccagtaccatgttgttttggttactgtagccttgtagtatagtttgaagtcaggtagcatgatgcctccagctttgttctttttgcttgggattgccttgtctgtacaggctctttttcatttctatgggtttttttcatttccgtatacgttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaatagatttttatatactccctttgtatcctataacttgttaaatgtaatagttgtactagcttctttaataagacttcttaggcaattctacctgatcattttatctgaaaattgttgatgcaattgtttatttcctttatggataagcctattcatcaacattttatgtttgaaagatttgcttgctgattgaaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctacattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaagatttacttgttaccttagttctttgatttttctggagtacagcaaccccaacttttagaagtactcttaacaaatgatacagtgtttgatctgtttcatctttggacttcagagaatgatcttcaaataatacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttgtccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtggtagttgttttatttatggatttatcagttagctgttacttattttttgtggttcataatgcaattttaacataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactatttaatattatttcttgtccagcagatcctgaatcttaaattagaagttgtgacagtaagtggaaattttcagggaaggaagaacagaatatcaaaatcaaaaattaacatgctatgtgcagagtaggttctatatccctcctttttttcccaccctggtaaactcttatttaaacttcaagatctgtctctaatattaacttcttggagaagtttgaccattcttccagttcccacatattattagcttatctttcctctgattttttctcatagcattttttcattcatttactaaaatatgcactaaaatatgcacctcattcagtatttttatataataacattttaagataatttgcatacagtataattcgcccatttaaattaaatggcgattaaattaatttaatttaacacaattaaattatttttagtatattcacagtatattttactgtattcttaaatatagtatatgtgcaatcattatcacaatcaatttctttacaccaggaagaaatcctctaccaatgagcagtgacttttctttttccccaaaccctctaagtctaggtaaccatgaatttaatatctgtatctacagatttaacaattttggacatttggaataatactatatatagtcttttgttactggattcttagtataatattttcaatttccattcatgttgtagcatatgtgattgctgtattcctttttattgctgaataatattccattgtatgaatacatcacattatatttatattttcatcaattgatgaacatttgaggtttttctatcttttggctattataaataatgcttctatcaatatttgagtagacatatgttttcagttttcttgggtatacacctaaaagtgggattgctgagtcacatggtaatttaatgttcaacattttgaggaactgctgaaatgctttccaatggggctaccccattttccattcccaccagcagggtatgaggatctcattttctctgcaacctcccaccgcatttgattttattcatattatgtgtctatctctcaaatacaaatccatgttcttcaagagtggaaaccatgtctgtttcagttttgtttctgtatgcctaatatagtacattgcatgtatcaggcactcatgaataaatgaaagagtcaaccaacaagtgaaataacacctactgaattgacatggaaccacatagagttcctattatcaagagttgttgggttgatgggtgcagaaaaccaccatggcatgtgtatacctgtgttaagaaacctgcacattctgcacgtgtaccccagaacttaaattttttgaaaaaagcaattttattccaaaaaaaaaaaagagtcgtttatgtgggcttaaatagctgtgcttttataaatgttcttttttttaatttcagcttttattttagatacaggggatacgtgtgtgggattactacatgggtaattggacccaggtggtaagcatagtatccaataggtaatttttcagactgtgccctctcccttcctccccgtctggtagtctgtggtgtctgttattctcaagtttatgtccatgtgtgctcagtgtttagctcccactcataagtgagaatatgtggtatttggctttctgtccctgcatcaatttgcttaggattatggcctctagctccatctatgttgctgcaaaggacatgatttcatgattttttttgactgcacagtatttcatagtttatatgtaccacatttttttaaatctagtctaccatttccagctatgttcttcatctttctaccattcacatcctagtgcgtgtaaccgataaattagtattcatttagatggactccattttattttattttattttattttgagatggggtctcattctgtcgcccaggctggattgcagtggtgcagtcttggcttactataacctccgcctctgggttcaagtgattctcctgcctcagcctcctgagtagctgggattacaggcatgcaccaccacgcccagctactttttgtatgtttagtagagatggggtttcgcattgttagccaggctggtctcaaactcctgacctcaggtgatccacccactctggccacccgaagtgctgggattacaggctgggattacaccactattttttaatggcattttagcagttaaaaactgaatgctctaaaagtcagggatggcatgggcacaggtgaaagatgaaagttttgtctatttctatttctatgatgaaatcagttgggttaacaagagcattcttctaagcagctagagattctgttggtctcatccagccatcacccagatggcaatacaaccagtaaaaggcagataatggtatctgtttttgcagactttatgttcacaccagtgtcactcatcttaacctggactcttgtcatcagcttgatatttcctcactttcctctttctccccttttcaagttatagctgtgccttgacatgacttacccaatactctgtattctcttcgtgttcattaataggctcattttccagaactaacattggggcatttcaaggactttttacgtagcacatgagctgcttacaacgtaattctgtctagttgggacatatgtcatttagccagattgtttatggcattaccacagccaagcatatattagtttcatagtaatttctagggaaaaaaatgtggaggaaatatgtggtttttgttatacttgcaatgttactatattactgcttttttttaagttttgatttcaataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagccaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaagagagagctaacatcttcactttttaaggaaatagacattgcccccatgattagatacgtatggatgactagatcatttaaaacaaaaattacataagggcttaaagagtggctcttaagtgtaaatgctaggaagcacccaattagttattatttcctgtatgtgttgccttcatggacattggttcatatagcctcaaaaagtctatgaagatacttttttttttttttttttgaaagagagcgtcactctatctcccaggctagggtgcagtggcacaatctcagctcacttcaacctccgcctcccaggttcaggtgattctcccgcctcagcctccagagtaggtgggattacaagcatgcgccaccataatcagctaatttttgtatttttaatagagacagggtttcactatgttggccaggcaggtctcaaactcctaacctcaagtggcccacccgccttggccccccaaagtcctgggattacaggcatgagccaccgtgcccggctgaagatactataaacatcttgattttttactgagtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcgtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttgtgaactgcttgccaaaagtcaggactaacattgttttgtacatttgcattaaaagaaattatatcaccgttgaagagctgatcagagaaagggtataggaaaaaggaaatgttaaaataagctgtaaaatccagcccatttatatctggagtttagaggcagtctaacaaaatgaatgttccatttactaatcacatttgccatttattcaaaacaaacacggcttgagagaggattaaataaacatccaaaaactgtcgttcttgaaacctttggatagaacattgagttgcattcctgcaggagaaatgccaagtgagtgagcctagtccaagtttgtttagaaagccatatttgggagaaccatggaagtgcgaacctgatcatgtgaaaagcccaggactgttcagccttctgtggcagttctgtgagttctagtaccagactattaatagggagtcaagtagaaatatccttccttcccctccctccctccttcccttcccttccttccttttccctttcccttcccctttccctttccctttcccttcccttcccttctccttctccttccttccttccttccttccttccttccttccttccttccttccttccttctctctctttctctcttctttggtgtgctgagaataatctgcagacagtgactctacagataagattgcaaatattttcccttccttcattccttccttctttcctctcttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagagatgaaataaatatgttgcctttgcttttcaaagatgccatcttgcccattcataagaaaactaagacccacagaatgactacccaaggcctcacagtataattaggactttaacaaaaatccataaaacctctggtattgggatatttaagataatacattgatatatactttatcactgtctttgataaaataacagtaaaaccattttaatgggacacatttttataaccattgtgaatttggtcctcaaaaaagaactcactgagatgatgagataatgcatattcatcctcttttacagatgatgaaacatttcggagaaggcaagtcagttttccaatttttcatactatatagatcattgaatctttgtcccttatatacagaatcaacaatatgaaatatgtggaacttgaaatcatagtttccaacttttctgcctatagaatgcccatttccagttgcttaacatttagattgataaacatgaaattcattaaacaggaaactgaataagagacctggactaatatttaggtattacttagtattccatccaagaagtgtctgcagacagtgactccatagatgataaggttgcacatatttcagaagccaaataaatgttgtgattaaatgattcaagtctgttaaccatttggtagttatgatgtaaatggctgttaaatggaaagcatttgtaaaaatgtatgtgcaaaaagaaaggatttctaacaaaccgaatgggccttacctattttagttaatactctcaataatgagcagtgagattaatttataagtatgtgtgtgtgtgtgttaagatatattcacattttatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggatatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagacaaaacagactgtaaaccaacaatgattcaaaaggacaaaaaaagggcattacataatgataaagggttcaattcaacaagaagacttaacagttctaagtatgtatgcacccaataagggagcacccagatttataaaacaggttattagagaactacaatagtgggagacttgaacactccactgacatttctagagagatcactaaagcagaaaaccaacaaagatatttgggacccaacacttgaccaaatggacctatgagacatctacagaatatttcacccaacaacaacagaataaacattcttctcatctgcacatgacacatactctaagattgactacacacccattcataaagcaattctcaaagaattcaaaataactgacatcataccaaccacattctcagaccacagtgcaataaaaatataaatcaatactaagatctctcaaaaccatgcaattacatggaaattaaacaacttgttcctgaatgacttttgagtaaagaatgaaattaaggcagaaataaaaaaaatcctttgaaactaatgaaaacagatacaacataccagagaacacagctaaagcagtattaagaaaaatgtttgtagagacaaacacctacatctgtaagttagaaaaatctcaacaacctaacatcacacctagaggaactagaaaaacaagaccaaactaattccaaagttgatagaagaaaataaatagttaaaatcagagctgaactgaacaaaattctgatatgaaaaccatacaaaagatcactaaaaccaaaagctgtttttttttgcaagaataaataagattgtcagactactagctagattaataaagaacaaacaaagagaaccaaataaacacactctgaaatgacaaagggtacattaccaccaaccccacagcaatacaaaaaaccctcagcgactcttatgaacagcactgcagacatacattagaaaacctagaagaaatgaataaattcctggaaacataaaacctcacaagattgaagcaggaagacattaaaatcctgaatagaccaataatgagttccaaaattgaatcagttataaaaaacctaccaaccagtaaaagttctggatagaccagatggattcccagctgaattctaccagatgtaataagacttgctggtaccaatcgtactaaatagcttccaaaaatcgaggaggagggactcctccctcaatcattctataacgccagcatcattctgataccaaaacctgacagagatagaacaaccaaaagtgaaaacttcaggccaatatccttgatgaacatagacacaaaaatcttcaacaaaatactagcaaattgaatccagcagcacatcaaagagctaattcaacccaatcaaataggctttagccataggttgcaaaattggttcaccatacacaaatcaatgaatgtgattcatcacataaaagaactaaagacaaaaaaccacatggtcatctcaacagatgcaaaaaagggttttggtaaaattcaacatcgcttcatgttaaaaaccctcaacaacttgaaattgaaggaacatacttcaaaataataagaaccatctatgtcaaaccctcagcctgcatcatactgaacaggaaaagctggaagcactccccttgagaactggaacaagacaaggatgcccacttccaccactcctattcaacatagtactggaaattctagagctccaaatagaaagagagaaagtcaaactatttctgtttgcagatgatgtcatggtatacctagaaaaccccatagactctgcctaaaagctccttgatctgataaacaacttcagcaaagttctagacagaaaatcagtgcacaaaaatcagttgcctttctatataccaataatgtccaaactgagacccaaatcaggaacacaatcccattcacagtagccacagaaagaataagatacctaggaatacagctaaccagggaggtgaaagatctctataatgagaattataaaacacagctgaaataaatcagagatgaaacaaatatatggaaaatcatttcatgttcatagataggaaaaaaatcaatattgttaaaatttggggcagtcatactggccgaagcaatttatagattcagtgatattcctgtcaaactaccaatattatctttcacagaattagaaaaaaaaaatattgtaaaattcatatggaaccacaaagagcccaaataggcaaaacaatgctaagcagaaaggacaaagccagagtcatcacagtacctgacttcaaattaaactgcaagactgcagtaactaaaacttcatggtactgggacaaaaacagacacataaaccaatgaaagaagctagagaaacctagtaatcatgctgcacacctacaaccattgatattcaacatttgtcaactcaagatggattaaaagacttaaacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaactaccatttgacctagcaatcccattactgggtatatacctaaaggaatataaattgttctattaagttggtgcaaaagtaattgtggtttctgccattaaaagtaatggcagaaacctaatgaaaagacaaatgcacttgtatgttcattgcagcactattcaaaatagcaaagacctgggatcaacctaaatgcccatcaataatagactgggtaaagaaaatatggtatgtatgcaccatggaatactgtgcagccatgaaaagagcgagatcatgtcctttgcagggacatggatggagctggaggccattattcttagcaaactaacatgaacggaaaaccaaataccacatgttttcacttgtaagtgggagctaaacactgaatacacatggtcaccaagaggggaacaatagacactaggacatacttggtgtagaggctaggagaagggtgagggtcgaaaaactatctattgggtactgtgatcactacctgggtgatgaaatagtttgtacaccaaacccctgggacacacaacttactgatgtaacaaacctgcacatgtatcccctgaaacaaaaataaaagttgaaaaagaaagaaaataatgtttatacttagaaaaaaaattatctttcttctagcctgagtgataaacattttttattattatagtttttaaaagtttggaaaactgcctttaatctgcacaacttttattagtattgttgtttgaaatttaagataatcaaatttggggacactcctattaagtttcttttatttgtgagctattacaacacccttactcttactgcagattcatagctgatgagttctattttgtgcaattagcatcaaaaagaaaaatcaagtcagccgtgcatttataattgtgttcagtgcattactaagcacattcctaaagagaaagtatctccatttgcatcatcgaaaaccaagtagtactccacatgtatacttttacacatctgactattggttgaatttccagcagactcaatttctgtctctatgcattttactcctgtttgtctcctctactagtctaatttccatgctgggtgttataggacacattaatgacacgtgacttctggtcccacaaatctgtgtcacagagctaggacagtaatgggcccaggcacattgaagcattccaggaactcattcctatacaatgacgatgggtgatgacttaagcacacaccatagtgactgcagaccatgtaaatatatcccatgacactcagctaaatgtctccctgactcaacctttcttaaccaatctcaaaggtcacatgttgattctaacatttccctacatgagcgtacacagaagacagagtagaagaaccatagtgaacatacagcttggtcccctcccaagaccttagtaggggccagtgtacatgagggcccctgaagcttcatttccttcctcgtcaaagcatgtttatttaaaagtatttattttactctggatacttcctcagaaatagttattcctttccttttttccctccctctctccttacctctgtcttttcctcaaacatttatttagtgtatactatattctagacccatgttaagaataagatacatatgctgattctacagcactgcatagaaagtaatgggtaacctaagtggttacaaataaaatctactagctatcctggtgatttaaaggccaccttcagctgaatgttcaggaaaacctttatgaggaagtagcatttgatctaacctataggaccggtaggatagggcctgggtggggagactgggagatggaaaggcattccagtgtgctggtgctgcacatggtgggacttctatcacatgtattctctatctgtaacagttaaagttttttggttacttggcctgggtaatggcaaagcaaatgtactaaaagaaactctggttttgtggccacctcagttcctttggagaatgtcctctctcagctgaagctgagaacatccagtcacatttctgttctggaaccccttaagctgtttctgtgacaacatctgaaagaattaagctttatccaagtcaccagaaaagggcttacgttaactgttttcactaagactctacgtttcaatactaacacttacggacaagtggaaggtattcttcagttgtatttggtagttcttctgtagcgccccttttgtcttcctccatttctctcttgctagccctcaactctaccccacgttcgttttcattatcttttttctcatcccccatttcctgcttatttgtttattctggtggctcttctctctctcatagacgacatagaagcatggccttctttctgaactttccttgacccagagggagaaaagtctaacatactatcttatttatgcaatctgaggaaagttgttggccagccatcacccagtgtgacctagtgacagaaccagtagggatatctgagtgttcagtctttgaatgattcttccaagtcatatagatgtgttgattacttcaatcttgaacaagatatgttgtcactatcatactgggctatgagtacttgagaacagggaactgtgtagtaaaattcaccacatatgctggtagcacacaggcatcaaccagtctaaacagaacccacccgggtcacctcccacgtcactgctaagacacagttctttacacagaccatgtaaatgctgttgtgttgttttgtcaaagcttctatcactcttcttgctgtaatttgagaagcaaaagcattaataaccagttacttacataactggtattgtaaggcttactggtggcagacagcattcctgtgagcagtattagcacacctctcgatgagaatggctgtgaactacattctttggagtaacaataagaaagactatacaaaccctggtcctctgtctacagtgaatgaacacgctcatcttttcttcccacagtgatttttttccagataacatattctaatggcatgagtatattaaaataaagtcagatagggtgaggaggggcatgctaacaaaaataatctgtcactcttgccaaatggaggtaatacagtcacaatatttacaagtaaaatggcagggatgtaattgaaagtacatctatatatcatctatatatcattcatatcattcttcaagctgttatcacagttccatctttgactgatgcctcttcaatatgttgtataatgtactatagagttattcctttttactcttttgctcatggaaataatttgaaggcttttaaccttctgatctcatttttcactttgttccagacatggcttactctctctgccatggaactatcagataaaatgcataatttgattagaccaaaactgtactaccatcagtctgtcggtcaacacaagatatattttaaggggatctacacaaaagtctgcatgaaaatattccatataaagaatagttacataaaccttaataaaaagaaaatactgggaagcacttagtgtctcagattctggaatcaaagctctctttcttttcgtttcttttctcagcgattcaaatgaccactctgatattttctttgccaaattaactttagcattggaggggcgtttatatagtatctggcttaaagctattatttttctcatttgctctgcagacatttattgatcacttactgtgtgccaggccctgtgataggaatggaggtagagaagacacaatcccttgccctcaaaggtttcagtgacagaagaaatagatgaagagaatgaggcctgaagtcatttgctcatggtcctacaggcacagagcaggggtgcccaacccccgggccatggacctctaccagtccgtgacctgttggaaccaggctgcacagcaggtggtcagtggcgggcaagtgggcgaagcttcatctgtatttacagccactccccattactcacattactgcctgaacttcacctcctgtcagattgcagcggtattggattctcataggagcgtgaaccctattgtgaactgcacatgcgagggatatattttgcgtgctccttatgagaatctaatgcctgatgatctgtcactgtctcccatcatccccagatgggaccatctagttttgggaaaacaagctcagggctcccactgattccactgatggtgagttgtataattacttcattatatattacaatgtaatagtaatagaaatagcatgaacaataaatgtaaagtacttgaatcaacctgaaactatccccatgccccaatccatggaaaaattggagaccacagaactggtccctgatgccaaaaaggttggggaccactggcatcgaggatagaatagggaccagaaagagattgtgcagccgtccttctagatctggttcttgtcaaccactccatctccctaatgtgggacatggcagaagagttacaactagagtaaaataattcttgttgtgagttgcaaactttatgggctccatgtttaaattatattattaaaatatgtattttgtgtttgatattaatctcatagacatttaggagaacgattagatttctgatgcctctaggcattcagaagtctctaactcacatgctgcattgtctgaaaggttctattttgtgatagtgcttcttgggcatcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccattcctcgtgttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggcgcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggaggggcgcccaccattgcccagacttgcttaggtaaacaaagcagccaggaagctcgaactggggggagcccaccacagctcaaggaagcctgcctgcctctgtaggctccagctctgggggcccagggcacagacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgacccccgagcagcctaactgggaggcacccccctgcaggggcacgctgacacctcacacggcagggtattccaacagacctgcagctgagggtcctgtctgttagaaggaaaactaacaaacagaaaggacatccacaccaaaaacccatctgtacatcaccatcatcaaagaccaaaagaccaacattagacagatcaacgagacagaaagtcaacaaggatacccaggaattgaactcagctctgcaccaagtggacctaatagacatctgcagaactctccacccgaaatcaacagaatatacatttttttcagcaccacaccacacctattccaaaattgaccacatacttggaagtaaagttctcttcagcaaacgtaaaagaacagaaattataacaaactatctctcagaccacagtgcaatcaaactagaactcaggattaagaatctcactcaaaaccactcaactacatggaaactgaccaacctgctcctgaatgactactgggtatataacgaaatgaaggcagaaataaagatgttctttgaaaccaatgagaacaaaggcacaacataccagagtctctgggacgcattcaaaacagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagatacataaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccaatcccacagaaatacaaactaccatcagagaaacctacaaacacctctacgcaaataaactagaaaatctagaagaaatggataaattccttgatacgtacatgctcccaagactaaaccaggaagaagttgaatctctgaatagaccaataacaggatctgaaattgtggcaataatcaatagcttaccaaccaaaaagagtccaggaccagatggattcacagccgaattctaccaaaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaaacgaatccagcagcacatcaaaaaacttatccaccatgatcaagtgggcttcatccctgggatgcaaggctggttcaatatatgcaaatcaataaatgtaatccagcatataaacagagccaaagacaaaaaccacatgattatctcaatagatgcagaaaaggcctttgacaaaattcaacagcccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgcctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatggataagaagaatcaatattgtgaaaatggccatactgcccaaggtaatttatagattcaatgccatccccatcaagctaccaatgcctttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacggtaaccaaaacagcatggtactggtaccaaaacagtgatatagatcaatggaacagaacagagtcctcagaaataacgccgcatatctacaaccatctgatctttgacaaacctgagaaaaacaaagcatgggggaaaggattccctatttaataaatggtgctgggaaaactggctagccatatgtagaaagctgaaactggatcccttccttacgccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaggacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaaacacatgaaaaaatgctcatcattactggccatcagagaaatgcaaatcaaaactacaatgagataccatctcacaccagttggaatggcaatcattaaaaagtcaggaaactacaggtgctggagaggatgtggagaaataggaacacttttacactgttggtgggactgtaaactagttcaaccattgtggaagtcagtgtggcaatacctcagggatctagaactagaaataccatttgacccagccatcccattactgggtatatacccaaaggactacaaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaagctatcgcaagaacaaaaaaccaaacaccacatattctcacttataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacgtatgtaagtaacctgcacaatgtgcacatgtaccctaaaacttaaagtataataataataataataataataaaagtttgggacgaaaaaaaaaaaagaaacagatccctcatggtatcccataaaagttaccttaatttatgaaaatccaacctgtgcaatatgggtatcttttttacaatagaagtgatttatatgggctactcttcccatagcaagagtctcattgccttaccatatagctcttttggaattttttttttttaaacttgaatatatcagaatgatagtaactggccactggagaaaaagctctgacctcaagccaaagagcaatctgtctacatgtctataccatggcagtgattattgataacacaactgattattgtaatcacaacttcccatacagaaattactatttgtattattctccaaaaaataaggccaaatgccataatgtgttttttcagaaacagtagaacatactcttagaatgatgtgagtgcacactcactctcattctagtttattctaaacgagaatctgagatgaatgttccaaatctctccaatcacaagggaggagggtacatttgcagtggatttttctcagaaggttaaatctaaagaagtaattaaggctccacatttctgatttgcaggaaactgcgttatgcatttcccttggatgaaaataagtaaagaggataaaggaagactctcaaattgcagtctgtgtgacctgtttttgaataaacataatcatattccacagtcaattatctccaaagtacagtgtgttctccagccagagcgagagagtgagaggaagaatgtcagttagaagtggttagagaagaggacacatgcatagaagtgtacatctttctattgtcctctgaaaatttttatacgatttgggaggggttagtggggaggattatacagtatttttatgtgatttcataaatgtcaaatttcagtcatcagtaagagaggcaagcacaggtaggaaaacaaaatgagatatgttatgttcagcacagtaataaggctcctaataccaaaggaaaaacaagtcagtagttacaactattgaatagaagtggtctaatcggagcagcaggatgcgtatcccattttattatggcttcattatgtgttttgcaaggctctttggcttgccattaaaataattttgtgcagcagcactgtgaggactcagaatccaggagcgtaactattattttcttttcttctttgttttctttttgaggtaaagttggcagcaaaggaaggtttcggatggaccaagtatagacacaacacttctgttaattcacatggggactaggcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaagttaaaccctgaggtttatttcagaaaaccagtagtcaagtacccttcttctcactgagctaagaaatcctcataaattatttatttcccattttagacattggacagtgactcagtgtgccctggaaatattatcactgtattaattttctcatgtggctcagcataatgttagagaaatggatagttacaggtccagacactataaagatggagctaaatattcttctaaaaataggatgtttggttaacgtttagtagtcaacaactttcctgaagccacacacagtgccggactaagaaatggaataaatgtcctcatacagtatttggtgaagtctccctttaggagattaagcttttaatgttaaagattcagagtattttagctttatccctgagacttattatttgacgtgatgacatctttaactcaagaggtcaacaattgggataaaatgccatgctgtgggtgatggacgccataaaagtaacctgataatcggtcgggtgcggtggctcacacttgtaatcccagcattttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttacaagaagtgaagtataagtagttgtggattccttcaaatgaaacaaaatttttctggacgcctttttagatagagtatatgcaacccaggagtatagatgtgatgtctcctgtcctgtgcaggagtataaatgtgatgtctcctgtcctgtgctcaggcaggttaggattctggcagaccatgagacacccctgagccatcactttaaaatgccccgtatttcagtagcgtctatgtgctaggatttctgtttgggagtacaaaaagcaatgagattgtttttcttgagtaacctgaagtctactgggaagaacccagtggtaacccaaatagctatgacacaaggtagaaaatagtaccaaggtagatagagataaaacctttgatacttaaaggaagacagaaatactgctgactgggaattttagaggaattttcatgaacaaagatcagtaacatcatccactatccatgaaatattgaactataaggcagttttagtactgggaaagaaaaactacatcatacctaccagtaagaatctcatgatcatcatattttaataaaagatgaagaggtaagatcgcttattctgtgttccaaagaaattcctggaggagaagggatctgagctagactttcataaatagagatgatttggatagaagaacaatttagagcatcctggtttgaaagaacaaaaggatctaaggcagtagccctgggaatgtacttcacaagttcaggatcaatgagtatccagtttagctaaagaaaacaattctagtgaaagaagtaaacaaacgtttggtaggatgaaatggttccatcttatggagaagcttaaatattgatccaagaattttgaacaccctagtggacttcaggagaaccttgtgactctgagcaaagataaaaataaattgatatgggaaatgatgttcctttcagattagagaaactcctgaattaatctcaaatttggaggccgcttagtataacaaaaaagtatattttcaatattgctgatatgtaatctaagaatggttctctcttcctgtcactgaaattcatctattatttattccaagctttaaaaaaaaagtactaaaataaaattgtgtgattgagcattgcaaaagagtgggtttttataatgtggaagccaaaattttttatcagaaaagaaaagagaaaaaagaatctatgctgagaggagatggccaactactacatagatttattaactcaacaaaagggtgaccagttcttccaaacctggtatttgttggtcgtatctattacaaggtagctgtggcttggtgcagggtgcagacaagagagggaacaggaagaaagagattagtgtaaactgtgaaatcaggcaaagctagactcaaattttgtctctgttttctagtaactatgtgtgaccttgaattattgaagctctctaaacttccactttcttgtttgcaaaatggtacgatggcatctacatatagaattatagtaaagagtaaatgagaaatacatgtgaatacctagccgcttctggaaaatagtatgtactcagttactggttatttttattatcgttgtaattactatttccagtgatgtgatgcttattaccttccaaagcaagtacttttatatttgaataagtgaaagctctttcccattatttctaaacccttgtcctacttctcagttctagaactttttttttttttccttaatggaaggaaagaaataaggaagggttggagagagagagagaggaaaagcacctttgtttgtatgctttctttagatacgttgaagacaatactcacaaatctcttcagtcgtctctccatttggatggccatcctcagtgcttaagcacttcttcataaatatgattttcagaagcatctgaagcatctgtattcggggtcctgtcctcatccctgttaagaaatataaggctcaaaatcagatgttgttatgtgaggtgtggtctcgtgcatggagtacaaggtcacttttcattaggagacaaatgcgcagtaatacctacagtgtgggaacgtggatcccttctctttaatatcagttttgccagtgccctcctttgtaacccagagtagcttcagataaacctactgagcccttcttttcttgttcataggaaaatatttttaaagggatagtgcatttataagaaaatttttatatacttcttttaccctgagaggattgcaaagtttgtcatgccctgattgacaaatataagttcaaaaaaaaaaacagaaaataaattccttaaataatttatatcagacaaatggatctgaatctaagcaaaattttcaggaaaaaaaatgtttataatcattaggtaaaagtagaattctgaccttatctttatattttctttatattttaaagctttgcctacatattccaagacttggctttcagttttcctaaatctaaacagagaaataaatgaaatcatgtctaagatttcttccgattttgacattgttatatgtccttacctgtaaaatgaagaaaatattttttctttttatcagggttgttgttaggaagaaatgatattatggatattgtgtttcagcctgctagggacagatactttcatagcttcattcattcaccctagggtaaaagtatcagtgttttcttctttttccttcaggatttattccttagtcagggagtgaccaaggatggtcagccagaacctcagctggtcacctggagcataatatggtaaacagaaccatacccaaagttctgtttacggaggcagtcctggctaccagtgaatgatcaggaaccctataagctagcccctggaagaacaatgatgctgattttatctgtaaaataattctttgcatacaaagtactataaactcagttggttctccctgcatatttttgaatgattgtaggcagagtttttgttatctgttttactaatgatgcaactgaggcccgcaggagtcaggttgcctataaaggcaaggatgtgcatatagaattacccaaagcaaattggtattttgtggggcacaacctcaaaaccactgatatcttgctacatttaagtacaaaaagctcctatatgccacagaattagaacattaccagatcttaaatgttccttagaaatcacctcaactgatgccccacatttggcagaaagccaaaaagtttctcagctaggaacaaaacacaagttccctttctatcacatggtgctgaagcttagatgcataaaccgaacaaatcatcaggaagctataaaaggaacaaacaaatacagtctctggaatcattgcaacctcaatacacatctcattgccacttcctggacatttgtgtctagctaggttgcttcccctgcctgagccttactgtgaatatgtgccaagcagagtgttgctgttaattgagctagataacatgccagtgtctggcctagttcttggcccataataggtattcaactaatatttacttcttttcatccactcacccttcttcttaacagttggaacccctgttttgaactgttcacttctactctggatttccctgtgtaagctcacttgcagaagagggtggaggtgaacacactgcatttcccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttatacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgatccttctctgctctatcgtggctactttagcatatttttctcaaaaagtgttcctctttcataattaaaggtgagggaagactggatgaaaaaagctgtgggatatggtcagcacataaggcctgtggtcaaagatgggtcttcagttacatcgtttggtcttactaagcctcaatgttctcatttgtaaatctggaataatcattagacctttttcactctgcttgttgtgaggttcaaacatgagactcaatgaaaaagtactttttggacaatagaacactacataaataggaaaattttaatggaaccttcctcatattccattaatatgttggtgctctgcattatagtagtactttagttgacttgagcacatgatgtagttgactttagattaaactttcactaagtattacttagaaaaaacgagccatcatgtgattctacagtctttatgggctacatagggatggtgaattcttttcaccactagcaaaggctcctaaaggatcatgccttactcccactccatagatgaagaccttaggcccctgggaatccattgagctcacagaggtttacataatgccaaatcaggatgggaagttagatcctgcttagtgctcataactggcttatgaggtttccatttcagacaatgaatactcatcaaggaggattggtggggaaccatgagctgttcatgtgtactgctgcactcacgtcgtatccagacacccagatatcatctctggcccactgcagtaagatctctgtcttctgtcctgtttgtctctccttcattcattccttcatttgctctatctagccttcatacttcttgaatcactttgagtatggtacccttattttaaataaatagtaccctcatttgggtatttgtttccagtgttcctgaggctggggaatttctccagagtttaatgatgactctggtgctcaagcaccaagaaaatttccacttgagatggatctggcactggaggtttattttttcccctttctattttattgttggccagtttgggccagcatgttgctaggttgtattggtttcttagctcttgtaaccaagctaagatgcacatgtcaaaaaatattttttcttcctctctaaaaaggtttttcctcttttctgtaatgcttcaggaagggaaaagagtgtttgcttgattctaattctggcatatgaagtgtttgctacaaaatgtttttatcactgtgttatcttgtcaaagtgctatcgtcattgtcattttcagtttaatagcaggaatgttccattttcacaaaggatattccatattttaagtaaactcaacaaaggaaatttcaaatgcaaaaaaatattgatagtgagaagctaattagtttttttatttctcaaagccctacatttaaaatagctttaagtttccagtatgtcatgctctgacagtagcatttacaggtaaaggatgatgcttaactaggattatggttacattgtaaacactcaagccaaagaaaaatatatccttggacaaaggggttaggatgatttgccagagtggcctccagtgtttggatgacagctacatcactgtgatttaatgcacctttagtttcaggagttgtatccagactagtcctcatctcagcctcaccaaaggggactggacttaaccacaatagaactcagagctcctgcagtgaaacccagtccctttccatgcgggaagtgataaccgcaggtgaaactctgagctagggaaataccatcttggtagtcctgaagtgatagcacttacattcttttgccaggcatccaaaatcctttattcttcaaatagttgtgaaggttttttttattattatataaagccttgcagtgagtcatagaagaaatgcattggggtctgagacagagagagagagatgaaacaactataattcctgagtcaactatgattcctgtcttcaagagtctcatgattaagaaatggagacaaagcagaaataactaattccaacttcctaagctaaatgtcataatgaacaaggaaccaaggaagcacatagaaggcttaggtaaattcttcctgagggaattcctctgttataggtaataattattaagcttccaccttgtcttgtttctatgtctctattattatttaatatttacagctaaagctatctatctatctatccatctgtctgtctagagttcctacctaatggtatgtttcagattaggatagatttctcacttgaaacagtctgtctgatgttttgcatccatccatccattcattctacaaactgttatgccctctatatggcaagcattttgctatatccttactacagaattcacttaggcactaatacctattttaattatggagacaaaaacagctaagaaaatgttatcactccatagatgagttaaagaaaaaaaacagggagaatttcttgaaggtgatgtcaatattatcataaactcaggcagtccatgctgaaaatgatttttttgtgagccagaatcccctgtactcatcatttattccctgatttactgcgttttattctgtatcagatgatgtgctagcataaagcggggacataacatcttctgatatcatgagacattgtttctaaacctcttttcttggtgattagacctatgcttgtgcccatcagagtcaagggttgtggacacttgctccgctgcttgttttttctgctatcttctgtccttgttggttgcattctaatggacctataccaagtgctgtcagaagatgagagactacaaatcagattccacaaggatgttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataatccataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaattaaaaagaaaaaataaaacctgggctaagatgatagacaaattccctttcaacttcaaccagtttgttctgaggatattgtgtgcttcaggaatttctgccatatgctgggatattcagacatatataacgcagtctgccttccaggaacccttagtctgttagtggagatggacatagaaagcagcaaatactcctttgtgtaactcatgctgtatatgagataagataatgaggcagagaagagttggagagtagagatggcctggcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacaagagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaaggcttcatcaaagcagttaaatgactttttcagggtttcactgcttataagtggtaaaagttacctgaccctacctctgactctaaagccacaggactgtccccttaaatcaaactttctggcctaagtctacaggtattccccagaatttctaattgacatgaaatgcaagagaaaagagtctttgaattttcctgcactggagcaacctgccttattccagacattgccaagaaattgtttttgccactgacattattgcgcatgctgccagtggaagtaatagtgatctggacttcatatgctttcaccgaacatgcatatggctcttcttattagactgtcatagggctcccttactttcaactttccttggaggtttctctattttctgtcctcttttcctttccttgtttctgataccagcctatagaccctctgtcaccagttgggtttcttcatcacatggttttctccttctcaggtggagttttggccagagggaggagaatctgttcaattaaacagattctgtacaacagattctgtataatgcaaaacagaaccgattctgtaaaatgcaaaaaaaacccttttctcttgcatttcagatcaattctaaattctggggaatatctgtagacttaggccagaaagtttgacttgaggggacagccctgtggctttagagtcagaagtagggtcaggtaagttttaccatttataagcagtgaaaccttgaacaagtcatttaactgccttgatgaagcctttaagaaataataattaaacatcccctggtatttgagaaaagaggtatcccaagtcccaccgtttaccaggtcctattactcacaatgctggtaaccataggtctccatcccttatgctcactcctcttaccacgccctgtctaggagctacttctacatttatgtgctcagtcttctatccagaaccctacccccaaatgtctaagctcctcacacctcagttctctgtcttgggccatggaacctctaacactggtttggaagtgtgtgtctttttcctcaggcagctggagcagagactgattccactgccaattcttgcctcaagaagagttgtcttgagacaataggttgaagctttcactacatgttcttttagcaaaaaattataaagcatagaggttgagatgggctctggaatcagactacaaagattctgatcttaatgcttcagttataagctctggatgttgagcacctctcctaatctccccaagcatcatctactgaaagggggcatcacaggacttccctcattgagctgttgtaaggattaaatgagcacatgttaagtttctggctgtgtaagtttttgttattacttttcttttgtacttgaacttgtcataccatgtttctattttgggttcagaaaatatggttaacataattataggtgtaatagaaattttggattagcctgtgaacataacacacaattatagcactgttttttttaatgagagaatgaattcctgagttctaaacagatgagttacaaagaaactcttggactgaagtcatccatatataatagatggtccagtttggagtagaagactgactgtgaaagataattgaaagtctgcaaaaatattttttactaaatgcactgtctttttgagcttgcattcataggcacatctaacgcacctgccccaatgtaaccaatcaacatcacatacagccctcagttactaagtttatgaggtaaatttattttccttcttggtttttgtttctttgcattttgatctttttatgtctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatacttaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtagacagggagatagaacattctggaaattgaatctgtgttaaaatgccttaaaaatggtgcatcatacgaatttagcgacatttcacttcaagattcttacataccttagggtgaaaatcaacaaagaccttaaaatgcagacaattaactctttttctctgtgttgtgtgtgtgtgtgtgtgtatgcgtacacacatatactccacatatctccacaaatcaatgacaatatcaaatggagcaattttccacaattttctccaagaaactgcatgcttaagcactgcactcagcaaaatgttgtaagtccatcaatatttctcagtcttgctgagtttctgcatgacccccaatagcttacccagtctcttcctctataagtaatgatcgcagattctacatctgcaagtacaagaatcctttcacaaataaattccagaggactccaacctgcagtgtctttagtgagtcagaaattaggaagatagcttcaatttggttatacccagcaggaaggaaacaatcctaatcatactaataccaatggaatattgtagtccaggagtttgatggagtttgaccagcatcctttagaaaggaaaactgcataaattaaataatttatatggaacaaacatatgtgtaatatgcatgtaaaataaaatggcaccagttattaatcaggtgaatgcatatatatcatagagaagtcaactatgaccagaagatacaaaatgaactgttctttaggctcatgttttgttttgcaatacagggcaggatattctctcttcctttagccttaactgatctgcttccatgttctagtcacttgaacattgatatgcatgtaaaataggcccctgttcttccattaactagaaaataaaaaagtgcccagaagggaagtttccatttctagcagcacgtagaaaagtgccagagtttgatcaggaagtggtatcagggtcaagatgagggaaaggacatcagaaaaaaaagtagaattatcctgttcacttcaaggaagacacacagcataaggcgggttttagaaaaggattaagagaaaattggcagacagaattagggagattgcttaatcaatatcacaatataacgatgctgggtagaagatgcatggaagaagcatggattatctcaatgacgattttattttgaagatagtgtgattatcacccctggggatgctggaacattacactggggatttagtcaccaactgaagcagatctctgggttgaatagatcaccatgaaggttgtttccaaccttaagttttcttaaatttcagaagttcaatgagttcttctccaaggatcaaggaggatatctactagaaatctactatagaatagagagaattggtctatacacaagtttatttaaattaaataatcctgataccattttgaacttttcagtcaaaacctaccatatgcacctcttaccagtgacttcagtgcttccttatacaaggtgcaagcggttctaatctcacattaaaaaaacactttgggccagttgcggtggctcacaactgtaatcccagcactttgggaggccaaggtgggtggattacctgaggtcaggagtttgagaccagcctgaccaacacggtgaaaccccgtctctactaataatacaaaaaaaatagccaggcatggtggtgcatgcctgtaatcccagctactcaggaggctgagacaggagaattgcttgaacccaggaggtggaggttgcagtgagccgaggtcacgccattccactccagcctgggcaacaatagcgaaactcagtctccaaaaggaaaaaaaaaaaaaaaacactttgattttagaaagaaggtctgtgcccaggcgctcccaggtgctgccaggcctcagaggaagggttctgaagacaaacctgactgcctccttccacatgctatgtctgcaaatattggctgccttcaagctcacagcctgtgacagcaagttggtttcatttcttaaagttgatcttcaaagccgtgaagcaatcgcaaactgtttgagatcccaaatcaaagaacagattgtgtagactcaaaaaaagcaaacaaacaattacatttaaaaacaaagtgttggaaaaaaccagcaacaacctttctgctcacctgccaaggccttgtggctaagcttctgtttttgccaaattgtagcaaatcacatcagacagtgtccttcttgtactactgacaggtgacccatttcctggtggttaaatctggagggatttgggagttcttgctcttaacatgactttcccactgactggatttgtgattgtaagcacatcacactcatttcctccatttgaaatgcaggttctctgaagccttctggcttgaaggaataatagtgagtaatacctaacattggtattgcacagcatgccactgagggctgcccaatagctctgtgaaagagatgaggaaacaggattagagaagggaccagctcacagtcacaggactagtaaattatgaagtgagaattcaagctttccaatatcccttgttcttcctactacatgataccacttctagctaaccactcattcagtagctcttgaaaaggatattctgttacctcctttgaagataatatttgatccctactttctcacagggctttccaaatagagtccacattggcccatttccatggaacattttgctggtctttaggtattttattaattgctgaattgtttaggggttttaagttgtctaaggagactatatctgaattcaattatttttttcctctttcccctcgagcatgcacattctttgtaatactgtagtgatgtataagttttcaagagctgtcaaggtgtatatatatatatatatatatatttccaaaagcagatagtatagtacatttactacagttgtttcactttgatatggataaaaaatgtataaaaaaggcaaagaattctgtgagtgtcattacaactttaatttcaaaatttttgcccttatgttatttgctatacttggctttcctcgacattataaatcattgatcacaggctggtataaatttagcattaccagtggattctgcgtatttgatatgctctttttattttggttttgtcagtttgctactcgtgagtttatctttgaacagcttcccatggctatgggattaggtctgtactccagagcctgatatctatgggcctttttttcttagcctttctagtctttttaccccatatttcttcatgatatccatagtttgtccaacctaaacaaagagctagtccccaagcacactaacccgttacattcatccctctgcttttaatacaattgtttctctatagagaatacctttaaaaatatatataagttggctaagctcaaaaacaccacttctatgataatactcttacagattcttccatttgtaaatatgcatgctcatagtactcttacagcgttggtcctctcttataacattgttagagtagatactgtaaactgaaaagtgacacataaaaatacataatggtgcagctcaggtatgtgtcatcttaatattcctattaaccttagaactttgtgactgtgttgggattacttgacatatttgtttatcaatcaacacagtgacagtgacgacgaatgagtaaccagtgttttgtttttgaaacatttgaagaagtgttccatatttctgaagttattagtttagtttagtttagtttagtttagtttagtttagtttagtttagtttagtttagttttaacgacagagtcttgctctgttgcccaggctggagtgcaacagcgtgatctcagctcactgcaacctctgcctcccgggttcaagcaattctccctgcctcagcctcccaagtagctgggattacaggcacctgccaccacacccagctaattttttgtatttttagtagagatagagtttcggcatattggccaggctggtctcaaactcctgacctcaggtggtctgcctgccttggcctcctaactgaagttatttttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtatcagggataatttttcttcagcattagatggctgtttatgtatgatatatttctctgtgtccctgggacctaatgatcgttgaatacaggtgaatagaatgttatacagtagatggaacatgattatcaaagtcaggagacctagactcagttgctttctagcaaggcagtcattaattacatgttacgtcttttatcagaacctcagtttggatctataaaataggattactcatttccaccttggaactgtttttatgtaaccatcaagtaagccggtaaatatagttatctgtgtagttaactagctgctaacaaaggaatccagggtggcctttaatatatgttcggaatatatttattcaacaaatgtttcttcaattgttttccaagttagatttataaaaaatgagagcctggcaggcaagcaggcaagttggtagcttgggatgggatccactacagcacagaagtgcagccagagacttgctcctaactccccacggattgctacaaatccttgctccaactcgcagcttggcaagggatcttgctatcagccttctctcatggaacccattgtgcatatgaatatttgattagcttattccattttcattttatactattagttctccttgtggggttagatcctatgcacacacacacacacacacacacacacacaccatttaagaataggaaactattttgcaatctatatgccctctgcttgtaattgttactgttcccaatccatttcctcctcattctttgtctctcatccaaatggttttcactttatgtgtaacaggagtgagcttattctgaactacattggttaggtcctttaaagcgtaagcacgagagaataaaatgaatggaatggcacagagcacagctcacatatttgttttttagttttaaattctcatttgctttttagttttacacatatttattacccgtatttctcatagatttgctttttggttttacattctctccttacttttgccttggttctcctgatgtgtgaaaatgctcctaaggccaccaatcacaggattgtgactccttccccaactttgtttacctacaataattgcaacagcatgatattgttcaatgttggcatatgcaaacagaaaacctaagatctggggagccaattctttgcagaaggtgcttcaacctatctaaaagcaaaaacattcaataatgtgtacatgctttaaggtgtgtgtaatatttgtgtgttcattatgttattctcatagtcacaaaactcctttcaggtaaatatttgttcccattgtatgcatgtagaaatcaatgtttagaggggttgttaaatagctagttaaaatcagaaccaagaatcaaattcattatttctgtcttaaacttctctttcaactattttaggctgcagtagtaagcatcatatgacttcttgtcatctctagtgtgaaatggttttccaaagatctgtgtgtgtgtgtgtgtgtgtgtgtgttttaaataggcattttacttttaaaaggaaggttcacagtcaaactgagcagaaaatacaagcaagttcccatatacccccatccccacaaatcccacaaatgcatattctttcccactatcaacatctctgacgagagtggcacattagttacaatcgataaacctacattgtcacataattgtcacccaaagtccatagtttacattagcattgactacttggtgttgtacatgttgtgggctttgatgagtgtgtagcatttatttcccgtcatagaatcatgcggaatactttcactgcccctaagaattattcttgctctgcctattattactttctcccccaaccccggtaacccctgaaatttttactggcttcatagttttgccttatcagaaatgtcttatagttgggaccctacaatatgcagcctttccatattgccattttactgaataatatacattcaaggttcatccatgtcttttcatggcttggtaactcatttctttctaatgctggataatattttattatatagatgtccacagtttatttatccattcacctcctaaaggacatcttagttgtttccaagttttggcaattatgaataaagtcgctataaacatccacgtgctggtttctttgtagacatatattttcagctcatttgggtaaataccaaggaatgtgattgccggatcgtatggtaagagtatgtttagttctgtaaaaaactgccaaactgccttccaaagtatctgtaccattttgcggtcccacctgcaatgaatgcgtgttcctgttgctacaacattgtggccagaattttattgtcagtatcagtgttgtcagacttttggattttgcctgtggtagcaggcttatttgcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaaggttgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaacaaacatgatgaactgtgggggctgggattaaaatcattggaaggcatctctgtgtgaatgtgagcctgtgcagtaacctgcacgtgtgttgatgcctggtggtctttccatgtgagacatcttggatctgattaaagggccttgtggtgtctggcatttacagctttgtatttcccttaattgcatatacagactcaagaaagggatgggggagtgtcacataaaagataatccacagcaaagatctcaagctgttaggtaaatgaaatgtttccacaggagggtttatttttgccttcaaaatctcctggtacctgataaattaaagataaaactctttcaaacaagtttttacttttcttttctccacctcccatgctgtcatattgagtgtcacgtacatcgctacttaaaactccaacgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatgcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggactggggacacctgttacagaatttatactgttaaatgtcacttgatatgcacactaaacctattacaaaccacatattgtcacttgtcataattggacagagctgcagtgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaattcaaattttgctgttagacttatcattataatgaaattgaatgttggtaaatatttttgtaaagtatatgccccttttctgtgttgaatgggctacaggcattcaataccccgtaatacccaaaatatcattaatttccagaaaatataaaattgtcacaaaatctaaaaactggaatattaggaaaaaggaaagaatggtttccataaatcactttgtttaacatagtttctatgtgtttgtctgagtagttgttttattagaaaattgtaatttcctctctaaacagagcaaacatattccctcttcttcttcttttttttttttttttttgagatggagttttgctcttgttgcccaggctggagtgcagtggtacaatctcggctcactgcaacctccaccttccagttttaagcgattctcctgcctcagcctcccgaggagctgggattacaggcacctgtcaccacaccaggctaatttttgtattttttttagtagagttggggtttcaccatgctggccaggctggtctcaaactcctgacctcgtgatctgcctgcctcggcctcccaaagtgctgggattacaggcatgagccacctcgcccggccagctaacatactcttttgttcctaaatacagttttaaaagcacatgtcttgagactaacttgtcctttcctttgtaacatcagtcagttttgttaacaaagtaagtgaggaactataaagtttgcattttaggaaaattttgcatttagtatataattttatcttagcctgtgctttatctggcaggatctgatccatcctataattctacaattagtgttttagtcagaaatgcagtcatttacatttatccctttgacattttgccattcttattcatttatccagtcattcaatttcagaatactaactttgccagatactaatatcaaggactggccaattcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggaggctgaggcgggcagatcaccaggtcaggagatagagaccatcctggctaacacggtgaaacctcatctccactaaaaatacaaaaaattagccgggcgtggtggtgggcgcctgtagtcccagctacttgggaggctgaggcaggagaatggcgtgaaccccagaggtggagcttgcagtgagccgagatcacaccactgcactccagcctgggtgacagagcgatactctgtctcaaaaaaaaaaaacatctttggtagcagttttacatagattcccttttgacagctcccaccccagcaactctgtaccatagttattggtaagcacatcttccagatgtgggaactgtggcttagaaatgctatgaagccagttagtagaagagctgaaattagaacttggtattctcaacctcaccatctagtgtgctaatcttttttgtttttgtttttcttcctgggacagataccatttgtgacctgttgagtgagactgatttagtccactgtgttaacaggaaagttgttatagtttttttttttcttccgtattgtttttaatggcaatgtaaaacatgtgaatctgaaaagagaggttctgagaaatttgtgcagctcctttttccaaataaaagatagatttctcttgatgaagccttgatggttggaaattaagacaagaactgaaagcaaaacagcctactcaaggttagacagtgactcgagtcattccatgcacttaaacaatatttaggatgaccctatgtaaactcacattatcacttaaaagccagtataaaaatactacccatctgctgtgctagtcctgctgttgcttgccacatttctctgacaagctgttacctcagtatatagagagagtatacattttggaatccggagtttaagtttgaaaaaaaaaaatggtatctggtacatatggactagattctgttcttccaaatgtagatttgtaacctcatttattcttaaagatgatgtgttaagttagctttttttcttgactctgaagattgaagctcttataattttatgcctggacatgaacaatgtacaataggaaatcatttagtttacactcgccatatgatatgcaaagtgggtgttgggaggtgtttatatcaaacaccataactaagttctaaaccgctctctggaagctatgtaacttttcaggtattaaaggtttggaagatttgtaggtgcagtatgtataattgcttccatacaagtaattttttagtgccaaaaaactctaattccataatttccagtgccattataacagccgagatgtaatcttccttcttaataggtatttgagcagaagaggcaagattgaaagttagatcctcaggcttctctgatgcatcaatctgcggataaagcctttagctaggaattacaatctggagcagacgtgcaagatcactgagtcatttgctgtttttccgtgggacaattacttattctttttctgcagatttcctaggaaatactccaaagtaaaaaatatcaggagcagcagtatgtgatcttccttgctgcttattgttcatactctttatcgcttctcagctttttggctaagatcaagtgtattgtttatactgtctccacgattttcctggaaatcctttttggtgaatataaccttgtgcattacttgaaaatgggcattttaatcattttttcattccactaatatttattgaatgatcattatttgtaagatcttaggagacctgtcaaagacaagcacgggctcatcaaaatcttaaacttgtgtatagagtactaaagaaggagcatgtgaacatatgattttcagaaaattgagaagggaagtgagtggggagccctttgagactggacagaaacaagaggaccatgacactgaagaggacatttttaatttcatgttcaccctgagattggtaatcaagagtcttatttactcagagcaagccgcataaatcaaaaccacaatgagataacatctcacaccagttagatcattaaaaagtcagggccgggcatgatggctcacacctgtaatcccagcactttgggaggtcgaggcgggcggatcacgaagtcaggagatcgagaccatcctgactaacatggtgaaaccccgtctctactaaaaatacaaaaaattagctgggcgtggtggcgggcacctgtagtccgagctactcgggaggctgaagcaggagaatggtgtgaacctgggaggcggagcttgcagtgagccgagatcgcaccactgcactccagcctgggtgacagagcaagactccatctcaaaaaaataaaaaataaaagtcaggaaacaacaggtgatgcaggtgatggagatgatgtggagaaatagaaacaattttatactgttggtgggagttcaaccattgtggaagacagtgtggcaattcctcaaggatctagaactagaaataccatttggcccagccatcccattactgggtatacccaaaggattataaatcatgctactataaagacacatgcagacgtatgtttactgcagcactcttcacaatagcaaagacttggaaccaacccaaatgtccatcaatgatagactggattaagaaaatgtggcaaatatacaccgtggaatactaagcagccataaaaaaggatgagttcatgtcctttgtagcgacatggatgaagctggaaaccatcattctgagcaaactatcactaggacagaaaaccaaacaccacatgttctcactcataggtgggaattgaacaatgagaacacttggacacagggtgaggaacttcacacaccagggcctgttgggggttggggagaggagggagggatagcattaggagaaatacctaatgtagctgacgagttaatgggtgcagcacaccaacatggcacatgtatacatatgtaacaaacctgcatgttgtgcatatgtatcctagaacgtaaagtataataataaaaaaataaattaattagttaattaaaatttaaaaagtcacactattaaagttagaagacatgccctgaatcttccagtcaaaattccttgtttacagatgggagaaagagtgaggaagggttttgccaatggtcacatagatgtcaaatatcatttactgagaaaatcagcataagaacccaggtctctctctttttttttttttgtttttttatcactcaagccaatagtttttccacccttttagttctgttatttgtcttctccactgttattcaaggctatctcaggccagaagcagaggtttgaactcttttcagatgagagcatttttgagactgggacctcatgttgaactaaactcacctccacgttggcacgcacgttacttcctcttccactgtataattttgccgttggattaaactcatgtggttggtgctaaggctttgaccacaggcacatttgaagattatacttatttctggatacaacctcctttgcctccaaactgaaaggttggaaggatgacgggaacaaactcaagtcaagggattccaaatggtcacatcttatgaccacaggctttatatttggagcgctaccatgattaatgtgtcctcgttgccatcctaagacttccatcattttcttccattgtctttctgacttcagctccgttgctacttctgggcagttataggtttctaacccaatagggcaatttcagtttcccccgcgttttctacataagttgtcctttctccacatatttgtttatgcagtttaagtcttgccagattgttctctctacgttctaaaatctttccaattttgaaagtcttagatcaagtactacgcagctgaaaatggctctgcctcttttatggcatttaatatctaccttggattatagttattataacgaccatagatactaaaactttgaaaagaataacaatttgaattcctttgtcctatccccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacatcttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagttgcatttgaatataatattgactaattagtcagccagaaatgagagctctaaacatgctctttttgtgtcatttactgcatttgtggagcatctaattataaagaaaataagtattcttcattggttgctagtaaagctgccactgaagggcaaaaagacatatagcaatcattgtttaaatagaagcgcttgaaaattttccattaattttcgtgtttgcattttgaatgctttcttgctcacacttgaggtatcaaactgaacaagtctgaactgactgcgtaagaatttaaggaagaactgggaggggtagaaatgaggaagctatttgcattcctggaagacaaaactcacgtttataatctttcttgatactaaggcagtttgtttcccaaatgctatttatggtgagctttttgtcttcaaatgtttgttataagactcttttttttttttaatcatccagtgcagaagttcatgaaagaaagtgaaagtgcacccatacccccattcattttccagagcttaccctgtttggtacattatcttgttggctcatgttttgcttggttttgtttatgcaactttttcttattaatttgttgttgtcgttggatggagttagggagggttaaaggactggagtaaaaatgctatttatctttaccccttcttcacttacagtgtgtgtacgttgatggagggggtggtggggatagagggtgattttacctgctccatttttgtttctatttgctgctaccagcttgcttcttaaccctgggcagaggctgccctgcaggcaggagcagaataagctgtctgtgcccttcctcttcctatacctttgaagattggtgcctttcactgttttccaatcgcttgttctttccataagctcgttcccttctctccactgctttgacaacaccttttagagttgctcctggagctgctgccaagacaatagtatgttttctcttttaaaggtctaaaccctgggaggagaggaactggaggaattgagtcaatataatatacgaatcactttatattttactatctataatttagtttttgacttccatttctaaggaaaaaattgttttcttttattgttttttttttttctgtttccattcagcactcgtgtactgagaatccccaagctatattaagtcccatttgggccattaatgtgtgtgcaacatggtctgtctgttccagtagagaaaaaggcatataaataactttcttatcactggttatatgctttgaaggagtacaaattaaacaacctgtggaagttcaagtaaaagaaagcttatttccagtcacgagaagttaaatgtgagctgggcagattcataatagagaagtaccgtttttttgtttgtttgtttgtttttaactctgagggccctgtgagcttggtcaatttacatcatctcatgaatgacatagggccctatatgtggaaacaaataaacaacaacaacaacaaaccactgtagagtcatatcaaagaaaaatgaaggtggtattcatccacatcaatattaagataaattattaaatatttataaaactctttgacagtgtacagcctctataattaatcaatgtagcactttctcaatacttccccattttaattagtaccaacatcaatcataattaggctcatgctttggtctctctgagacttttaaaacatcatgggtagggggcatttttcaggattcaggtatcagctaagagttcatttagccagtagatcgtgaccattcttcctctccctgaagctatgattctggatactgtggctcttcctgctcctccagacatagagaaaatggacaagtttctccttccccattttgagtgcatgaagtgaaaacttagcttgtccagccaaactggaggaaggagaggcgggacttattggagtaactgaaaagagaaaaattggaatatgagcagtaccaatactcagtctcttaaggaagggtagagtccctttctttctctctctgtaatttttttcttttttgttttttttttttcaaagaagattgcataagattctgtctctctaggagatgactgatgaaatataccccctgggtcatttgcatcttactcctttgtagtgtagggaagaacattccaaacccattataagcacttactgttgttgggcatgtcataacaaacacaatacctttctggaatatactgctgagcccttggctttttgctgaatttgcctaaaagcccttctgcctattgagtggccacattctgaactagttatacttggttaagttttcacacagtacactctgggatactagggttgcaacaatttaaaaaagaacatagatggaagctttatatctcaaaagctcctacctttgacttccctgacaatttttccttctcctgctcttcaactctatgtttcccaactttgtttttgtaaacacgaaaagtaaattttttaccattttgtgcctaattcctcttctttctctcttctctttttactcatcacaggaatgtcttagctttccttccttctccaatctgccttgggtatagagtcacgcctttaaatcttttagcataccacaatgtaacttacataaggaaatgtttaatttgggaacctcagttggttttgttaacactgctgcaccgaagctctagctgaattcacataatctcatgattttagtaaaggtaacaaaggaaaactattatgtaagtacctacttttcaacaaacattgggctgggtttcttctttacattttctcatttaatcttcataataaccctgctagataaggtttaccatctcattttgcaatgtggaatctggagcccagagatattaaataccttgtacgagagtaggtgtgcaaagctaaactttgaacctaggcatctctgacttcaaagtctatgctttttccacctcatagaaagaccatccagaagatcaagtgttggaaccttccgaggctgtgacatatttattacttcaaagtttattatcacaggacatgcatgctgctttagcaactagaagtgtgtgaatgaatattactattgtgttgcataagtccttggcaatattactttttaggtgccattctaatcctgccctgtttggaataattgtgattacgagggcataggagtaattcagaaattttttgaagaaatttctccacacagcattagccttagttatgagtataatacaaaagaagaggaccagcactgctggaaggtaaatgaaaagatggaggaattgaacgattacataacagctgttcagacttgtggtactgattagagtcatttgtagagatgaagcagtgtgtctagccagtgtggggtagggtatactgggaaggtctcacagacagagtgaagtgggttacggcaagccctgaggtatggcaaaatctggacagctagcctggatcttcatttttcattagttggcttccttaactgctcaacaagtagaccaaacaaacaaaccacgcatacacacaaagcaaagaagtaaataaagaatggtggggctaagactgtgaatagctcctagcaaattagagaaatagcttcaagtatatgccttctggatgatgtatgtttgtatatgaaggacaacacatcaaggggtgttggtagtaatctgtgctaagcttagaagccagtatatcattgttctagttctatttctactgtcgagtggctttatagccttagacaagtcatgtaaccgttcaggccccaaatgtccttctggaattacagggattgaactggatgaataaaaagttctatttcaactccaacatttaataattctaaagttcttagtgagctctgattgctcatttgcattacataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaattgcctcccaatgagtgtgggagggacctatgatttctagccaatagaaacagcaaaggtcacatgtagtctttgatgacttgtgtgtgattgtgttatataagactgtaacatttgttctatgaggggactttcacccttgtaggctttaaagaaacaggctgccatgttgtcagctgccacctggagaggtccatgtggtaaagagtgagggcacctagtagctgacaagaaactgaagccatcagtttagcagcctgcaaggaaccgactgttgacgacaatcatgcaaacttgaaagcagatccttccccagtcaatcctcagttgagactgccaccccagcctaactttgcttgtagacaatgagaccctgaggcagaggacccatctaaaccatacctgcacttgtgacccacagaaactgtgggataataaatgtatgttgttttactctgccaagtctttattgttttatagatagctaatacaattatgttacttttagaatctaacattttcttcacctttcgttttctacataatagttactaagtgaatgtgacttgttatccccatcctcaaaatcattaagggtcttttatttaatatttgatttatctgtggctttgtgaaattcataaatctgctcctcagtttctggtatctcttcaggagagatgccctcttactctactgtatatggaagttgaataagattgaaactgatagagaaatacttgttgaatcaagttgaattacatgaaatgggcttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccacctaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgttccaatgccagcaaagcccctctttgaagactcagtttccgtcatgctgctctcttacaacacgctttcctcaattctgaatgaatgagcagatgaggatgctgaaatgttagcataacaaaccaaagtcttcttctgttgcgggacattacatttaatgtagctttatacagctcagatttatttctataggttaagcattttgttaaactattcctaaaacacttctgaatgggtcaccagaaagaatatggagcaatcaattctactgtaacctagccaggcaaatattgactatttcctgataccagcatatgttgtatatttctgccttactctagtgagcagaaaatctgtgaaggtttttaggaattgcctaaagacacgcagttctcaaatggcaggaaggagagtaaatcctagtctttctgattccaaactttatattttttccattaaatgaatacagcatacttacatacatacataagtaatacatacattcatacatgtattcagctgtgaacattttttgggcaccctcaatggcccattcgctgtgttggatgtgatgagggatatgtagatgaataagacctagatcttgcccttatagggaaaaataagatttaaataggttaaatcctagtcttgtgggaagatagaaaagatgcacaaaacgaaagccagactcaaatgagtaaagttagattataagtctgcagatgtaggtaggtaacctgagctttccaagaactgtctcctcacttgaagaatggcagttaataatctctgctttatagactggttgagtggattgaatgagaacacatgggaagatgctggcatttaataggcaacccataatagaaatgttaacatgtgctctggggtatcttcagaggtattgggagaggagtccctgcctaaggaagaagcagtgctgggcagaggaaggaatgtggacttggattggaactcagtggatctggtctccagtcacccaacaagccatgtgactgtggaccaactactaactgcataggcaccttggattccacaattgtaaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgcgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaaactcagtaattttttcctcctatccccccaggctgtcagcggccatctctgctgtcactgtgctgcctttcacagtctttcccactaccttctaaagttcattggttttaatctcctctggtatgaggaagaaacagcaaaattgtcattagaatcattggtgaataggagtcaacaaacattcactagtggcccaaaggagcactcatcagaggaaaaaatgttgttttattttgaaaaattgctattttataaacccagagctgctactcccccttcttttcttctccgttctctttcttcatctttttctttcctttccaaccttcatgaaaactggaaatatggactatgacttcatatgctcttacttaccctctgctgggattttgttctgaaattgtaacaattagaggagtgtttctaaattggatcgcttcagattgtctcagttctctgtgactttaagaacaagctgatttgaagccacatactgttggcagctttcatccatttatttggactatcaagcaagaatgctcacaatctttcatatgaaagaagacatctttatttccagttcacactcttcataataagaagggtatttgaaataaagccaaaaagcataacttacttctctaacttcatatttcagatgcctgcaatagtgggagaacatttttttactaccccaccttaccctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagcgctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctacttttgtatttttagtagggatggggtttcaccatgttggccaggatggtctcgatctcttgacctcgtgatccacccaccttggcctcccagagtgttgggattacaggcgtgagccaccgcacccggccgcatttcccttttgtacactaggagctaccgagtaccagaagtctttgttaggatgcacagttctttgctcactctgcctgggacagtggctcaacatctccagtcccctttgagttacctccagaaggttcaggaagagcctttccctccaaaatgttcatagcatttgatctaccttctctaagataagcagcttttgtcacattgtacctagggtaaagatttgtaatgccttaactctatgccatctgtatgcttcctgcggacaggatatgcttctaatttatcagattcccttaagaaactacaccatgatgcacttctcaaagtatgctcttaactaatacttatgggaggaaaaaaggaaggagaaggaaaaggagggaggaaggaaatcgtgtaattgcagaaagtttatgtctgggacccttgtgtaataatgttaaataatactttgacttttacgccatttttctatatacaaaattctttcacatctattttcaccactatcctgatattgtttgcatgatgtgtagtatgtatgtttttaatgtgtgtgcatattgtttgtctctcacacatacagcagccccaacactgacaaatccaaattctatgagtacagggagtttgttgtgttcactgctgtatccccagcaccttgaacagcacctttcaaggaggaagaacctaattcatgtttgttagaagaatgaatgacaatattgtcttatttgatcttcaccataatcccgtgaagtgaataccgtattcatactgtatcctcgtttttttgcagatggcaaaactgaggccttgagacctgctcaggtttgcatagctagtttttggccatggcaagatttgaattcaggtttttctatttccttattctctcctttttgtcttctgggaatttgctatattaatagcaaagcaagaaatgtcacacaaagaaaaattgtttccaattttaaattcatgatgcatatgcaagaaattactgacttttcaatccaatggtaacacagattgtgtgatttttaggaggaagagcctttcttttccatctcttgcgtttattagcatatgtgtcagtgcacacacatctacaccgtgcagctctcaccttgtacttttccagtctgaattcgttttgtaggctgtccctgccctgactatcccaggtgcctatcagggctgtgtcttggtcaggctaaggccaagcaacaggcaccagcatttgttatggttaccttggcaagtgaatggggtttgagggaagctggagagcaggcatttcaggagtagaactaggccagtctgtttttgtaaaaagttgatattcaccctaattgtagctcatgttggcaagcggagtaaacacccatgcaaattactaagttgtactgaatgtccaaggatgtcaataatcatcttgaaatccaaataaatatattttttactgaaacggaagccaggcaccacatgcagtttctctctgtcactggagacagatttggcacatatgcatgagacagagaagggcaactcttcaggccctaatgcacacaggaaactagggatgtgtatatcatacttggcagcaaaatagaggtggggcagccatcactttctgttctcaagcacctctcttttttcctatattttaaaacaggatgaccacaaagaagaataaggtatacagtagcataggatcctaaattaaagcatgagggaaagctagcattagtttttcatctaaagtccatttgggtaggaatgagtcagtgcaaaactgtacaaaggtgatcttaagtcacatgttatgttaccgactctgtggcaatggctgtgagtagtccaggaactctccaaggcctatttttaaattcacttagaccaagcataatgaggtaaagggatgtctatacacattctcaagtttagttctctgaccgtgagtcagactgtgggccatggacctgggcgtctcagtggtagcaggactcattttttccccttttctttctcataaatgacttaggagacacattggagaaccctatgtgctccttttactggaattatcttttaaggaagtactgatttcacctcctgtacatggtttgctgagatggcctattggggtttcccaccagtccacaactggaagtttctatttgcacattttgactgctagttctatatttagtcaaaagcctgccttttgcctggtttcttagggaaatagtctgtaggagttgctgtgtccatttgccttgttcacttgggtatttatttgactgtataccctgattatttcctaaattaacaaaaaggcacagggccccaaatgaaggaagaccccttgtaatttgttaaaaaataagtttatgaaaatgtgtcgtcaggaaatcagagttgtgttgcggggtggggagcatgatatacatttgtgtttgtatgtttctaattgtctacagatttatggcctactgtaacaaagccattgtaagtgtacagtgggagggtcaagaaaccttattctatggattcaaacacattatgcatacaatttacacgtaggcacaaaagtatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacgcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacacctttttacattatgaaacacctatgttcaccttatccatggagttatgccagtgacctaatgcctattaagttcttccatgttccaaaggtctttctgtacttgaaaactcataggtgagtcaggtccttcactgatagcttatagctaaaaaccacttgggagaggggctgtccaggtcttatgtcaaaactttgtcccatacgctgttagtgttagaaatggagccgtcagcaaatagaatctgttgtttcatttaattacttttcaatatgccattaccagaaatttttatgtaaatacatattttattccctgaggcttgtcaatctgagaccaaaattatacaacactgaaaaaaaaaaaaacaaaattttctttttactagttctctccctgtgttactgtgtcatctctcatgcatggtataggatgatgatggtgctcaaacttagccaaagactcttttgttggtattcaattggcagaattaatgaaacaaatattttaagatccctgaatatgtgctaaaagcatataactacactactggctagtcagtaattggtgcctcagaagagttaggtatttattcatttaccaaatacttatatgtcaagcactgttccatgtgttttcttaacccatgtcattgttaaaacaaccctttgaaatgtgggtactgtgattatttccattttgcattgaggaagctgaggcacagagaaagtaaggaacctgcccaaggtcatactatcaattgtagtggtgcaagacagtgggctctgaagtatgttctctctatgacgacactgtgctctgagggagtgagagaaggaggacattgtttggggcccagtgaattaatgaacaagatatctgactaggatctgaagactagcagaattgaccctacagagaatgtttgaccctacagagaatggctggctgttggtgttcacagccgtgagcatagtgtggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagcccagagctctgtacaaaatatattactcaataaatgtagccattgatattattaataatattattaaatattgagaatgaattctaccaaagtgcatggcacttccagtggctgattctgttttatgtagccacaggcctttaccaaaggcaatggcaataaagagagggcacagcaagatctatactcctttaaactaaggtaacccacttcagttagtccccacagcttctcttgcaactcttaccctattagctgtttctggggagaaatttaatgggcatagatactgggtggatagaccataccccagtgatactccagagagtgaaaaagagaagttaacacagggcgtgacttcctatgtttaacttgcagttcttatcttacgttgcccatcagaattatctgtggcatattctaaccatattcttcctaggcctcacccctagagatactgaattaattgttcttgtgggtagagtcactgttatgctttaagcttcccaagtgattctgatgggcagccaagactaagaatctatgatttagatagaagatgggaagccgagggaggccatgggaaagctctgatggtgagtatgggaagaatcaacataaaacaagcactcaacaagtgtgcatctagttgaagccttgcttctcctgcatttgttatctcagtgtgctatttaaaagcagcacaaaaaacaaggagtgaagaccttgatatcaaggatgtgaaagctacttctaatcttcaaacagatattaggcaggggctttaagacttcaacttgagagaaaagctaaggcacctggtatgtgtgtgctcaagtgaaatatttgtgctgactgagggcttcaatgtcaggctgtctgaaaggacacaatatcaacagctttgctgtgcttgtgtatgagtctttaaatgaatatatctggttatagcttatctcttttctccatgctccctcatttccaatttccaggtaatggagatcatctagttcggtttcagctgctttattttgcagatgagcaaacccagtgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcgcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggggtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttgggagaagaaaaacaataatctatatgatgggcttttggcctaaacccatatcctttagatgacggaatttggcacagctcatattctggtttaaagaaaaatgttttgttatgatgtcatttgcctaattaatagcaaaagaggattgaattttccctatgcaatgtcatctagcctttgagattttagagttaatgactcaaatcaattgtcctgtcttctgtgaaaccttcctgatgccttcagttggataaatctacccttggtgttcataaggcattatattgatgcctctgatgttatgcagatatatcccttcttggctttgtttgcccattcaatgaacatttgttgaacaccacctatatgccaagatagttggaagatggaagtgtggtacacagaggatgtggaagggaatcacagaagatgagactatgaaggcaggcccttcaaggactttctaagtagtactcaggagtttgacaaagaggagctagaagaggtttgtgaagtcagatgagtaatataattaggtttgtattttatgaagggcaacatctaaatatggcttgtctattcagcaagcacttattaagtgccttttgcatggtagacaacatgcttgatgctgaagatacaagaaaaaatttaaaatggtccttgccctcaaggagctcacagtctattgagttacctttctgactttcccactagattgtgagctcctggagggcaggcactttcgttcatctgaaaaagagcttaaatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagctatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaaccactattctactctctacttccatgagatcaacttttttagattccacacttgagtgagatcatgcaatatttatctttctgtgcctggcttatttcactcaacataatgtcctccaggtttgtttgacatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtgatagtgcctcatatccactgaaacgtaagtacttaaggagtggatgggaagtattcctggaaactcacagctaagcttttatgtaaagacagcacataaaaaaaaaaccacttttcataactttatggaacctgcaaaaaaatcttggcttccttcatgatgcttgcccctagagtgtcagcatagcccttgcagagaaaccccaggatacctgtatttctccaccctggccttcctctgagcattgagttgttagcatcaaaaaatcaccacagccacgttgatcctcattttcttcagcctctatagagcctgctatgccagggtcctgggtaatctgcagacagctgctgtcatgcagcctcatatatgggttgactttaccagcaaagaattccctcaccttcgagacatcactgacatcttcatgcacagcacagacaatgaaacaaacaaaaaagaacaaagagggacataaaggttggaggtcatttacatttgcatttacttgaaaggaaacatgctaacttgttgacttgactcacttgatgtactttttcgagatttcacctggaatcttgttcttgctagatctctggatatgcaaatcccatctttgtccaagacctaattcaaatgccaccttttcttgagaatgtcccttcatctcctgagctacaaccatctcccctttctctgtgctctgatagcacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacactctttgtttgtcgaggaaaaggaaacttgcaaagggatggcaccagcgcagcccgacagaattctctgtgggccacatctgttcatgccagctgttgtcagtgtgtgtcgcctcgccgagaataacagcaatgattttcactttatagcaacttccatcttgggatctcagaatgctgcataaatgtagattagggctcccaaaatttttgccaagaatgagcatactttacagagcatcaagaatgcgtcactcttctgagtgaatctttattggtgcaaagagaattaaacgaatattgaattagaccttccttcctgatgtgagctttcttcttgattttactccttattttctagatgaccttgaataactcagtttccctccttgacactcagttttcttcttataaatgaagggattcatgtactactaaatggtctccagtgtcttttctgtttctgaaattcacagaaggcagggaatctaaagttgcctcccacattttagaaaggcctaagttgttgtagaattgaatattttcttagcattttattcatgatatggtaagaacccggcagaaaatttttcagtttggtcactggaaaatgacactgtcctttagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatgactggattcaaatcccaggttctccacttattatcacggtaatctttgtactccagctttctcatttgtaaattcagaatagaagccacctaatatggttgcactggtgatgaaataagttactcaatataaaacattttgaacacctactaagcactcagaataccttatttatactcttgtaaattatacataaattaatacataaattaaatactaatgtatttctacctttcagagtttgtgggaatggataaaagattccttcaatatgactactattattttaatcatggtcagtgattgattagaaatattaaatgttgctggtctttagattcactgtcagagcatgatctttcttcccctcggctgcagtgctgacgaataacactgagtcattcatattctctcatccaccttcctgccacatttgaaagacatccatagctcatatttgacagactgtgtgtgagcatttaatacaaataatcgtgcgccactgtcaaatattagcacatgccatgtgtcttcttatgtattactcacagtggctctcagatgaaggcatctacccagctcctctgcctactttcccaactccatttacaggtgaagacgctaaaggggggaacaaaaaacttgtgaaatgttatacaaaactggaggtataatttggcatttgaaccagcttgttctgcctctgaagcccacgctttctccattataccacaatcaatatttctgaaagtaaaaaaggccacattggtctccagcttctggtctaattagcaccatactttaatcagtgagtttgactgtcttgattaacctttacgatagaccatgtaagtttcatatttctaaatgaatatatagagatggctgtaaattagtggaaaaacactaagctggaatcaaaagactcctgcctaactcttggttctgccacttaatatgggtatgattttggctaatcacttaacaaaccactaacttggtttctacagaaagaagaaatgatttcatgcattggacaatattaaataatctagtgtgtgtgtgttgcacccaagtatcttttgactgtaaaagcacatagaaaggtgaaggaattttaatcccatggttgatagagtagaatgccacctcagttcctctgaattctgtccctcattcaagtcctaattcaagctctttaagcacacagtactctctctctctctctctctgtctctcttaatctgtatcatccattgatacacttgaataatatttatacatcatagtatatctttaaggatgatattagtttcttaattggtgtaggctggaccatctcatttaacttatggctcatgcctgtaatcccagcactttgggatgccgaggcgggcagatcacttgaggtcaggagttagagaccagcctgggcaacacggtgaaaccctgtctctactcaaaatacaaaaattagacagagaaattgcttgaacctgggaggcataggatgcaatgagctgagattatgccactgctctccagcctgggcaacagagagagaatccgtctaaaacaacaacaacaactcacaaagtaaattctatttaccccattttatttttgaaataactaataggtagtaaaattcagcatcctgcactggatcatacaattggtaagctgtggatgtgggatttgaacccaagtaagcagaccctagaacctatatatctaaggcatactgattactatcaacgttcaattttttgctttgttcttttatttctccttcatataccttgatttcctgactggattataaattctatgaactggttgcatctcactcattttgatgactgctttaatgcctaattaattactattatttgtggataatttaatatagatttcataggaggctatagtttgctacactgctcgtgtactctagaaacaaggacccttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttaggtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctcctaggttcatacctgaaaatactaaagaaaagtctggaaccccatgttttataaagtatgtttcctgttattttctaagagctatccatttttataatattctgtttagataattttaaaattataaagagaaaaactcaaattactcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccatctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccatccaatggaaataatgtcttggaattctcttgcctttattatgtcaaatctctaatatataacatccataaagcctaattaatgggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcctaagggaggctgctctgctctaaatagccaagcatgagctttactttactatttgtcttttggtcctaaaggcgagactgtacaagaattaatagttggagaggcagcaaggcatacgttcaccaaatgtcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaagaaaatcatctttgttagtggtttctaagttgtccctcttgataattataactgacatctatttgatatttaatatgttacaaagcttcttcatatgaatcagatattattattctccagtttatatatgagaaaatcaacaatagaaaaagaaatcactggagaacttaagtagtatcttagacatcaggcctaagagccagatgctccaagcccaggcactattatagctgccttgacacgtggagacggagagaggtgggtgtggagagacctcactttcccccagctcagcctagataaaacccttgtgtgcagagaccagggccccctgactggatgcccaggccttttcccagctgcagtaactcttccaacaactcctcctgtctgtaattcagaatcatccatccttggctatgactccaaatttggtttaagaaaaggcattttatgggcatcgatgcatggcatgagaaagggaatatgaggaagtagagattttaagaaaatcaagatttcgaaagttgaagatcaactgggatgagtttcaaagcaagaatcaaacttttaaagtcaaaatttctgggtcttcctctttgtgtccttaaaattcattcttcaataaaatggaacataagaatagaagaaccaagagcatgcttttctaatcccaaggagctgtgaggagtgttcatttagaagatttcaattcagatagtcaggtatccaccttccacttctttccttctctgtggccatcgcttttaacctgaaacagaagaggtatccagcaaatcatctgcccctggccagaaggggttctccttccatttaagcagtgagatgttgagagtagagtataattcagtgagagtcaaaaagtagaagcagccacaggaaattgcaaactgcagacttgacacagctaaatagaaggggggaaaagaacgaaaatatcagaaatatattttttctggcaggctttcagctctaaaacggggctaattctaccttttgaaaagaagataatttcaatgtttcttttttttcaagaacacataattgaagttattttccctctgagggaaggaacctcttgtacatcactacaaatggacaagaaaaatgagcagctctggtacccagagtgatagagtattcattatcatgtaatctttttgaatatcttggctgccttttcccggtgttttatccgcctgagcggtgcttttctggtaaggttcagatttgcagtaaatttgagttatctaacaccatgtaacaaagaaatcaacagcaggtaagcactcaagaaagaaaaatgatcacgccaaggtcagccccagaggaactcagggggctgacattgcgacagatagtgggtatccattttgtaaattggatccttagcacacaggttaaagtaggtaaattgtagtaacaaagatgcaagatggtgtggtgttttcctgggagccatttgcaccttagtgcgggctgtttcccatgcttcctttttcctttagaaaggatgatggatatttttcttctccactcagaaaaggggcagtgggatgataaggtgattaacctttgtgtgttcttgatttcatgccccaagtgtagtgaaagttcagtaggctgcagaaaccctgtgacctgcccattgcttactcagattcagaatgctgaatgaagttctggatgtttcaggggatgctgacaactggcttaagtcctctcataaatggaaatctctgtcataatgaggtttccacttactcagtgtgtctatttttatagactacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaactaagattaaagatattctgaatagtcaggtcttctgtatttatgggtttctatgtaaatgtataatcaaataccatgaagtgttatatgaatatgacagatactgttatgtatgttattcttaatctagtggagtttccttcttcatcaagggtcctattcatgtgtacattttgtttcagaagcaagtcttcattactgcatagtcccacccataatgtttaccagggatttagacccagatttggctgtaaatttggcttcatattaagtattttcttgaatgacaatcacctgggcccctagcaagaaaagaggaatggcaaagaagaaccagttttagataattttcagctgaaaaaaaaaaaatctttattttaagaagggaaaatacagaaacatagaaagaatataaagcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacgatatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttcccttttttttttttttttttttttttgagacagagtctcgctctgtcgcccaggctggaatgcaatgatgtgatctgggctcactgcaacctctgcctcctgggttcaagcaattcttctgcctcagcctccagagtagctgggactacagacaccaggcacccgccaccatgcccggctaattttttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtctcagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgatacttacaagaatgtctttttttaagagaaaggtttgcttcacaatgtctttgttttgctatttggcagcaaacctccactctgataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcaccttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtactggattactgcttctaggctcgaacactgaaagttttaagctgtcttctttggtgtaagagacaactcttaacggaggaaccctgtgtttctccatggtgtattccacaggtgttaagtattctgcactgggttagtgacagccgtggagtggaggtggaggctgttctctagccaaataaacttcagaaatactgaaagaaatggtctctcagaatctttcatcataagaaaaaaacaggaatccataattagcattagataaaagagtagaatctaacagaaaatagcctttccaagtgttatttcagaaacagcatagcaagcaaatagagtattcagagaacaaaaagaatgataacgtttttctcaaaatctgtgaaatattgacaaggtaagtactttgaaattagatttatacttgaaatgtaagtgctaggggtagaatctaaatttctggcttagatttataaaggacaggatcggccttcttgctgccttgtctatattgaaagggaaactgatattaggttgagacaatgataaattgtgtctgttctctgagggtccatcctaagactgaagacaggaattatcaagttttctctaacagtcgtttggcttaattaaaacaacttgcaccattattattagaggtaatattttatacttttctagcactctctgtgggaagcatcgtttgcttggggaaaaaatgcatggcacttggagacaggtgacaccatattttgggctcaaggtctccctgtattgcaagcctggagaaaaggtgtaggtcacttcccaacctcattttcaattccactacctgaactgtaataatccactccctcagaggcagtttgagagattcaaagagatcctctttgttacaattgtctgaaagtagttaaactctatttatcatgaaatgtgggttatctcactttaattcttacagagactgtgaggtaccactggcaagtccattgatagaagagaacctgaagttatgaaaggttgacaagctcacctaaggatgccaagtgaaggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgttttgttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcatgtctagcatatctttatcacttgaagtcatcatgtttaaaaagatttatattcatggattacaaaagtagaactacttgctgtacaataaagaaacaaatgtagaaagtgaaagtcccctaagattccacctgctagaaagaatctcctttaacatttccgtacctggtctttatatagacctgtaaataaactgtagttactttatcctattctgcagttggatttgttctttatgaaacatgtcttgttcatctttgcaggcttgttccatagatttacaatgtacgtatctgtcattgtctatttaggtgattcttttgctggttagtttaccttgttagtccttgttcctcctctcaaatatggctcctgtgaccaaccttcgtcatttaattttattcacttgtatgagtacttctgtacaattttcctggaagcaagtcacatgtatgcaatttaaagtttaacaatactggcaaccattcatccaatattcatgtttatgcaaatacctatcaatatactatgctatatatatatataattttttttaattttttctttttttgtgtggggggaaaatagaatctccctctgtcaccaaggttggaatgcagtggcacgatcttggctcaaactgtaccaccgggttcaagcgattttcatgccccagcctcctgagtagctgggattacaggcgtgcattatcacacctggctaatttttgtgtttttagtagatacggggtttcacagttttggctaggctggtctcgaacttctggcctcaagtgatctgccagccttgatttcccaagatgctgggattactgatgtaagccactgtgcccgacctgtgctttttataattaatcatttgtgcatgtttcttacccccactagactgcaaaactctcaaaaacaaaggttgtgtgtaatatatcttcatgtccctcctgggttcttacagaaggtacacaaaataaaccctgtaagaatgagtggataaaacaataaacaaaagaataactgaataattcagtagcttctctaatcctcatatgacaggtaatgtttacagttcagaggaggtcctaagtttaacctttaatgtttgctaataaataagtcagtcaaggatgagctcttgtcctgactttatcaaaactagccctccctgatttttggggggctctcagtttccctgtctcacaaagaggagattagcataatggttcttcagatcctggcaagcaactcaattttttttgtctgtaacctgagcatatgccatagtttactcatcactgtctcatctctaatccaaattgttcaacaatgcaataaagtctcaggctaaggttagtgaccagcataaaatatttttggccttttcagccttctgcgtgtctgtacttcaaatgtctgtatattttgggaaaccaaaaaaaatggaaattattttagagaaaaggccaaataggtaccaatcaaccttcttgactatgtttagaagacatttaacgctttagacatcacacaaatgattaatacccatcttggagttgtagtaaatgttgggaatgatagcatgtgttcagagatttgtactttacaggattttcacgtccaagagctcacttggtgtagtgaagataataggagaatgaatatgtagctttcagttttgttgaacttactcttgtaaacattctgaaaagagaaccttttggccaactattttaacaatgcataaatatcaaggcaagagcattcccaacccacatctctgcccattactcatggcagacatcatcatcagttctaaatttaaataatagcatttctgtttttatcacacttttattaagaatgttggggtgagatattagaaatggtcaaatttataggcaatggaaaatgtgataaattcccttttaatcacatagcacaaagctactttaaatctagtatatggcctttattccttttttacatactttttattcttcattgatgatctcaagtactctctcaattgatatttgattctcttgcattgctataattctggctcgcccgcctatttattttttaattttttttttactgcagtatgttttggggtacatgtgagttttggttacatggatgggttctatagtggtgaattctgagattttagtgcacccatcacccaagcagtgtacactgtacccataagggtggaatgaagggggaatagacaaaggccccagtggccctgcatgtcccatatgggtacaggggatgagggataaaagactatacattttatatggagtctttgatccctgcccccctgcccaacctggccgcgccaaagccccaaagtccatcattttgctctgtatgtcttcacatcctcgtagctttgctctcacccacccatttcaacaccaacccagtgtcaatgctactgacttatcatcactatttgaaatctggctgtttgcagtgctggaaaaatgaaattactcaacttccttaactggaacaaaagaactagaaccaaaatgttcgctttctggactcctgtactcgataagatttatctcatttcctatctcaaagtttatatgtggtcccgaagtacacaacttccacaagctctttatgctgcttgacttttttcacctgagtgtgagaaacttctacctgtatgttttctcccttttagctgaataaggcctagcctgctctgctccctctcttcaggaagtccgtcgcgggctatgcgagaggtcccaccttatacccttattttgctcttcctgcagctgtttttctttaattattaatgtgcctgtatctctcacttcactgtaaggttcataagaaagaaagactcaatttatttttctcataaatgtataacagcaaatagtgattacttagcaattgttgaacaaaatagattcttcctattgtaaacatggatttctaaagcctgatagatgactcatctagataaggcaaatgagtaaagagatgtgtccaaggttagccactgaataagtgataaaactaattctaaaacccaggtctcctgacagccacgtccagtgctttttcctctccagtgcaatcgctgcttgtttaggctgactgccttggttgatggtctaggtggcaattaaaggactgtgtgctttctgcctttcagggtggccattcagggcaactggggccttcgtcagttgccccttcattccgcccagaggatgagcttgagcacctgaccaaaaagatgctgtatgacatggaaaatccacctgctgacgaatactttggtgagtggggcctagagctgacttctgaagtaactatcttgctctgatttccttccttagtaattggaactattatcagctccactggtaaagtatttgagtccagatgcatgagagttgatatacatccccgcacaactaagtaattgtaggatttgcatttgcaagactgccatagatgtgatgtctacttagcttatactaaaatttcagtggtccttagagtttccttagatacaaattttattgttgagacttattttttaccagtctaggcaacatggggagaccctgtctccattaaaaatacaaaaattagctgagtgtggtggcatgtgcctgcagtcccagctactcagaaggctgaggctggagaatcacctgagcctgggaggtcgaggctgcagtgagctgtggctcagtgagctgtggttgtgccactgcactccagcctggacaacagagtgagaccctgtttttttgttttttgtttttgtttttgttttttgttttaaaaaagaagacattttttgacaacttattagcttcccattaggcagaaataggatttctgtgtatgttcccatttctcactggtctaaagattcaagtaaaaaatgtggaattggatattgtctgatatccaatttccagattgtactcttaatttttttttctatctcagttgaagaaatgatgttttctttgtagttttaattttcccctcttcaaacttgttaataactaggaatggttaatccttccaatccatgaatataatgcaaatttatgaattatatgccgattgtgaggttctgtggacgcataacctgtcctcagtgaggttaaaattgttcagaaagaggtaagacaagcatacaaataattactagtctaggtagaaagtgataaaagacatgagaaggcttaggtcaattgttgcaaattttatttttattttattttattttatttatttttgagacagagccttgctctgtcacccaggctagagtatactggcgtgatcttggctcactgcaacctccacctccggattttgagcaattctcctgcctcagcctcccgagtagctgggattacaggtgcccaccgccacacctggctagtttttgtatttttagtagagacgaggtttcgccatgttggccaggctggtcttgaactcctgacctcaggtgatccacccgcctcagcctcccaaagtgctgggattacaggtgtgagccactgcgcccggccagaagttttaaaagctccatttattaggagcatccggaatactttggtaaagaattggtggcacttgaatctgagccctttaaaccagtgcctttcacattttctgtggtagaagaccattttcctcccaatctgttggagaccagtatttttgttgagtcagttaaaattaattactagggaaataaaagacacaaaataaaatggaagatgaaattttatcattattagagttaactgttaacgaattactcttttaaatttttatactagtttctaaatattaatcctttgttcctgtatttatctcatccagggtgataagcatttcttagacacccatccatggaccactttttgagtggcactgctttaaggacaaatagagaaacgacatttggggaacagtattagtaaaggcacaaagatggggaaattgcacaggatttttgcttcttcaaatattttctattttcatgtcttttttgctcctatatgggaatatgtaatgacaggtcaactgaccacaccagtccaaaaacacacagtagatgaagtaggaggtattaggatatgaaaaccctggcttttatttgtgttggggtggcagtttagcttagctaaaagagcaaaaagagtgggaatgaaacatctggttgtggtctcttctctgtccctcgctggccaagcaatactggcatgtcacccatctgcctgagccccatttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgcagaactgaattagaatgcagatctgtacatttacacaccacactgtaaaagatggggaaagctagccaggctacatatttagaagagtgtttatggtggagattagctttggacagatgggaaataagagatgagcattctcttctaggtacacagaattaacaaaatataagttgaggccaggattatttaaagaaaatttacgttatgtagaaaacaaaaaaaaaagtgcctatggtaatattcaggctgctctgctaggtggtggtgggggtagatgtgggtcttacctttgaagttcttatagtctaataggatatgtgtacagagttatggtgttataagcacaaggcagaaagtgacaagtgacttaatcaatgttcaccaagtgttctttgagaattcagaaaaaggaaagagaaaatcaagagagagaaatggaaaagtatttatggaatacttagcctttgagtaagtctttaaaattgtgctaattgagatttggaagtaggaagatagtagagaagtgaagtcatttctcatgaggggagtttttgacataacagggaataaaaccactggagtgaagtgtccacgtgagaagtagcaaatattgggaaataaggttcaagtagtaggttaggaccaatctagggaaggctgtcaatgtccggctaaaggctaagaacgttattgtctataatgagcccttgcacattgagatcacatgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgactgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaacaaaatgtaaataaatgatgtcaacagagtaggttcctttgtggtcatgttgctttgcttccaagacactcttttttttttcataagtagaatgattcatgaatatgttattatagttcttgtttctttgcggagcccctcatcactcttaacagttttatttatattgaattataattatcgtatgcttaaaagtactgggagaggtaccagaagatcacctcacagatgacttaagtacaaaggagaaaaggaacttttataatggagaggtctcctggaagccgtcttaaaccaagtaatgaaatttaacatcctcaataatgggacagactggcatgtgccaactgaatgtaggaagtctgcagcatcgtctaggcagtggtcttgctaaaatatttcagctctatccaaccatgaggaagtaaaaaatgcagatgatgggacatgcttcaagacacctgtcctgaattctgcaacactgtcaatgttataaaacactattctagattaaaggaaattgaagagacatgccattcaaatgcaaggcatgtgtcttgattgaattctggatgaaaaaaaaaaaagctgtaaaggattggtagcaaacttagagaaatttgaatatcaatgatatattagataatacatcaatgttaatttcatgatgatattaatggtgttgtgattatgtaggaaaatcttatttttatgagctatttgttgcagtataaggtgaggtatgattgtgtctacagttttattttgaaatattgatagagtgacagaaatagagagagagagacagaaagagagagagggatgattgacagatatatgtagacaaacagagatagagataaatgtggggaggcagaatcacctcaggttaaaacagctagagatgctataactgcaacaactataaggactcccctcctctctaaaagtgtactgaagcctgtcacaaatgaattaccttaagaatcccttcttgggtgggtagagagattgacatttctgcaccttctcaactttcctgttttaatgactacagtgggtctttgaaatttcccgttatcgttttctttttttcttattttttaccagacatacacatcttctattgctggtgagatgaggacaattgtggtagtgatgacaaaagctgatatttacctagagctccatatgtttaaaaaaccaagtcgcagccacaacatgactggcagacctggcgatgatgtcttcatttcattttttggatggggaaatagagattcagagaggctcagtgagttgttcaagctcacatagctaataattttggaatttggcctcactcttctgatctcatgtctatcataatacattaccattacagaaaggtatataaatgctgttcctgctgaatgttagtaactggctgtttctctcccatgtcataacttttccttatgaagttatgatcttcaagtgagagatggagggactgcttctgcccaagattacatgtttgtaatctggacttcgatgtcactgatatgtttcaactatcttaaacatcctgaattaactgctgtgacatggctgaggtacatacattaggaagaccgtctaccgaatacctacctatcagccattttgcagtctgtagttcttctcttgaccatgggagaaggcaaatcactaatagccaccgttcttattttttcaagtcaggtttttttataaaatataacaaacagggacccttaactgtctcagctgggtttttttttaatgatttcttctggaaaggtgatagttttagtgtttccatgccttcttttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaacactggtgtcattgagagggcctctaaacactaccctgtagaggaaagggaggaaacatagtagaaagttgggggtaggagaaaattcttacccagttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtgttggttgatacagccacagccttaagtaatacacccagagcctctaagttttatgctttcattcattttgtaagagaaagcgtgtttgtatatgaagcttttcatacatgcatgtctgtgactatggcataattttttccaaataataatattctggctgaggagccctcaaggctgaaggcaacactgttggaagacagtatctctggaaatggatgttgtaatacatctaaggatggactggaaatatctgacagtagatttttaagcatagagctgtaattatcttgacattgtttatatgatattgtcttattccttctttaaaaaaaagcagaagtatgtgagccttaaaattattgagtgagctatttgaagaatccttcagagcagtgccaggtaaattatcttctcagaacttagcatttatctaaggaaactttttgttcatctctgagtattgttagtaggagtttttgagaatttttgcagaaaaccaggagtttgttccagtggaactaggccttcatttttcaaaggacagctagacaaaagtgaaggcatgaggcagcagggacctagcacatgctaagccttgagagaagaaaggcgttaacatgaacaaagtgctatgatcggtcactttattggttatgccagctcattgtatttggtgccttggtatcaactcaattaagatgaaaatggagggccagtgaatgttcatgaatagaaacagaacaaaaaaaacaatgaggaggatggtccattttctttctgcactagtgggaccagttgataagtgagcttgtccagaggacttgactaagatgcttaggaaattagaaaccatgatttgaggtgcagttgaaggtatggagagaggaaaacctagagccctcattgctgttgaaagactatcatgtggaaaaggaatttgacttaatatttgtgattcaaaaattagcaacaaaggcaagtgaggggagtctggccagttcccattcagcgtaatgaaatcactttcttaagagacagaagaaagtctttgtaaaattctaggtcagaatctaataatcccttgttggtgaaaatggtgataggtactcaagcaactgatggatgattagattatacttcataagtgctgtccaattctaacattttgtgacttaggcacaaacaagacgctaaacttgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagcgattctcctgcctcagcctcccaggtagctgggattacaggcatatgccagcatgccaggctaattatttttgtatttttagtagagacgaggtttctccatgttggtcaggctgatctcgaactcccgacctcaggtgatcctcctgcctcggcctcccaaaagtgctgggattacaggcgtgagccactgcacccggcctggctaatgtgtttttaagcattgatttggaatcccagacttagagtaaagaagaatgtgatcttagaaattatctaggaaaatccttcattttctagaaaactgtatcccaaatgacttatccaaagccatgcaactaggtgtgttttgaattctatggtcaaaattttctttctgagtaatggacagtctccgatggcatgaagaggaatggcagggctgtttacaaaggtgcagacataggtcgggcctgctacttttgtgatctcagaccgtagatccaccttattcaaacataagaacacattgtccttaaaaagaataaaataaataacttttaaggaattttgtgtatgtatttttcaaatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactatagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttggacttgatctcttttgcatgtatcttctgtgaaatttaaaggttcaactggtcaatgaagagagtacttggttaagattttattttttaagtactgggtcacatttcctccacctgtaggtttcatctatagtctttggttcccaggaccatttcgtaccaccacaattttcttctgttctaatctaattggattggatggatagggcatcacattgaaagaaacattcttttcttacgtttacttgagttgtccatagcaacctgtcctgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctgcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgcccaggttggaatgcagtggcgtgatcttggctcactgcaacctccacctcccaggttcaagctgtgctcctgcctcagcctcccaagtagatgggactacaggcacgtgccaccacgcccagctaatttttgtatttttagtagctatggggttttaccatattgatcaggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatcccggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccagatttcctatagtactgtacagctctgatctcagtcctcacttggttctaaggtttgaccatcaaactttgagcttgcatgagccttgaacttggctctactcctatctggcagtgagcatcatttgttaaaattcaacaagagcaaacagaaacagtgtacactagtgacttgctgaaagagcctaagaagatacagtaggcaggagtaatggaaatgagtttttaacctccactgactcaccctttctttcctagtcacccttagggtcatggcaaagttacagaggcatttagaaatcatcttgcttgaaagcttccctttcttcagtcattagtgagcatcttcataattttttttaccatatatgtaaactatccatagtattatttgcctaatatttttatttaaatcaattaactttttatccgactttgtcttccttcatgtcaataacatctataatttgattctgtgggttgaagtactaagttgcttctttcctgtaaaagatattaaactgaatactatatttaaattttaaaaatacggctggaattacagatcacatctgtaatcccaacactttgggaggccgaggctggagaattgcttgagtccaaaagtttgagaccaacccaggcaacagagtgagacccccatctctacaaaaaatgaaaaaaatattactaggtatagtgatgcacatctgtggttccagctactcatgaggctgagataggaggatcacttaagcactggaggtcaacggtgcagtgagccgtgattgcaccaccgcactccagcctgagtgacagagtaacagtctgtctcaacaaaacaaaacaaaacaaaaaacaaagttcatttcatgcaccagctaatgtttgaaatattgagaaatgtggatatcattcaacaagaagaaaaattgataggataccatggtgaaagaaatggtgtcctcaagcttacccattaagtgtataaagcataattttttcttttttcttttgcatgcggagtcatcatgttcttgtgaaggatcgtgttgtgttgttagatattgttccaggcatccagcactgagaggcattgccggcctgatactgtcccactgactcactgtgacatcttaggccggtttctcttccataggtctcatctctcatatcacgagattagaacacatgaactattgtgatccttttgaccttaattcctttgcctcaaacacttttcatatattgtcctctctacactgttaaaatgtaggtgagtaagaaaagcagctgccccatataaaatttcagtgctgcttgcctcagagttctggagaattgtaaacaaacccaagaattatatttcctagatcactttatgctctgcttgttactgttacccatttcctgaggtttatgagagggtcactgccttgaaagtagctttcaatgccaggtaataaaagtggaataggatgttgaatatgatgaagaataccatgcactaagtgttgggtacactagcagcgtcactgtgtttcagcattttcagtaatggtgttcagtcatggtaattggcataccggctcagtaatggtgtttactaatggtaactggcatatgtgagtgatattagtgtgggtaaccatcaacggagcaatagtctaatgtagatgatacagcagtaataaaaatgaataattcatcttttgtcagatagcttagtaaagtgagcactagatttggagtcaggaaatccaagtgtaagtcatcttttctgtgtgacgttagtgacatgtgacatttgtgctctccttagagtattttgttatacagtcttgagaactcttcttttagcagctttaaaatgagtgttattttgccagaagaactaacatatccatggacaagtcagaagttaaaaccaaattatttcagttttcttgtttagattagctcttctatagaacctcagagtcttcctgaatttcaggtatttcacttattaaaaagataattatccctatctattttatgtgcatattgtgggaatcaaattaaataagtcggtatgaaaaagttttctaaaccgtagcagaagaccaaaaatttaagaggtgttagtatctccacctagtgcagcatctggtttgatttgtgtcatttatgattagtgtgtaataatcattcctctaaattgttaacgtcagtgtttatctctatttgaattaacactttgtattttcttatgatgttctgttgtaattggaatatcgctggagaatacaaaaagtgttttttagtcattgtgtgtgagaaagcaacacaccaagatataccacaatgttctcgtttgctgagcaaactactcttgctttttaatgtggaatgtagaagaactaattgaaaagagacaaaatgaattttgactcaaattgaacaggatgaatcataacccactttctcatctgagatgtgaggaagaaaatgtaaaggaaaccaaccaccacacagctttactgtcagtgtcagcataatcaatatagagtgtttttcaacagaataaagaatacatttctgcaaggctgagagttgcaggtagtcggaaacctagttatttttgctttgtctatagtctgctaaaattgtctcgttctgccttggttaaagcattctaatcaagagagtttggggcccctcagtaattgcttctcaaaccattcagaaatgtacctgtgatctctattgaacagaggccaatcagagactggaccctctattgaacgtctggtcccagtgtcattttgtcagatggtcaagagcagggagacggcagacatacagaaacctggacaggactgaattgctgcttccctgaaaataacttacttgggtttattgatgtgaatgattaaacaaaaacactttgtcctattggattctagaatttcgatgcataatccacttagcttgtgaatgtagcttaaaaaaaaaaagattttacacaaataaagaggcactatagcatatcccaggaaaaaaactctaattcctaagtcaaaatttatttctaatttttgttactattgtatttgattcataactcttatgatctttattttcctcatgtgtgtttatatattttctattttactgtaaaattactaagatgggagagcacatctttcttatcttactcttcctctcttccccaaaaagaaaaatgagaagaggagatagagctggatgatttttttaaatatctttgtgccactccaccaagagttttgcttgcaatagaggttctctagtctgatttgatcctaaaccattctcactaatgattctgcttaaaataagactagtacatattgagcactgactatttagtatgagttctacatgcattacttatatctggactataactctaggcagtagatactgttttttacaatgagaaagctgaagccaagatgagttaaataattttcccggaatctagtaattagagttgcaatttgaacacagaacccagctcttaacccctgcatataccatgcctgtgactatagatttcagaaaatgagctagccaaagcctggaaaaagattagactcacaggatctgtgctcattccatgacttttctggtaaatcctattctgttttttcctctactttccttgggggatgtttttagtatgatttgattttctctgattgaaagctctcactactaataagggagcaattagaaatacaggtacaccatctctttgtttgctctgtaccagatgtctgctgagacagtgtctttgccctcctacatgggtagtagtgcccagttgggctgcttagtccagataacaaaaggcgatttctgaccgtaattttttttgttgttaataacacttgaaatatgcatctttattcctccattccttcttggacttgaaacttggttattatgattgtagcaatatttatgtccagaaactctcttctccccacaatttgcctcaatccagtactgctttctttcacacacgtaaatagttttaacttttaacgatccatgcctatggcatcttctagtctagtgatgtgtagaaaagccaggcccagtctcattgcccaggtggaaataagagagagcaaggaaaaggggactgattttgaaaataaagtcaccctgttgacatgtcatcagtcaaaagagttcagtgcaatagctagcaattggctcactcagtcggaagttgatgctattttaggccgtcagcggcagtgtcaatgtatctgtgaattttgccattttatttcattaagatggttcaggaagtcagacactgattaactgattcttcgacttagttcccactcctaattttggatgtgtggtgtctttaggaagctgctgtgtcaccttgattctaaagaaaagtttcgttgtgcctctagagcaatccggaacagtttacccttgtgtctggttatgctggaacctgctgtgttctacctctctggtcacaggtggtatggggatacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtataggtaagactaggaaaattctaagttttgtgttgttgctaggggcttgtaatcttattttatttgtaaacatgctctaaataagaaggataaggatctctagataggaaatatatgttgttctttgtttctccatttattcaataattattgaaggcctatgatatgccagacaattgttccaagcatttccattaaacattagtccacaaaatatagacagaagtgcttacaaatagctcaattccaatatgatacattgctggagtttggtgatatgggaggaaagaagttagaatggcttactatgaatggaaaagtggagaaagattttctgacatagatcatgttaagactgaatattaatggaatttttcaggtaagccatgaattcaagggcatttcagacaaacaattcaatagggacaaaggtatagagaccaacaccaaaaaaagtgcaatatgactgccaaagaatattggaaggagaaatgagactaaatgaatgattagtggccagatcaagagggcctcttatttcttactaaagaatctagagtctgtcctgaaagtgtggaaactccatgaagggtttcaacaagggaaccacaagatattgattaaagatcactctgggtactattgtggggagaggtgttcaatgggacaagatttgggggatgaagatcagtctgggtgtcatttgtacttgtctaaggggaataagggctggaaccaagatagtcatcttgtgacaatttagagaagggtttcaaaggggcgtaagagggatgggctgagacttattcctgggcctctatcttgggtgggtaatgacatcactaagtgatgtgagaaaaagagaaggagttcagtaatggtgatgccatcagtccacagagatcctctctttatcaatacttattgagcacttgctgtgtgtacacactgttctaagcattggtgctacagcagatgaaaagcttcttttatggggcttacattccagtgagaagaaaatgatgacacataaataaaatacatagcaggtcagatagcagtatatcctattgagaaaattatgcaggagaaagggatagtgagtgatacagtggtattggagtggaagtattatggtgaatagtgtgaccgctataattgtgaggtctctattatgggtgaaatctggtctgcctaattttgtttcttttccattttttgtttgtttgatgaattattatttctcgtaaacaaggcaaataaacagcaatagcaacataaacatttacaagcacatagatgtaggcataatagtttgtgttgccaacataacacatgccaggaaaaacaaaagaaaacagcagctaaaaaaagtaaatatcaaaaaagggagctttctcagacacaaattcttatcattcaaaatgctgtgtagtttgaattagaaagtcacagaatgggaccttagatttaatccaaatctcttagtttaggcagaaaaaccttcagccgagcaaggaagtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagcataaagactcagaatcacctgggggagctttatcacattcaaaactacacacccacacacatctaccttgtatttacaatgaaactctgatctactgacataaccctagatccactgagaaaatattattactcggagaaaatttagctgatggagtgtgccataccccacgtgtgatgagataacaaaaaaagttgacaattactgatctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttcgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagggaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtcataggaaggatgttttggatgtttacctgtgcaaaatgggaaattgttgactattgtcaaacaatgggtaacatcagattagtgatttatgtaaaactgaagggataaccatttctactgctgtataccacttggataaccttataaagccacttaatagggaataatggggctggaaatttaatgggaatagatttaaagtgcttgtgggataagaaacatgatattgctctcttttgttctctttcagttcaaaacaggaagtgcctaggtatgcagaaatgcaaatcaagccagctatatttttggtgtgttttgtgtgtgtttagattttcacacatcagcaatactgtaagaacactatgtggccaggcacagtggctcacgcttataatcccagccctttgggaggccaaggtgggaggattgcttgagccctgggagttcaagaccagcctgggcaacatagtaagaccctgtctgtacaaaaagtgaaaaaaaaaaaaaatggatgggcatgatggcatatgctgtggttccagctaatctggacgtggaggtgggaggaggatcacttaagttcaggaatttttggtggctgcagtgagctgtgaccatgccactgcactccagcttgggcaacagagccagaccctgtctccaaaaaaagaatactattatgtgaataatccaccagattcaactaaaaaatggccatgatgttttaaaagtacatatatacacacatatagatttaaagattactttcaactttctaagaaattagtagatctttagaaaatcattgtgcgtatgtgcatatgtgcattgtttgtgctggtcccaccttcaaggagaaaatatttcaagatcctgatgcttacttaagaggttgtatgtgtttaccatggaaaggaccttggaaatcatctcctaattctgacttcattatttatttattttgatgaagcaaatggtgcccagattgaaacaggagtgtaagccacagccaccaagtgccagtgcccaggctaacacttttctccattaactctggaaaccttatttcctttttgtaccacgtatttacagtgtttggtagttatgaattgagtgaattatcccaaggttggagatatcttggtactcacttgtaagtggagaaacactaataggaaaatattctgggaatctggtaaggaagtatgagtgaatttatcatatttaacctttgttcaaatacattaagccctttcttccctttgtcattctcaaactggatcgacatgataggaggagaaattttatcaactaaaaggggttgtgtcaataagtgtttatgatacctctaaacttaggccttaaaacaacacaatctgtgatctgacagttctgtaggttagatgttcaacatgagtctcatctggctaaaaccatcatgttagcaaagctgcatttgtctctgaaggttctttctaggggagaatcccccttgctttttctgacttctaaaaactgaccacattccttgacttgtggccctctttttccatcctcaaagcctgtaacatagcacctctgaccatttttttcatagtcattctgtgtctggccccagctgggaaaagttctccaattggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatcctaatgaagagaaaaatgacagaaatttctaagataactgtttcatatttcttcattaaattaaaatgaaaatacatcttcttagagtattggggtataaattaaactgaataataccagtgaaaatgctctttcaactataaagtattagagttgagaaagttctttttgtttgactattcattctgtcatctcaccttagtggtaatttcttctgcttggacaatagagcaaagttgggccagtaccactttggcaatgggcatcaaagtcgaagaatcccatgtgcaggtcgaactcagtgaaaaagggctggaactggctgctcctgcccgcttcctgccatagtcaggcccacatttgaactttattatttcgggggtaattaccttgtgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtacatttatataccatacatgtacacgctagtatgctttagttaaaatacaaagcctctgtagaaaacagaagaattctgcaatacccctgaaaaataatttattttctacatgctatctcataaatctgtactaaaatcaattttgaaaaattaagccccccttctctaacatggtactctctctctttatttgaattgtttcatgcacttcaacaattatttctagtttcatttcttttcatgaggactttattccaagataattcaatttttgttgctactgtgcaatctttttgcttgttgttgttgatgtgtggttattgctagtttaaaggaaactcttgactttgcttgctcatatccaaacactttaccaaattcagttgttaacaaacttatattaacaacgttttcaggttcttcagtgattattaggctactgaagtgtttttgtggttgttttgttttgttttacttctattggaattcatgtggctgtttatattttgctagaaaattatgcattttgtcaagattgtctactgttgttactatgatataggcgtatttctcacttatactttttaaaatatctgtcttgtccatattcatagcttccttttgctttgactgtttttcctttttcctccttagtggaactttcctaagaagtgtgtatatgtgtgtgtgtggagtttgttttctaactcattacttttaacgtttgccttattattttatatatccttctttaagtttatttagttattcattgttgtagtatcttactctgaatgttcatttatatttctctgtctcttctgtttactaataaaaagcatttaaattgatgaaatgcctctccttgactttatctgcatcccatttggatatcttttaaaatttatcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctctcctaattatatcaacaatagctttattatagttagaaaagacaaaatgctaaatgaattagccgggttaagtcacatttattgtgatttaattcttactgtatgtagtgtaatataaataaaataaaaattttattttattattattattattttttgagacgaagtcttgctctcatcccccaggctggagtgcaatggtgcgatctcagctcactgcaacctctgcctcctgggttcaagcaattctcctgcctcagcctcccgagtagctgggattacaggagcctgccaccgtgcccggctaatttttttgtatttttattagagatggggtttcaccatgttggctaggctggtcttgaactcctgacctcaggtgatccacccacctcagcctcccaaagtgctgggattacaggcatgagccactgtgcctggcctgtaataacatattttaaagttacagagaaagggcaatgtccccaaaatattttcatgatgatatgtcagacatatggagtttcaaactaacactgtggtaattgttgtgtgtctaaacaagtgacaacggggctgggcagcaaaactagacatgggagaagccaactgatccattgagctgtcccagcaagagttagtgggattatgatttatgaaagacctgtgtggacaaggtagtttggaggaactgaatggagggagtgaattaattagaagaatgagacaggactagccacaaacttctcctagaagtttaaactattttaaaaataagagttgtggctcatcaaaaaagtagtgttttcaaaaaacacagccccttcacttaaatgatacgcacagtccagatagactgcaaaacttaatgtttagaagctaacaactttttaaaaactttattgatctgatctgtactgagaacagattttctctgtgctttataataaaacataaagatcaatcacaaaataatttatcaataaattttaaaacaaaaattttaaagtgtatgtaaatatcatataaaattaagaaaaaatatgtaagaataatatttgcaatgactatgataagcaaagggttaacaactgtatgaaaattttcatgcaaatacaaatatcccaacagagaaagacaaggaatgtaaataattcttaagtagataaatacaaatggatatttaacttaaaaaaaattttattcacattagtatgaaaagaaaatttaaataattgaaatctagtttttcacttatgaaattagcaaagatttaggaaaagaaactactgtcatttgctgctggtaagaccgtaaattggcccaaaacttttagaaagttattttacaatatttctcaagaactttaaatgtctcatatctgtcaatccagacagatagatggatggatggatggatggataaatatcagatggatggatggatggatggatggatttatcagtaatagatacatagatggatagatagatagatacatagacatctatagagatatatgtttctatataaatatatatctatattatcctaaagaaatatatatttgaacaaaatctatttatgaaaatgttcactaatgcaaaacttataatggcaaatagaaagggaatctgctgaacaaaatattatcaatcccaaataatgagatattgccaaaacactatatttaaagaacttaagtgatttgggaaaatattatcttgtgagggcaaatacattaaatttgtatattcagtattgccaaatttatataaaaaaatgggtagaatttctttttaaaaaacaccttaaaatataaacggagtacttcccaataatcagattacatgtgattttattttcccccctaattttccttaattttcaagttccgtacaatgaacatgtgttattttcataagtataaaagacttttttataaaaagaaatatatagaactaattagccaaataggaaagtttctaagaacaagggaagaaatttgtgaatggagtggtgaagagatccttggactgagagctgggcaatgtggatactaacactggctctgtcacaaagaaacaaggagacttattgaggttctctcttctggctcaaagattttatgagccagtaatttatcaaagagcccatcctagtgtacccatgggcctgtcaaccctggtagacaggttagtagcccagatgaaatttcccgtggatgaattttagaactccgctccattgatcacccttttttgttgttgttgttcttttactcttctggaagagagctaagaaacttctgataccatccccctttcccactcgccctcagttgtgagatggaggcagcaaatattcagtgtgttctttttggtcttaagtagttctagactcagataccacctcagcaccaggctgagtttgggctggctttggctacggtttgctgctgaatgtatcagtgatggacttttgaatgtttaatagccttagggaatgtggcagtgtcccctacatagagaactgtagattctttagtccaccatttccaaccctgtgatttagattgtcattataagcatcacaggatgccctgagttgagaaaaatctgtgctgtttaaatggtctttaagcagcctttcctttctcctctttctcagctctattctgcttaggatatggcttatgccacttaatcaacatgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgcgaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctctttaatttactgtggttatattatatatgtgcaatggatccctattttcaaacatagtcgtttgataaagtgtgggctgcttttcatcacgaatgtaaaaagtctcttagttgctacacccagcaactaagtgtcctttaattcttaactttgaatacttaattggatccctggtgctatgtgtatttgatttttgttgtgaaagttgcattcactgtgtccctttatttgacatcagcaagatgtaatttctataaaccaattaatgatgcacctttcaactcttactatgagaatattagctggtgtaaatatcggactccttgtgaaggatgactcgctatctgattggtctttaaaaaaatactttaggaaataatggcttgcccctgcatataccaatttgaagtctttctaatatcagccattagctgggatccacatggagtacatagacaaatgaccatagtttctactgtaaaaatgcctcaagatcttgtaggtgagattaggcaattagataaatgcctatagcacaaaatgaattaacatgattgcttgaaaagaattaatttctgtaataatttgaagaaggaagaagttatgtatgctttggggggtatacagaaaggctttataaacaaccctatgaaaaaatggaccacagttttaaacgggcaatccacagaagggaaacactgcaatattcattggaaaaagaaaaggaaggaagggagtgaccaagagaagaaacaagaaggaaaggactgaaatcttgtttgcctttttggagaagatagcatttgaaatgggccttggataataaggtgtgattgtcgttggtggaaatgaattgcatccagaatgcagaaataactcaagcaaaggcatagagattggaaaacatggggcaggtagaaaacaagtccagagtctttgctgcttcttagaagatgtataagggttttattttatagttttataatgaagggcttttaatttcaagtgatgggtcagtgtataattccttaggagataaaattccagggaaaaggaggaggggttataagataaatctagaaatctaactcataaaaattagttcccttccagggagttagttactccaaaaatatccttgataagctaactctgcatggatataactgtgttatctgtgagctggctacagacaagaatttacaattgtctgtagttgcagtctttgagctgcagtcattcaatctctgtctactgctaaaagccagagtttggaaagagcccttatgcatgcttgataatgacacaatttgactgagaatactgccattttataataatctctgaaagttacttccttggtctactgaatctcatattttgtgaagttaaatgaccaatgactgtcattcattggccatgattgtcttgagtttgttgatactaaggtgttatttataatgtgccttttgtttctcaagaatatgttcgcagaaatcaccagtagtgttatccatgtgtatggaaggccagactgtatccccttatgtactaacagactgtatggcaagaagggagccaggttgtcaatgtgagagctaatgttgatatcaacacaggcatcagaaagtcaattactctgtttccctagtttactaaatggtgcttttgcaatagggaccatgttgcctaatgggctgtgaactttaatttgttcataacagtgccaatgagtaaatggatctacctgtggactttagagtgtacttctaacattttaggactgcaagaaagtagtgtgttttatcctctgatacattcatattctctattggagcatacctatccaagcccaatatcctacatcagttttaataaagagaaattacatttaattgtgtctctatcctttcatattaatccattatgaatattttattccacaatgttagaaaaattacattaacttattagtgaagaacattcttttataagaagtgctttatacttcagaacctcataacttactttaaatatttcaggcacaataactggtaagagatgaaaaataagcctgaactcatagggtaaggaccatttagaagtcttttgtcttcagcttgtgattgttcagttaaacttatttgatgtgtgctcagcaggttgtaaaattcctatctttctggagtgatccataagagattacttcatagtgaaacacttaagtttgattcttatgagttgcaaaatgattttccaccaggaaaaataaagaatatgggttccatcaaaagtcaggcatgaattctcatctcctgataaaatgtgaaatatctttgctgatcctgtgcctattctcagtttccatgaccatgcacaattattatttttagcaaataagcaaatttgaggcaaaaacattaatttgataagatatctgcaaatgcctttctggaggagaaaataaatttaaaaagcatcagtgtgtttcactgatatgcacaatcccccacttcttataagaaattaaaacactagtttttaatatcttcagagagaaaatgagtaaaggaagcacagtattttccgaaacgtgttatttaaactaaaaccatgaaatttatgaaaaaaaaaaaaagtagacccttccttgatacacttggtcccaccgaggttcaaagtttcctttgaattggggggggaagggagattctgtaatttaagttttaaacttctgtctttgtatctatccttgtgctggtactccgctatcttggttgctatggttttagagcaaatcttcatatcaggtggtctaagttctccaactttgttcctcttttccaaaattagttgaactattgtgcatcctttatatttccatatacattttagatgtggcttgtcaatttataccaataaaggattctgttgtacatgtaaaccaaattagggagaactgacactttaacaatattgtctttcaatgcatgaacatggtatatctctccctttacttcatttttttttttttggttctctcagcagtgtttttaattattattgtaaaggccttgcacatattatggaacaaacacatattatggaacaaataaatgtaaaagctaaatctataaaacttttccaagaaaagaaaagaattcttacaaccttagataggcaaatatttcttaaggagtatacaaaaaaccccacaaaccataaagttaaaaatgataaatttgattttataaaaactctaaaacttgttttttaaaagacaccataacaaatgaaatagcaagtcccatacagggagaaaatatgtgtacagtatgtgtatatgacaaagattttatgccagaatatagaaataattattaaaactcaagaagaagacaaagaatgcaatttaaaaacaggcaacagatttgaaaataggcaatagatttgaacaggtacttctctaagaaaatacacaaataaccaataagcaaatgaaaaatgctcaatatatgtagtcattaaagaaacaaaataaaactctgtaaggtacctccatacattgatgagagtggctaagactaacaataccaagcattagctaaaagacagagcaattgaaattctcatacactgcagttgaggatgtaacatggtactgccactttggaaaacagtttggtagtgtcttaaaaataaaacgtgttcaacatatgacccagcaattctcctccttgacattgacccaagtgaaatgaaaccttttttttacacaaaggcttgtacacaaatgttcatagcaactatatttataatggccaaaaactggaaacaacccaaatgttcattaacaggtgaaaggacaaattatgctatatttatacaatgaaagatgactcatcggtaataaataaatgatctgctaatatgcacaaatacatgaaaaaaatcttaaaaatatgatgctgaataaaaggaaccagagctacctccacccctaaaaaagactgcctaccttagaattatatatttacaaaatcctggaaaagacaaaactaatctatactgacacaaagcaatcagtggtttgctgaggctgggagtggggaaaggattgattataatggggactgacaaatagggaactttttggggtgatggaaatgttccagatcctggtaatggaggcagttacaaagtcttataaatgtattgaaattcatcaaagtgtacagttaaaatggttttatttattgcatttagattatacctcaacaaaggtggttttaataaataaacaagaaaaagtgtttttcaccaattggtttgaaattcggccaaggcatatttgagcgagggctgtcagccttgtatttgttgcaagtcacagtgagtatgtcctaatggatcctctacaaggtccaggttaggtttctttaaaggatggcaagaacctgaaacagtgtgagtgcagagaacagtgaaacagtgtgtgtacatagtgctttgatttttgtgcattttttggtcctaatattttaaagtttgctgaaccatacctcatagaacatttacctgctttttctgagggaaatatctttatagaacttttccaaagcattctgcatagattttattttaagaaattaaaacattttatttgtattaatttacataataattggttaactcacataattacaatgacaagatcatacagtaggagcagacttgggatcaaatgcagctgactctaatagcaggtgtagcaggaggcacacagctgaggggacatttgagacgaaattgaggccaggttccacttcacattgtactagggttaagcgtgtccacccagaggaagagaatccttaggcctaaaagagcaaaagtgtacagacatactcaagagtaagagagtagccaggaacaccagccaagccataaactccagtctgtgtgtgttaacagataaaattaagagggtaatctagggagtctattgctaaatgaagggcacattaagtctcaacagtattcctatgatcaatcaagcaaccaatgaagtgtacaagcagaagtgatttgtcatggaatttcagagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtggtaagaggccagttttcccatcctcatttactctaaatttgattcatagattattgagcctcagatatctgtttgccatctggtctggtcagtctggtttggcatgcgtcttctttctctttagagtttgatgacgttttaggctgtgaggggcatttgcattgtagtagaaattggatgatgtcagacttgctttatcacactttctcaataatctcttttggtgagtttgatattctacttacagctgctaaagctccttataaccatacgcacaaacatacacttccatatagtcatacatactcacaaacatatatacacagccatttacttacacacgtgtacacaaaggtgtatatccacacacttacatgcacaatgagagatgcatagtaagaatttttccactacccctagtttaactggaagctgtagaaaatctgaactttattatattgatctctgggatcatccacaaaattgcccaaaatgggaatgcggaagctgtttcttacctttcattttctccacatccaatgtgtcctcttcaactgtgtattttgaaacaacctttgaatctgtccccttcccgcaactgcactgccaactgctgatatcattttttgcaaacaagtgtaatgaaaagagcatattctttaacatcaagcaaactaaggtgcaaattttagctctgcatgtattcattgtgctatcttggacaagttatttaactatcctgagcctccttgtcttaatgtgcagatagaagaagataatgcctacctgataggtggcataggaaaaggtcaaaaacattattttctactcccattgctccccttgcctgaaacattataatggccaaacaactggcctcccaacctcctttcccctcttcagtttttcctctacattatagctagagattttgctaaaatgtatatatggtcatcccattttttacttgaaactggtatcttcctgcctataaaacacattttgtttcttagtctcacataggaaatcctttttagtctgtcttgggcccaggactccagtccgattttcctcccattcctacctgccctcttggttttgaatgttccacacaacttcattcctttctttgttaattggcttttcctttacttagaatgctttcccccttcctgctttttagggagaacagggtaaactgttctccctatccttcattgagtctcctttcttttttctaaagttttttcttatcagcatccctcccccaatttgagctcattttctagaaagaattaatagctttcttatatgactctcaagatatttctgtgtggttctctaacagccttcatttattttatatggtaattatagatgtccatttgttctagggaaggcaggtgtcaggtcttactcatctttatattcctggtttgacatacagtgcctgatgtctagtaagcacttgatatctgtttattttaatgtttatgccctacattatctatcacaagtattaaagattgataggtgctctgtaaatgttaaattgagttaattattttcaatcttacaggaagttacataagtcattcctgtattcatttgtgaattttcgacatcctatattaagagttgcacttagaatgtgagttccatgagggcaacagcacttctgtcttactgctctgtctgctatgttggcccataattaaccactcagtaagccttttgtgaaaacaacctcaatgagtcttctacctcaagtcttttgaataggaatggatttaaagctgacccctaatacatctttcaaactttaagtcagtaaattttttacaaacttttttaagttgataaatccctcagaaattattctgaggaagctgatgggatagaaatgaaacagactaaggggctccaggcaatcaccactccccttcgttctccttcctctgttggtggggatcaatagagcaggatcctcaaaactgtggagttctttggagcatactttgaaagcctctaattctattccacgctctaatttccaaaagagggaactgaggcccgtggtggttaaatgccctttccgaggttacacagctatacatggtagagccgacccatgtcttctgactctcatcccgttgcacttacaactagcctgcatgttccccttttcccatatcgcatggatagcatcttacgcatctaagtttttttctttaataatgatcttctcttttctttaagagacaccatcactccgagttgtaccacttgcaccaggctaaattattcctcagtgtttacccctttcagatatttatagaccatcattatggcactccctagtcacctgtcagcttcctaatatgtacatatatggtttctttaatctttctgtacagtcggcttctctagtcccttaatcatttgtaccattctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgttaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaagaaaccgttactgagcgtatccatttttatgcagtttctgtggacttacatggtttctgggagctccctataagccttagtaagggaaagctcttgacttatctcactagttattagggatttggatatatgtttactaaatgtgataatctaagtatggaaactacattagtacaagaggaatcacccagaaatactctactggcataaataaaacattacctattgcccagttttctcatttgtttcattttgtaacttttataatgtgtcaataagtttgaagtcttgaagggctgcccagaaaccaccacagagtggattttccttaccctcaatctgccttcatcaaaatttagtttgtgtgtttatcctataaaatttatctcataataaaaactgaagactaggacggtccttagaaaaacacttgattcggtgtatttattttataaaagggagtcacagagagaaaatgtggccagctcaggtacatggcttcctaggcaatgttccatttcccaaaactttcattggtccagaaagtgtaccttcattcccaaccaaatccttcctataatgctttccatgcctttcttctgtggctctctctgatgatctcacaggtctataagctcttacaggtagaaatatgatttcttgctgtgttcttattataaagcattgccatgcaactgagaagtaatgagagccagtggattttattagaatggaattttaacttttctactttaaaacccagtgattctgctagtctggaggtagcaaagaaggatgactattttctctctcacacaaagtaagattctgaaggggcttattctctgaatgaaaaacgagaggagaaaagtaagaaccttctaatgttttattcaaatgttaacaaagaaatttgagaagcgtgtttccttaaaattgacaccatttttatcccaaacattctggtaagtgatagcagatgactgtgcaagcttctatggagagagagagaggaatttttccaggagcatagtcccagtgggaagtattacctaaaagtaatacactaatcactttcaatcttgcatatttccacatactgtgtgcacacatatgtgtattaataactgttccctagacgtcacttcagcgctcagacagcttagtgttgctatgcgaatgctggagatggaatcagatgcagactacagtttagcaatgagaattcttcagagatacaagaatggaaatggccttaggtcctgcctcatgggtctccctctgagctccagtgtaacatcgggtgtcaagtatttgtggccccatctgcccactccactgagaatctaaatggcattgccagtatttgtgaggtactcatatcttaaaagtcagtgtactcaaatcagtcttgcattctaccttgtggattttgcatggaaattttttagaatgtcattgctgatggaagccccagatatataagtacatctgctccatcgtactggtgatttttatagatattcataagaaaatttattttacagcagtttattttagaggaattctttgcattttatttgtatgtgtgtatacttattttactggcaggatacacacacatgtatatacacacacacacatacatatatacacatacatacatatatatatgaatgtatgtttgtatcctgtcagtaatactttgaggtacctagggctgagattactatttctcttccacctatggctcaaatgggtaaaatagcttactcaaagtcacagttcatacatgtggtgcagcttgaatcaaaactcaattcttctatccacagatttaccactacttgagtagtctgtggtgtttaaaaaaaataataaacaacaggccgggcacagcggctcacacctgtaatcccagcactttgggaggctgaggcaggtggatcacaaggtcaggagtttgagatcagcctggctaacatagtgaaaccccgtttctactaaaaatacaaaaaattagctgggcatggtgacgtgcgcctgtaatcccagctactcgggaggctgaggcaggagaatcacttgaacccgggaggcagaggttgctgtgagccaagattgtgccgttgcactccagcttgggcaacaagagcaaaactctgtctcaaagtaataataataataagacgaagaagtaacaaagccaaactggaaagtttctgttaaatgaatgttctagataataccaacgtataaagcaatcattttataccagctatggtcaaacagggaccagagccttgacttttttttgcctcaacacagctctgcagaacccactcagtaccccatgtcctactgccattcctttggtttccagaacattgagatgtacaaatccaaaacaccacagtgtttcagagagaaatggcatgactctactggttgcaattgtaatggagttcaccttgttctggagtcatacagaagccatgttgtagacttagtgtcccacgcaatactcctaattacaatgaaaatctactgttaggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttattgagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatggcctgatcaacactttttaataaaatcacaatatctactgctgaattttggagggaaccaattcaaatcatagcacacatcttttctaaaatggaaagggtaatatgatcattggagaaatactcattcctttgcatattggtttactatccaagccaggtgtggtggttcacacttgtaattccagcactttgggaggccgagatgggtggatcacctgatgtcaggagtttgagactagcctggccaacatggtgaaaccccatctctactacaaatatcaaaaaattagccagccatggtggcacacacctgtaatcccagctactcaggaggctggggccagagaattgcttgaacctgggaggcagaggttgcagtgagccaagatcgcaccactgcactccaacctgggcaaccgagtgagactccatctcaaaaaataaaaaaaaaagtttactatccagagaatcttgtccaggttaacactcttttttgtctgctttcttcttttgtgaaacaagaaggtaagagggacactggagaaaacctaatgttctttacaaaatgagtcatagttctccatctgcaaactgtggctcccatttatgtcttggtgtcaatatgactattacatgttatgtacatggattccacctcatttgcaacatagtcttctgcctgagctctgtttgttggatctgatctaactttacatggtcttaagtcacacattgaactcttaagttctgtaggcctctaagcctttttaagttttagtattttcatcgttaaaatgagagtgattataacccttgctttgctgcctccaaatattattgagggatcaaatgcattgataaataagataaagcactagacaaatataagggatgcttgatgacttcacagagggaagattattctgttgctggctgctgaaatacagtagctttagaaaaacccctttgggttcccttattatcaggtttggtctcaaataaccagaataaatttggagatttcctaccacaaaagctaaaagtacctgggcagatttaccctttgagtggacctaagggaaatgcagattcccacgggagagatcacggagcagattcaaaccataaggcaaaaataattgttgcaatagcggttctaactgtactagtaaatattgatttttctgttagcagatcaatcatgaaatgaattctaaatatagaagactggttaaaaaattaagacggagaatgtgaaaatgtccatgtgtaaaaattaacttaaagagaaatcttgctttggccaaaagaaatactactgtttctgtcaggaatgttctgtgatttaatcaagtttcctgcctggccagataattttaggaattgtggacttttaaagtagtaagtcagtttagaaaactggttaagtggacagatgtaaagtcagactgcctaagccccaattccagcttcaatatttaactctgtggttgtgggcaaggcacataatctctttatgctgccttttcatcaactgttatggagataatgatagaacctacatcatagagttgttggggtgactacatgagataatacaattaaatacttaacacctggtccataaaaagcgctgaataaatattgactattatcatcaccccggggtctacaaatttttgtaggattaggattaggattgaaatttctaccgaaaaattccatcagtaaaatattgataaatataaatcttaaccaactgcctcagagacatagggacctctattttccactcattgactgtcatctttagagaacagtccaaagcatgtgcctttctgttctagttgttatgagctctttattttgaagttgaactatatacttcctatagtttaaaggagaaagaagtaggtctcatgctggacaccttctagatgttacctcctccgaatttcatagccaagtatttaaggcagttatgatcatctccctcttagagaagcctagaaaaggttactgcagtgcttgacagcaaatagaaactcaccaagtgcatttgttgagggattgacagaatggctggataagtgactcaactaagaccacttatctagtgagtgcgtctactcagctgcttgttttgaagacaaggaaattcgggctcagaaaatttaggaaacttgtctaggctgccaatagctagtaacaaaggcaagaattgcatatctgattttctttacaccatgttacatctaactgttcaaaagataaccatgtattatactcgaaaatgcaaaacagggttgttttttgttttgtttgttgtggtggtggtgatggtatttttgttttgtttttgctacttttcctgagagtggaagttgttatcaaaaagttactgtcatgactactatgtgtatagatgctattagtttcatcaaggttgggaatagggtatatgttgcccaactttctgcccctctccgcctcatattaaagttccagtttcctagaatatatctcctgggagatttggcactagccatcactgcattccaataccccgggacaaactactcttggtggaacacagaagcatacagtccttgttacagcagtggttctcaaactcacattcctgatggaaagctagagttgaagggtcaacacccaagagctgcagtggaggaccatcacctgtcctgattcgccacctgtggtagatcatgactttcactaagatcccctgaggcttgtggggatggagaagtgatgctggactggcccttcctctttccctgcaggtgttaatgggttctgctcctaaacaatactgatataggtcagagttatgattgaattgtatacatagaaacatgtgctgattgagaaaatgggctttacaagtcagacctggttccagtctcagccacactacattctgcctttgagactttggccaggtgatggaacatcaggtttcttatctaaaaaggagaataattggttggtaggactaaatgaaaaaatgtatgtgaaatgcttaggacagtgctgagcacagataaaaatgcacaataattttctattttttgttagtttccttcacaatacatatatttacatcagcgaaacatgcttgcttttgcaaccttctgtgggactccccctcctaatttaccacctcacctgaagttctaagctaagcaaatctctgtctataaatgaatcacatcgtggttagactttataacaacttccccttgccaggagatcactcagccttcacttcatctcatctggtttgctgcccaggcctttatccactcattcctgaactcctctccctgacaaccttggggttttggcttgttgtgtgcgtgtgtgtgtgtgtgtgtgtgtgtgtgtgtgtgtgttttgttttttgtttttttttactttaccttaatttctctttttggactaagatgttaaaatgtttcttaatgtgactgtctccgaaactgttttgtgtctaccactcatcctagtggcagtcattgatccttttcttgttgcgagtgtttgagtgtgggtgtgtgtgagtgtgtatatgtatttgtagagggaaaaacaagagagagggaaacagacattggagccacctttcccccactagccacgtacctgttgaaccttcaagcctctctatagaatcagatatacacaagcacagtgacagaactacatgtgtcctacagtccagcttttaagatatgataaaaactcttgtattcacagagctaaatggcaataaccataggagattgcatattgctacattatgtaaagacagagtcccaagaaaatagtgagaactcagtttgatgtatgatgtgatatgtgatatcttactttacatggctaacagttgacattctttgtggattctatattgtctaaggctacagaagagccatatgataaattcatcggcaacccaaaagaagcctgttctatcgcagtgcttccaattaatataagtaaaccactttctctggctcaatgctaccaaaatattttatgagaaaatttagctgattctgctcatgtatattttcaatggatggaaagccattgcaaacttttcaaactaaaatataaagatagcattagggagaatactctctctggtgaaaaacaacatgtattatgatgcgttaggaatttctttttttcagccaactcgtggttgagcagtctgtccccaaactgttttgcatgcggacgaaacctgtttgggcgatacttgtcagcttttcttctgacaagcaggacagaaataggcacccccagaacactgagtttgacttgactcaacatagaatcacctggagagttttaaaagtttctctcctgtaatatcccacctccagaccaatgaaatcagaatctttggagttgggaaccagggatcaatatttttttttttaagtttcccagatgattgcaatatacaggcaagattgagagtcactgtcctagagtataagcagtttaagaaacaagttgtctattattacatgcatcaatactacagagtccatgaaataaaagctttggtgataagaaaatgccaccatcctagagccttcagttaacatcatatgggcctgtcatataaagaatgcaaactcattctgttatctttttgggccttcagtggaagataatttttaaatcagcttaatggaaactgtgcttcaggaaaataacttcagtagccatatgtaggataaactggagcaggttttgtttctaggaatatgttgccatcatttcactacccttatataatcttattgattcaacttttagaaccaagactttttgcagaatatatcgaagaatgtgcttaatgggaatgctgatatatcatacaattggcatatagagcttcagttcattatcatatttaaaggtacaatattaattttgcttgtgcttaaaatgtctattataattcaagtagcaaggaagacataaagaaaaatgtgacctggctttacatctgcacatatttaatactttacatttgatggtgaataatgggaaagtttgggagtatgtcatgctcagtcaccatgcatcaactcccaaaatggctgtggacagctttggtcctgcctcaaaacaagcactgcttgcaaaagagggtctgtggcttatttttatcagttgtgtggtgatcacaggaaaaacattttaaataaaaagtttattttgccatcatgaaagaaacaaattcatattaccaaaagagaaaataaatatgacaacccagcctggtgcagtggttcatgactataatcccggcacctcaggaggccaaggttggagggttgcatgatcccaggagcttgagaccagcctgggaagcacagcaagaccctatctgtacaggaaaatattaaaaattagctgggcttggtggcgtgtgcctatagtcccagctactggtggcaagggctgagggaggaggatcacttgagcccaggagttcaagggtgtagtgaaccatgatcgcactactgccctccagcctgggcaacagagtgagatcctgtcacaaaaaaaaaaaaaaaaaaaaaaaaaaaaaaaaaaaaaaaaaaaaaaaaaaaaaaccccaaaaaaaaaaccccctttttcccttttcccctttttttttttaaaccgggaaatttcctgggaaggccctttttccccccgccccccccaaaaaagggcggggaaaaatttaaacttttaaaaaaaccccctttaaaaaaaatttggaaaagtttttttggggggaaggggggggaaatcaaaaaattcaaaaaaacggggagcccttgggaaaaccctttaaaaggaggggggttttgttaataccccgggggggaaaagacacctttttcaaaaaattggggggggggtctataaggggaaaaaccccgggggaggaaaaaaaaaaaaatgggggcggggcactaaaagagccccccccccaccttgtatttaaaaaaaaaggggttttaattataaacccccccctttttttgggttttggggggggaaataatttaaattttcctggggagagaaggccccccctgggggggggggggcccctcttggaaagggaaaattttttttagggacagggcgggcgccacaacaagggggaaaaaaattttttttaacaccccaccccgggggggggaagaaaaaaaaaaagggggggggtccttttatagccccaggagccctaaaaaaaggggaaaaataacccccgggggttctttgtgtaaaaaaaggggggaaaaactttctcaaaaaaagggggcccaaaaaaaggggggggggttttaaaaaaggggggggaaaaggccctttaggggcgcccaccccttggtgggggaaactttcctcctctagaaaaccccccaaaaaaacaaatttaaaaggttttctctgaaaaaggaaaaaaaggcccttttttgccccggggggggggggcattaaaggggggccccccttttttcgccgggaaaaaaggggccaagaggtacccccgagggggcccctcgttccaaaaaaaaagnnnnnnnnnnnnnnnnnnnnccccttttattttttgttgtttttttagaaccacactttttccaataatattaaaaagaggtgtttgagaggaggtttatattcaccacggggggatagaagagcccgcggtgctctctattatagagggacattattatattgtgcgtggcgtaaagagtgtttttattttcccggggcggaggagggcccataaaaaaaatgtgggcccgcgtcttccccgcgcacattattaatcctcccccttgaggggaaaaaaagagaaaatttgggggttatttattttcaattcccccaggccaattctcaaaaaaggattgtgggaagattttggttctcccttaaaaaaaagaatgtttttaaaaagaggggggggggctttttttccagagggggggggcccccggaaaacctttttaaaaaaaaggttttttttgccccaaagaaagaaccaatttctttttccaaaaaagaaaaaaattatgccccccccccctggggcagggggttaaaacaaaaaacccggccccccagggggcaaaggttgggggggtgtattatccccgggggtttggcccacccggggaagacaaaaaaacccctttttggccggggaaattttaaaaatttctggggggggggggggggggccaaaaacccccccccttggtggcaagggttaaggaaaaggattccttttggccccggggtttaaggggggggtgacccaattttccccaatgcccccccccccgggggaaaaaaagagattcctttcccccaaaaaaaaaaaaaaaaaaaaaaaaaaaaaaaaaaaaaaaaaaaaaaaaaaaacacaaagaaaagaaaacccatatcacgctatgccacttctcttgttcaacctgtagatttccctggaatgccactattcacccatgccatccccaaaaatgacttgttaaaattctaactcttcagattagctccattattaagacttctgtaaagtctttctgttggtaagaggaggtaaatcagagatatcagaacaatcaggaagccattgcaatagcctttgaaaggaagggtgattaggtagtaggcatgtggtggaaagcaggcatttctgacacattgctgaggttgctatagatgggagagcagaggtgaaggataagaagaattgttggctgaatctagagtcagtacaaagcaatatataaaataagtaataatatataaacaccatttttggttttgtttggaaatcttaattcactgacaaagttccccatcggctgccggccctctgtcatcggatcttttgattgactgactgctcagcattggcagcaagctcttcacaccagccctgggtctgagctaatcagctgtgtttccttcatgctctgatgccttgaagtttggtactattctcctggtttctcttgtttaaaagtgctgagatacttgtctaaaagatgggccttaagattgtggtgtgcttttaataatgtgtggggtaagtgcctctagaggcaagcatacactatgcttgagtaactttctctccattctgaatctctccctaaaggacacagtttgtaaatgtttgttcatgtgaaaagggaagattcaggtaccttttctgtcctactgatgtgtggggctatttttatgttttgttcttcacttttttctgtacttgtgatttaaaggtgccagactggttaccctcaaggctagtgtccccactgtatcccaagaatagaaaaaataatgagaggcagcaaaactggcctgtgtctgagtccagcatattaggctgacccactctagaggaatattctccaaagcataaagtagaagatcattccttaggaatacaatacagtccatctgttttcatagctgagaaggcaattccgtgtcatgccatcatggagccactgcagtgttttggtatccaagccatagtcactcattctctccgtgagggaaaactagaatgtcttttcctcttccacctttacctttcaaaattccatccttgaaggttcggctcaaatgcttctttctccacacaacctttcctgagcccctgtgagtgtggttttccttccacattccatagcactttcttctaagacgtgttacatgctttgccatgtgactattgcatgtaggttgtcttgactgtgagaggcactgacatcgtgacatcgtcgaattcatttttgtatatcacacagaaggagaacatagtcgtgggcaagagtagatatttgaggttgaatagatggaccatttcaaagcttatcttttcagcctgacctttaaggctttgctctggccgttccctctaaatcagtgattgaagtttgctcccagatcctcatgagtagctatcaaactctccataagccatgtaggctcaggttcttggattccaggtattacacttcgggcatcatagtctgaatcaaaattgctacttttagctgcttagtagactgccattaccaatagtttaatgagaactacttttttaggggacggggggaagtgtggtccacagatccctgatagcccttcgtgtactatgtagtgaatctgcttgacatctagaaaagggaagagtaatatagaaaaagaattttgttgacctgcctgcatttaacaaatgtaaaatgtaaaattacagctttcacaggaatctaatatgcttttaataatcatatggattggtaatccatttactcctaatccctaattcgttttctgcaatgaaatgttgtcaaagggtggcatgaagctgttagaatttaagcatgattttcaaacatagcacattttttttgtggttttgtttttttggttttttttttttttttttttcagaataatttcaaaaatagtgccatatgaaatagttttgttactgttggcaggaaagtccaaaatgttatctcataataaaaacaggtacaagttcagtcttggataaaaacttttgaagtctgccacaaacaaatactatacaaaattttttcatcaaatgtcaagactgtggtatcaagactttataatgatatcaactgtagtggtgacagcttagtttccaatactttaactctttttccagcacttcatatttctttttggtttgagatgaagtctcgctctgtcacccagctggagtgcagtggcgccatctcagctcactgcaacctctgcctcccgggttcaagcgattctcctgcctcagcctcctgagtagctgtggttacaggcacacaccaccacgcccagctattttttgtatttttcatagagatggggtttcaccatgttgaccaggctggtcttgaactcctgacctcaggtgatccacccacctcggcctcccaaagtgctgggattgaagacatgagccactgcacccagccttcatatttcttattccttaggaaaaaaactaagatgtatactttgggttatatttaaagtcacattcaaatcccacaacaggatataaagaaatacttttcagggccaaatacaactggagaggattagaaataaatttacctttttttctctcacgttgaaacatctagccctcccatgtttgagtgtgaaatggctgtcaatccaatgtgatggagtgctgaaagccgtcttcagtgagaagtctctccataatgctccctaacatcagatccatgttaatcctgatgcacagaactgggaataggtaatatagcatagtgtttaagagcacagatgctgaagttagactgcttaggctggaatttagttaaccatttgtgtgactcagtttcctcatctgtgaaataggcataataacagtacctgcatatagactgttgtgaatatgaaatgagttaatatatctaaagcccctagaaaaagtctgacatatgtgaagcactacatttgctataccttatctatcaaagcctacagcttctggctaacattcccagtgttctataattattagatagaattttttttaacttagtagaaacaaagactaagaagggaaactagatgtggacgtgacgtctagctcaagattcccatgatggagccacatagagatatggatggcaaccagcataatgcctctcactgacataactatttgtctgaatttatattttattgttattatttaaagcttactgcaaattttaaaaactgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggtaagcagttagaatgaggaagcactatggctcagtaggagaaagaaccttttagccatcaaagcgatctagaaattaaaggactgccttgggatctgcctgtcactgagagctggctgcagaggttttacaatcagggcttttgtaaaaggaactaaaatttgagtttggacccaattatcttacattctaactggatgtgtagaatctccaagaagaaagactcttctgtactgttttatagattttgccttccactccaaacatcctgagtcatgttccttttatacttgcatgtgagatgagagtcagagcactgacctcaaagccagcgaccgggttctactgttcctttctgcaagaacttagactatgagactcaatcccctcaaccgattaatgtaaaatcccctccatgccaatcttgcagaggataggggtggctgtactggtgatcttgctggggtaatggggtaatagtactggggtaatgacggcaggagtggtggttctattgctgctgacgttatgaacctgctttctcctccactttggctttagcaggactgaagtactccttggtgtgttcttatcaaacccttttttttccaggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattgtaagttccagatttgttcctcaagcactttgcaaagatgtcttctgtggctgaatgccagtcactctagatagaatatagccatcagatctttgcttcttcctagacttcaaaatgtgtgtgtggggtgtgtgtgtgtgtgtgtgtgtgtgtgcgtgcgcgcatgtaaattagcatattgtaatttttttctacacatcccccattcataagcagtcagaaaggtgtattagcatgggactgccattcagttagtggtctgctgggaagatcatcagcctgtggctttctagcatgtatgtacaagctaaaattttctttcttaaagcatcagaaagctttccaagtagctgagtcacacctcttataagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttacatgtgcagtgaaattcactgggctttaggaaattattataacctttcagacatactcctcgcatttttacatgtttgcttgcttttctgagtgcgtaacaaaactggagaaggtctaatctgattaaataataggtttctacagtgtgtgggctcaagtttctatctccattccaggcataggatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactgtgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaattctctttaatcattttacatattttgttttctattttttatttattaacataatacaaatgttcatatagttttgcattgttagtattcatttttagatttttatctgtttagttttacatttagattacacacttcattttaaaaccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagcacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatataagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagttttagaaaaagaattgctgttttattcctagcattaccaaggagtctgggcctagggacagagtgcatcagaaattctcagcaaaagtctatttatgaagtggcagccaaggatcctcccccaaaccagtgcttttattcccagtggatggactccaggtcctaactctctgacagcagaaggtggtacagacatttttactagagttgaaatccaaatgactaaagggcctctggaaataggaggccaactccacaggaggctaaacactttaaggtacctgaaacttggcgcattagtgaccaacccactagcagccttttgctcccttatgtcatcaaatggctacagttaaaacattctaacttgtcagcctacattaagaggtagttttgtacctctgcaggaaagctgttcttttatatactcaattcttcttaataaaatgttttaaaagcacttatggccagtgctttatgtggatgttggaaaaggaagcaagagtttggactaaacctgaaaaatccacatgaactttcttcctttttttctaattgcctacgtctgctctctcacctccaaggagtgtttgtctgtgcctcttgtctctctttctgtctcacacaacacacacacacacacacacacacacacacacacacacacactttcttcttgctgttacatcatcatttcaccagaactctcctaggaaggagaaaaatggttcaagaaagagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacacccagcccatgttaaattttctacgtgaagatcctaaaagcccccaactactcagatttaaaatcaggtataattatagccttttcccagaaaattttaattgataaccacctgactcatgctttccagtatcacagaacctgaaatgctaaacttctactgatgaaaaaccataagcccttgtattttcttgagcatttgaggccttaaaaagcaaaaaaaaaaggttaaaaatatttataacaactgacattgacattaacatttgctcagtgctttaacttttatgaagcacttttcttttatcatattaccctctaattaatgatcctagaaaatagttacagttatttttgccttcatttccagtggcaagaaactgaatcttagaaagtgtcagcttgcttagttccatagagtatgagtgtcagagctaatacttgaccctgggcctctgattcccaaggccggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttgtcatgcacttcttttctgttatgtttacctgtgggtatggaaggatgtatacaaatgtaaccacacatctgtatacatgtggttacatacacacacacacaatgagatcataccttaactattggttagtaccttgcttttgttacataacagtatatcaaactttgccttctatacagtccgttttaaatattcttgaaccactgaaaaagaatatatgtcacctacatatgctttctgaaggttgattcaaggatattttccaaaaggcaaataaagtaatcaaaataatatgcacaagagatgcatagcaaataaaatggtgaaaagcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaacctgaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatagcaatgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagagcctagcaaaaaacgagatgcttaccaaatcattttataaagctagcgtgctcccaataataatacctaacctaggttacccccagaagacaattctgtgataatctaactttcataaatgcagaaatcctaagtgaaatattagcaaattgaataccacataataaaacattccagttattccatattcagtgctagaacaattaggaatcttttagcataatttgctatattgatatatcaaaattttagaaaaactagtaatctccatagatgcttttcattaaaagggcatttaataaaatttttcatgcattcatatttaaaaacaaaaacaatggcaatgcaaaataagctctaagtagtatttacatatttcgatttattatgcaacatttctaacatatataaagatatgaagcataatgacaaaggtccatgtacctgttatccaatttaagaaataaaacattaaaaattcagtagaaatcccttgggttctattccatgatcatgttcccccagagagagccactattctaaatttgttttttatcattttatgcatttctttaaacaatatgtagtgttgttagcacatagtgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcgctttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgccctagtttgtttaagtcaagcatgaactcaccactcaatgtttgccagagtttggatgaatgtcagcatcaggctactgtaataatggtttaagattatttaatcccattagttatacacttcattaggctgagtgaattgttggcagtggttcagtaaacttcctcctttagagataaaaggacagaaagaaaataggaaaggagcctattcctcattttctttcatagttataattctttttttttttttttttttttttttcccgagacggggtcttgctctgtcacccaggctggagtgcagtggtgcaatctcggctcaccgcaagctccacctgccgggttcacgccattctcctgcctcagcctcccgagtagttgggactacaagcacccgccaccacgcccagctattttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatattagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttacttttagcttcagtttcctcacacttagaatgaaaacaaacaataagagcaaaccagtttgttatatgttctcacatctgactttgtaaaacagtttgaaaacattagcgtgctcagctccaggattgtcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaagtaaagaaagaaagaaaggaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttccgatctccagccttaaaatgctttcctggaacttaaccaactagatgtaaccatttctgaacatgcaaggttttcatttccacatctctcataggattgatcctcaccacaactggtattatcaagtcactggcatccttgacacactccagtactgacaggaaccccttgaagactgtgcggggtgcggggaggtcacccttttttcttttcttttcttttcttttttttgagacagagtctcactctgtagcccaggctggagtgcagtggcgccatcttggctcactgcaacctctgcctcctgggttcgcgccattctcctgcctcggcctcccgagtagctgggactacaggtgcccgccaccaagcccagctaatttttgtatttttagtagagacggggtttcaccgtgttagccaggatgatctcgatctcctgactgcagggaggtcacctttaattcgtctttgtcttttctgtagtgcttatcataataggtgaacctattgctgctctgatagtgagggggatttggggggagcctgtgtcactctagcactatgtctccccacagtcattgactcacataccctttgcttgccccttcgtgcacctaggacctgagactatgtatgtataagaaggaaggaggagaacttggctctgagagactatgaacagagtcattgctgaaatgtaaatatcaaagattgaagggaaagatgtgagagtgaagccagctgtctagcttccagccgtagaatgatcataagagctactacactcaaggtcaaacacactgactcacccatgaaaattgccaaggagtttgagtggaagttctctgatattccaatgactttgaatgggacacggtaattccttcccacagccagggcttacttaaaataagtaaatgaataaataaagtctactccctggatcttttttttgctcttgtccctgcagagtaaggggatgccagccaaggctgacatcatcattatagcaagacaggtgctttttttgaatacttcacaaggacaagggcctggtattatgtaggtcttcaaagaatatatatatatataaatttttttaattcagtctcctacatttatagtatggggaaataagacaagagcgaggaatgccttgcttgggatattgcaattggatggctgcactgaggactatttaagcaaccttaaaatcacaaacacacatctgtgatgactttttaattatatctgtcattttggaaaagatattaaacatcttcctcagaagttatttttactttacacactctttaataatgttaaaagatatttgatgcaatttatattaataaagctcatgggacgtgttagtaaaaataaaattgaatcttctaaaatatattcctttaaaaatgaatgtctataattttatgctagtttaagcaaataatctgaataaatcctgtttgtttagcataacacatgtacacgtagtttctccacaaaatggaacgcgctaaatgtgttggggcctcaggaaagaactagtggaagggggcataggaggatttgggggcaaaaggaggaatccaaaaagaaggtcttcatggaggaagagacctgtcccaatgtgtcattcggtagatctcactttctcctagtacctcatagtcattcatttttcacccccaacagacaagtggagactgatattattcccttttacaatgtaacaaaatcaaagcttagaaaaccagggggtttggaaaataaggaatttgtgtaggattaaaatagaactttgagctcctggactctgaatcttagcttctaccttgcacttaaataaatttatgctaacagatgtcctgtcatcagataggacttttttttttctttttaatgtcggcaagtctcattgttacagctctctggtctgcccagtttggttacacctgttttgagattccttgcctatacccttccaactgaagacaagcacttcctactgtacttacagaactttcatctatgtcttggtttaatcttttgcctttgttttaaccgtttaccacttctgctttatattggtaggtaatcttacccccaaatacatagactatgagctccttaggagcaaactcatttttttttcctgttgttctttgtgtctttttttccctatccacctccaaatcttactccacatttctgaaaatagcacccaaagcaatacctctcactttggggagtatttagtacattttttaaaaaatgaatgtattatacagtctggatcaccataacaaaaatacaaggactgagtgccttaaataacagagatttattttcttatagattgagaatggaagtccgagatcagggtgttagcactgtaggattctgctgaggactgtcttcctgacttgtagatagccaccctctcactgtgtccttacatggtgtgtgtggggagggagcaagcccactaagtgtcttttcttataaggtcactagtaccatcatgagggctccatccttatgacctcatctaggcttaatcacttctcaaaggccccatatacacatactatcactttggggttaaggcttcaacatataaatttataaagggactcaatttagtccatagcaataaattaggccttttgactatagatctgtaagtgcataattggcactgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgatccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggcacaagtggcaggaagccaaactgacctgagtctggctgggcagtgtctgcaggttactccagcaaagctgctggaataacgatgtgttcttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaataacgactcccaattccctgagttaccattagatggtattaagcaacttcacttaattatgtacctgttttccagttatgttaattatacatcctttagcatttaccacctgtaccaatcatttagcataataataccttatacttaaatgcaagtacccagaatacttttatagttgttttcatttgatattcacaacaatcctacaaggcaagtgttatttctagattagatatgagagaactgaggcatagagaaggtaacccatatagccaagaaactaaaacagggttctgacatccattttctaactatgcatctaggtttttttttttttttacctctgcgtctaagttgcctgcctaaatcgccttcagtccattgaaatccatccaatcaatatttactgagcatcatctgtatttcaaatattgtagtgggcattgggggtatgaaattgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttgatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgctgtcagcatggtatttcaaatgcttcacaatttgaatttaaactagtcaatgggatcattaagattattatgcatgttttccaaagagtttgaattcaaatgacaacttaaaagaaaaaaaaaaagatgtccttgaaaaactaaggaatgttagtgcacttatagaaattcttgcagtttggagtaatttgccacctccccttctgaaaaagtacctgatgatagtgtgcttgagagataggggtattgcagacatattccttaggtgagtaaaactgaattgtaaagtggatgctatggaccatggattatttcatttagtacgattgacagtagaaaatcaggaagggacgtgcatcagtgcgaggctgacacacagatctgaggatggcagaagctcactgaatagcacacgcaaggacccttcaaactcatcacatgtgccgtttggttccctttcaatgggtcggtcttggaatatggaggtctgctttcattttgtgccaagtaaccacgtgagcagtttacaaaagatacaaacagaaggctgctcattcatttttcaaaaagacttttttttttttgcaatggagtttgcaaagtgattttgcaatggattttgcaaaaaaaatggatgccattttttttaaataagtgtaattccaatgatgggaaatttactagctctcaaggcagcttttccttgtgttgaaatctctaaaggttaaaaagttactttttggaaagaagtctatttccttacaacatgttttcattggtccatagagaagacagctaatacatcttccacttggcagccttttaagtatttgaagaaaattctcaagtccatctgaatcttctgttttggctaacttctagttccttcatccatttccaacctaaatttgagcctaacgaacagatttcttctttcttatttaaatatatatatatatgaggaaataaaggcacagagggcttaagggagttgcccaagaacatagagctggttggatgactggaatgtaaggctgtgtggctctaaaccttgtcatttagactagagcacctatacgtcagttagcttcctgccacttcttgttttctgcctggataggactttataaagagtttggaagaagggagagttccgacgaggtacagaaatcagaacttccccttcttccaaactatatacaaataatcagttaatcagattaaaggactcttagtaacattgaaatcaaacctttgtgtttccaggagctctgagaacaacaatttttttggagcattgcaatctcttgagtatccaaaatgattctgtaatgatgtctgtgaggtcagaattggagcagcaaatggaattcctttaagggcttcccatcaatggacagctgattccagaaatggaggaggcacagtttgtatccaaattcataagcacaagtgggagaaattaggctttggtaaagagggtgacattcccaaaggaatcatctgtgaagttggggaaggaattcaagctcagggctgctgttctctaccaggttcttcagccagctggacatgctccccaggtttctactcagtctggaatgttagtaaaagtccacttcctctccttgtttctcccttctagtgaaaacgttcctcttctctaccttcctgacctcaagaccattgttccacacatcccccctcaggatcccaccccgccattctcattctcattacattgtttctggatccatgtctttatcagatgcagcccactgtccctttcagaagatgccagaaaatttacatatgtgatcaaatgttcccatcacaacagttctttccagtaatcccagtgctgggcagctgattccagtaatggaggagacactttcagctattaggcaatggatcacactttcaaaggagattgagcaatctcctcatcaagttgtacttagagcacaaatctggtgccaaaaggcactaccggattcagactgacagcactgagagttttgagtgaaagggaagttagactggtgttatgtgtattcactgggaggaactcaccgggagaaataaagagggtttccagtttattcattgtgtaaagcggctataatagtatttataggggttttgtgaatgtcaaataaaattatatttggaacagtggctagtgccataagtaggacttaacctttagcaatatgtactacattaaaaggaaggtggacacatgagtgatctctagcattttgtgactggaaggaaagagactggatgaccactcttcagagatgctatggacagtacttttgtcaaggactgggagtggagaaaatgacttatagtggtctttccaacatgaagtttgtattaatccgttttcacactgtgaggaagaaatacctgatactgggcaattataaagaaaagaggtttaattggctcacagttccacacggctggggaggcgtcaggaaacttacaatcatggtggaaggcacctcttcacagggtggcaggagagagaatgagagacaagcaaaaaaggaaaagccctttataaaactatcaccccctgcctcggtgcggtcgctcacacctgtaatcccagcactttgggaggccgaggtgggtggatcacgaggtcaggagatcgagatcatcctggctaacacggtgaaaccccatctctactaaaaaaaaaaaaatacaaaaaaattagccggacatggtggcgggtgcctgtagtcccagctactcaggaggctgaggcaggagaatcacttgaacccgggaggcggacgttgcagtgagctgagatcatgccactgcactccagcctgggcgacagagcaagactccgtctcaaaaaaaaaaaaaaaaaatctatcaccccccttgattcacttacctcccactgtgtcccttctacttcacgtggggattatgggaactacaattcaagatgagatttgggtggggacacagccaaaccatatcacacatgaaacacagaaaaaggacatctttttacatggatcttctgatatgcttgtaccaaagcccacagtatatcctgtcttcttgaaagagtatcatagttattcatttgccttggatggaaataatgttgtaataccagttaatacttttttcaactaaagggaatttggcttcatctccagttgcaaattcacatcaggaaatatcaaatccaaagatcaaaactcagtatctcatcactttcaggaccatccttgccacttgtctcaggcatcatgtacctggaagctgaaaagcaatgtacagaacctttgaattggagagatatcaatttgaacccagatcctgctacttcctacattgtgaaagggatcaagtttctttagttctctaaagcaaaggtttttcatctataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattggtctccatgtatctctggtccctttttcccctgtcttctgagtgccctggctccatggatcatccattctttatcctacccaatgggattcttctcgtcaacatccatttgtgccccagcttggcccatattttccctccattgactccacagctctctgtagctattgctttatcccttccttcacagccaaactctggaaagttggatattagaaatgctgtctccacactattcacaatagcaaagacatggaatcaacttaaatgcccatcagcgacagactggataaagaaaatgtggtacatataccccacagaatactaagcagccataaaaaagaatgagatcatgtattttgcaggaacatggatggagctagaggccattatccttagcaaagtaatgcaggaatagaaaaactaatgctgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctgctaccaggcccctatcccttcatagactagctgaggacatcagggacttccatgttgccaaaaccgtgagtctaatcagtgtttacctaacttgatatctcagtaaaggatcattcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaatcttttatccctcgtcccccttccacgcttccccccaaatccccaaagtccgtcgtatcattcttatgcttttgcgtcctcgtggcttagctcccacatatcagtgagaaaatatgatatttggttttccattcctgagttacttcacttagaataataatttccaatttcatccaggtcactgtgaatgccattatttcattcatttttatggctgaatagtattccatcatatatatatattccatcatatatatatattccatcatatatatatattccatcatatatatatattccatcatatatatatattccatcatatatatatattccatcatatatatatattccatcatatatatatattccatcatatatatatattccatcatatatatatattccatcatatatatattccatcatatatatattccatcatatatatatattccatcatatatatatattccatcatatatatatattccatcatatatatattccatcatatatatatattccatcatatatatatattccatcatatatatatattccatcatatatatatattccatcatatatatatattccatcatatatatatattccatcatatatatatattccatcatatatatatattccatcatatatatatattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacattgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatattaaacatcagtgcaggctgggcccggtggctcatgcttgtaatcctagcactttgggaggctgaggcgggtggatcacttgaggtcaggagttcgaaaccagtgtggccaacatgctgaaaccctgtctctactaaaaatacaaaaaaaattacccgggcatggtggcgggtgcctataatcccaactacttgggaggctgaggcaggagcattgtttgaacctgggaggcagaggttgcagtgagccaagagcatgccactgcactccagcctgggcaacagcgtgagactccgtctcaaaaaaaaaaaaaaaaaaaaaaaaaaaccaaccatcagtgcagaagaggatgtggagtggagagactgcatcaattatattttgctgatgagaatataagatggaacaaccattctagagaaagttttgggaatttcttcttttaaaactaatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaaggctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgctgggggaaactggataaagggtacttagatctctacgttatttctttcaacttcatatgaatctacaattataagaaaatttaaagtttaatttatagaaaaggcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagcatttaaagatgttgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaaggtgttcccttttaaacctgctcctctctgtgttccttttccatgaatggcattaccttgttgctccaaccaaaggcacaggagctggcctgtatccttcctcttccttcagtatcccctcttatccacttattaaccaatttctgacataatactttggcttcctttatatcttctttcatttatgagacaagttccttcagtgttttctagtgacttttcattacttggaagagacagttcatactcctcacactaccatgtaaagagctcatagccacatgcacacacatgcacatccacttgtgcacacatacctaaacacacacccaaaacagagagattgtctcatgcctgtggctgggtaaacacttgtccttgatggaatgtgtagctttcccatctccatcccaatcacctagccaaaaactctcctccttcaggcctccatttagacatcacttttccctcaagtatgtgtgattcttgtgccttatcctccccatcatcctgtaatagcatcctctgcttttcctcatcatagcatttagaagactgtatttaaattacctatttgacacatacctcagtagctatacattttccctaaggggagggttgatgtcttgtttctcattgcatcctgcagtaagcaccgagtaagtgtttcttgactctggggctgtactgagttgaagaaggatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaaccctttttgttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtctctagttgttctgtatataaaagctaaacttcttcacatgtttctgtttctcttgtttatgcgatcgtttgtcattggccttgtgttggtgatgtatgttctgaatgaataggctccagcaattaagtgactgagatgaaatgcttttgtatctctctagcctcatttcttttttttttttaccactgtgatgcaaacacatggaactactgttctccattgcaccatgattagtctatccgtagtcttttgtgtgtgatctttctgtacctagaacactcgtcttgggcttttgcctggccagtacattgccattcttcaggtctcagctgatttttcacttcttccatggagccccctctgacttcacaagattgcgttgtcctgctcatatgtcctgctcagagcatgctgcatgtctcacttcatagcacctgttatttttttagtatggattttggttttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacgacttaacgcccttcaagattttgtgtaacagggaaaggagagaacacctggaatggttcccgcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgcagtgcagttcagtgcaaaccaacggaaagcccacagtttttttgtttttttggttttttttctaggtgtaaacaaacctggttgattgtgaggcaaagaaaaataacaaaaacaagtgagaatacattagattaatttactctttcttttttcccgctcattcataatgtgattgaaatcagaagtaaagaaagtaaaatcagagtgagttccctctgctcagtcacccaccctgatcacaagacttttggaatactgggaggcactgcatttaagtaagtatcagctgtatggagagtatgaggttaagatgatgctggatttaatttaaagtctcctcactggtttgcgtgaaggaagatttttatcaagcagagtgaaagagacagaatcttgaagcttccgcagaggggaagaagacagggccgtgcactgcgagtcagtatgcctccagtccctctggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatcctttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgctagggccagtattgtaggtggcaaccaggtacattagtctctgcccttgtggaactcatattcccatgtttgtaaaggagtctgggcctcttatatgtggtaaatgaagtgactgtctatgtagttgcctttgcaggacacaagtccttgccttagtttccctccagccaggactgccccaccgagactattcatagctccaacttaaggtgctttaataaagggcagaaatcatgacaagaaaggacgcttttcttcaggcaatgaattcagcctgattttagaagctgttttggagaggtctctgtaagcatattacattttattccctgcagtacaatatttatacatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactgctctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaaaacagtgttccttctacaaatattctattggctggggctcattcactttcacacagtaacaaagaatgcttggaaatgtggccacactgtatacccccaaaagaagaggaattagtttggttcaaatttatctagtctctgtcatgctttcatcatcatcatcatcatcgtcatcatcatcgtcatcagctactgtggatcagcatactttcctgcaattttccaaatcgaattttgtggttatatattaacagagtatataaaattcattttccctacataatatgtattttattcctatatgtgttttctgcagtggtctgatttatatcaatgactaacatatagattcgatttgcaccaactagataatttaatctcttactcctccttgttgacagttggtggggtgcgccttatttttgaagaagaaaatgcttatccagttattcagccaatctcagttgacagcctatcacatgtcaggcactggaaattccgtggtgagcaaaaacagacaagtggcctgctttcaggaagtttctattctgttaagggagatggacagagtgttttaaaagaaaggagtattgtcctaagataattaaaacacaggaacctgacttagacagagattaagacaggcattcctaaggaagtgatacttcactgagttatgaggagtgagtaggagtttagacatctccagacagtgcagcacgctgatttgaggaactgaaagaaggccagtgtggtcagagctcagagactgagggagaagcatgatgcaggatgagttttgagagataaaccatgaaggacttaggccttgctaagcattttggcctttttcccaaaagtacaggaaagcctagccattttattattttataccacccatccattacaggcttttcctgaaaggtctttggcaataggggagctatggaagcaacatcatgagtaagtgactgggggaaccttttccctaagtgttgtggttgctagccacacaccatgtattcaacatctctccaactctcctcatcgtttcccagagctgaaagtaagatgagcacgaagaaaccatgtttagttaagaacatgacccgaagagtgaaaggtatttcctgttccaaataggagcccagtctgcattttctactacatgatttagtagaaagacacattgcatttgaaccatatttcttctgctagccaattccatcttatctacaactttttgataattattttgagaaatagatctagatcacagccttccaattcctaggccaggatactttccatttttctacacagaccccattgcagtcctcccttcttcacaatcttcaaaatatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccccctcctcctcctcctcctcctcctcttcctcttcctccttcttgcaaatacaaacacagcagggctctatgcagctggttactctaggctctggtaacctaacatagcaggggaggacagaagtcaatagggtgagaagtctgtttttgtcacggatttgctagaagctattaaagtgttcttcctaagtctgttacttcataggttgagggaagtaatgcatcccacacaagaggactgggatatgtttaaagtagtaggaaggcatttgccactattctagtccatcctgcccatgctgcctaatgtttgttcctacagatcaaaatctcataatcttctagacttctagatacagaagagttggagagatcaaagccttgcctctgacccagattattcgatctcatctggcatatcctacactctagccatcctgacctgccgtgtgttcccctaaagctcccatccttttctgactttgcttttcctcattctgtcccctgcattgaaatgcctttcccacatctctatgtctaaatcttacatggccaattccaacgtaatctaatctctgaagattccctttgctccccagttagaagtagtcactccctgctctgctcactttttgacatatattaatttatatagctatgcatttatatgtgtatgtattatattccttacaagagaagcttttgagagaagggcctataacttttctttctatttgtgtttcccaaagctccttctggtgggaaaaatgctttgaggttgaattaagctcacattgaactctatgatgaaaccatttgcttatgaacttggacaagtttctttacaactctgaaccttctgaattttccaccaggagaatgggaatgaataagtaagaaaacttataagacagctcctggtgtagggcctgactcatgtcaggttcccaggaaggccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacataatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatagtgtagtttctgatgtcaaggaacactttagagagaccttaattaatgtagccatatgttgacttcctggagcactcataacaacatgggaagcccacgctgggaagatgctgagtaggaataagagaacaatgctaagagaagggaaatttcaccgtctgtgaagcgtctgtttagattttatgtttaaactttatgaactctgtcacttgctggtgaattttcttgctcagtatcttaaaatacagctgcagtgtgggttccaccctcttcacttaaaagggtgattaactgtttgtgatgaataattatttaattgccagttcagctacatgtgtgtagttgttttgcttctttcctcttcagtgtgagccaaatcttctcaataataaaaataatccagaattagtcaactgccttttatcatgttctcattcagcctgctggagcaagaacattccaattctacatcacctttagcttaaaaagtaaataaatagaagctctcactcagccagttgatagttttactctcacagcctctcctgtaactaataaagtcttgacttcatcttgaaccttttactctatctttggataaaaatttaatcagaaagaattattgctcttttaatacctgtttaacctttacattcgcgatgggtacaaaaccacttaagatttaaagctctcttgttatggacttgtatgctgacctacttttcctcagagatattttttgcaagaattgttgaagcttgacatggggatcactgcaaatgtctcagctttgccattcactgctttccattcctatgtcctccttgccctgttaattattttaacagagacttgctattttaaggaagctctttatcgttactaaatctttttttattgttaaactcctttttctttccagcatagaagtatgtcatgttttctgtcttcagaatgtgcaagtgcttaccttctcataaagtgtgcctgttaccttaattttatagtctttatcacaaaaaggtacgtaagtggggttcagaatagtgtcttgcacttaaggtttaacttaggttttagtttcttcatgcaagcaacttgcatatgtagagaggcagcatgctatatagtgcaatgttcttcttggtttttaattataaaagtgatttcttttctagtaaaaaatcaagttatgcacaaatatatagagtgaaagtgttttcaactcctctctctagaggaagccactagcagttggcatatttccttccagaatttgttgtgtattataaacctatatacgtgcgtatgtatacacacacagtagtacacacattgttctgcaccttgcttctttgttttccctaagaatgtatgcttgatatatttctaaaaataataatgtatatgggtctaagtatttttagtgatatagaattctataggatacatgaaccgtaactcccttagtcatttctctactgattagtatttaacattgtttcttttttttttttttttgccattaaaagcaaatatctttgtgcaattatcttcatgaaatgttgaagctttctttttttttttttttttgagatggagtctcgctctgtcgctcaggctggggtgcagtggcgcgatctcagctcactgcaagctccacctcccaggttcacgccattctcctgcctcagcctcccgagtagctgggactacaggtgtctgccaccacgcccggctaattttttgtatttttagtagaggtggggtttcatcgtgttagccaggatggtctccatctcctgacctcgtgatccgcccaccttggcctcccaaagtgctgggattacaggcgtgagccaccacacccggccaaaactttctgcaggatatatttttaaaatgggttttccaagtcaaaagtgtatgtatgtttccattttgatacctactgaaatagctctccaaaagtgaaaccaaatttattcttttcaatggtatgtaagaatgcctgattccccatactctcattaaccttgagcatgttccatcttttaaatttttgccaagaagattgtctaaaaatggaatctcattgtttgtatttgcatttttatgatttttggtggatttagcatcattttctatgcttagtaactgcttgcctattcatatcctttatccaggttttttgttttgttttgtttctttttggtttggttattcatgttttccttattagtgtattggtagttatatgagttttaaccctttgtcagtggctaatttggaactcctccacagatccctgggggtttcttagagcagctgactggctggcagagctctccatggccttacctccccttcctcttctccgaactcacacacacactgatcgaacagaatagaccaattattacctgcatttcatgttgggctttgtgcttgagattaaacaaaggttcccggggctaaacgtctaaaaaacattgccatggaatgaagagccctagattttgtcataaagtcatctgtcctaggctctacaatgtagcattttcaaattggaagagccttcagagattattttattaccaacacccatgtaatataaattatacagttaatatatgttgatatacatgcaatactgaagaaatctctaatgcattctatattctgtaacagtaatatgtattttattatttataatagcttcaacatatattgaaaactagaggcacatacgtctataaacagtgctcagggcgtattattttggtgtttatttatttattaggtatttattattttatttagtccatagatgatgcatttatctgagaactcctctgactcaaggcccagcaagaatctgctgcccacagttatgagtagctgaactgggccaagcttttaattctataaatagcgaatctatgtagacactcagctagttagtaccagagtggtacccagatccgtgatgtcttgactcttagtacagtgcacttttccccactttgccattctttgctggtgaccttgggtagatcttcttaactgctcagagcttcagttcttctctcttttaatgagagtaataatgcatgcattgatatcctgactaggatggagttggataaagactgttcttaccttttgtgaatagcatagtatcttacagaattgtgaggaattatccaagtagctattgcccctcatcatggtgttaaaagtaggattgctagtttgaacggtaactgcaggaattcaatgtgttttgattttagcatattcccgtatcatgtagaccagtgttaatatttttagtattttatcttagttcttttttttctgaaagtcttgatttttcccagttttattttttagatttgaaagaaaaagaaaaaggatgtaactatgactcttatgttttcaatctctctgaaatataacaaagtaataactctaaatggtcaacgtagtagtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccagacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttagattgttaatttctttaattattgttttatatttttcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatggaaacatatggacatacagaatgaaataaaggtgggaggatgatgagggttgaaaaaatacctattggatacagtccagtactcactcttcggtttatgggtgcactaaaagcccaaatttcaccactacacaatatatgcatgtgagaaatctgcacttgtacccccaaatatataaacattttaaaagatttaaattacattttctgtgagtagaaacagtttcatttcattatttgaagtcatgccttttctgtttcttgcccaattgccctggctagggactttcagttagttgttgaatggaagtggtgaacatgaacatttttgcgctgttcccaatattaagagaaaacattgagtcttttgccattaagtgtaatgttagaagtaaggttattgaacatgctctttattaagctgagcaagtttccttcttttcattagttttctgggaggtttaatcatgaaagtgtgttgaattttgtcaattgcctttagacataagttggtatgataataagacttttgttctacagctggttcatatggtaggtaacactggttaatttttaaatgttgtatcagccttgcattcccaagataaaccccacttggttgtgttgtactactccttttgtgtgttattggatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcattcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaatttggctaacagtattgtacaagttctctctattcttactgattttctgtcttctttttcagtaaattattagagggatactgaaactttgagcataattgtaggtttgtctatttctcctttcacttgtatggtttttgttttaatgtattttgaagccatactgttaagtgcacatacattaggattgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacaatcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattggttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaagatagccaatatctcttcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatatattgtttcttgactttttaataatcgccattctgactgtcatgagatggcatctcattgtgattttgatttgcatttatctaatgatcagtgtcattgagctttttttcatgtttgttgactacataaatgtcttcttttgagaagtgtctgttcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctagggcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaagagtataaattaaattccgcttctatctgcactgcccaaagattctgtgttttaatactaccctacaactagtctcttgcaactggttaataactgtagttttttttttctgttaccaatagtatggcattcagaggccttaaggcagtaaggcatctgccttagtgttctgcaagtgttcacatcctgtctctcctcagaggcatctatctttccttagatttcaggttacagtagtttccccaactcccacttatcagtagttttgccttctgcagtctcagttacccatggtcaaccacagtccaaaaataggtgactacattacaatagtcatgtagagactattgtctctctacaaagagagagaaagagagagagagagagagggagaccacatacatgtaacttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatgggtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcatataatgatttcagtaaattattgatataaaaattttcaatgaagtataactcatagaaaagtgtacctatcttaagtggccataggatatcatttagactgtaacataagagaactatagatattcacatccccaagcattaactgagaacctgttatacagtgggcatttaggaaatgaaaagtgaaggaaaagttactgaccttaggggtcttgaaagcgagaaaatgattaagtgctgtatacacacacacacacacacacacacacacacacacgcacacacgctcaaagagtagggagagaaaaattatgattggggaaatcaataaaagcatattggagaagacatcatttgatattaacctttaagtatagcagtgtagatagtgcgtaagaattggattatagaacttagtcattatgttaggaaagaaacctatggccttgttttatagcaattactggggatatccaggtcttttgcactggaagaaataatcttagaaccatttattaaggacagacccttacagatcatggggtccaaaactgtcttggggtcgaaaactttctcatcttatagatgaggaaactgaggcttagggaagggaagggacttgcctggggtaaatttttgctagtaaatgtacttaatgagatctctcagttacactgaaacgtttgagtattggaacattgtgcttttgttgttttctttttctttaaatccttaaaaaagttgtggatacatagtagatgtatatatttatggggtacataagatgttttgatatagacatgcaatgcataataatcacatcacggagaatggggtatccatctcccttcaagcatttgtcctttgtgttgcagatcattagaatattgtcttcatcattcttttattccccaccaaagtttttgtaaggtagtaagaggatctttgtggaaagaattcttattcccttacgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctccagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattcctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatagcttctgtatttccactcactcagtatgaagtttgctattattttccccaattcctggagccagttattgcagcaaatttagcatttggagcttatagactcatgctagacagacacatatagaatttacgaatcgaattagaaaaatggtctttgaataatataaattgtactccatgtatatttttatatatgaatgaacctactggactccagtgagattagcaaataccttagctatttcattgcaataaaaaccatttttcagtcactcatgtccctctgggttcttcagtgatattatttgatgtatgctttattctgtgccatttattgtactgagtattttgcatgaatgatcttatgtaatcatcagtaatctgttaaatcagtatcattattattcttgtttcattgatattgaaatataaaagtaggttatcataaattaaaaggctacgggtagtgataaaattttattccaggtagtatctccagaatatgaattcttaatcactactcgtgtttattcattccacatgtcactgaatgcctactatgtctagcaaagttctagattctcttgtagttgcattactcagttattggctagataaccctaaacactgcagaaagctgcactctgcccccttgggattgcctggctccataagattattaccgttgctgagtttggggacccacttgagcaaatctagcatacttaaaaggaagtttttattctggagaagttttgttaacaaaacatctattggctgggcagagtggctcataactgtaatctcagcacttcgggatgccaaagtgggcaaatcacctgaggtcagaagtttgagaccagcctggccaacatggtgaaaccctgtctctactaaaaacacaaaaaaattaggtaggtatggtggtgcacgcctgtaatcccagctattcaggaggctgaggcaggacaatcacttgaaccggggagacagaggttgcagtgagccgagattgtgccactgccctccagcctgggcaacaaagtgagactctatctcaaaacacaaacatacacacatacatacagacccacacacacatacagacacacacacacacgtctatttagcatctgtcccaggcagtgcttctcaatagcatgttaatagatgctaaaggacctttagttaggaggtcaactggtctacctctgtcacttagtagacaagaaggttgccctaaaatatacactaagacagtatgcattacaaaaaagccacaataaggacatagcttaggagaaatgttatgatctctcttcaccagtctccttatatgacactggttcaattcagaagtagaggtgaagatagttaatatcctaggaataaatgttaaatctcccttcccctttcctcacagtattatagtcaattctcataaggaaatggccctaagttacaacattaagcttttctattcacttctaataactgaaattccgcccaactgcctcctcacttgaattccatgtactttttttccaaataaattaaatgactttctctaagtcaaatgctattaaaattcttgttgttcctcaaactctgctttcttgtagtatcaggtttattgtgacttgaatgagacttatttgtaaatggatgtattttccattccatcttgctcttgcatacacacacatacactgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatctattctcaagtatatattgtatagagaaccaagatgttcaaggactgtagagccagttataggtttggttttaaagcacttcatcttagactcatttcctttctggctgatgttagttaaaataatataagcctgggcttaagattgtatctctgagtgagacaaaataatagatgattctatctccctttagaaaaaaaagaaaaaaaaaaagcagcagcagcagtaattgactcttacgcttaggcaagaactccacaatggatttgttggggaaaaaaaaaatgttttcctgcttgtatgtgttggtttagattttctgttgtatgtgtgttgtgaaagaagactttggataattattgcgattttccaagcagctggtcttccaatggcattgttacagggtcagtctattttcctttaatctgaccataatgtcatagaacactggctgtttctttggcaactgttcagggaagactagctgttttctctacctcaagccaatggtggactgcaggcaggttctcctgcaagccacagggaagcagttttcattactggggtctttgtatcaacaaatcacttatttcactgtgattctgttgagacaggatccgaaagtaaatttcataagaaaaaaatgattatacatcaagctcaggtgactttaaaatttttcctttacattgagtaaagtttctggccacttttgaccttttttttcaaatgacattattgatatgaaatcagaaactataactgataaactacaaactgctgtatagacacttttctacacaatggtcattgcttttattctttatctaagcctgaattgtaaggcttccttctctttttttttttttttttttttgagatggagtctcgctctgtcgcccaggctggagtgcggtggcacgatcttggctcactccaagctccacctcccgggttcacaccattctcatgcctcagcctcccgagtagctgggactacaggcgcccaccaccatgcccggctaattttttatatttttagtagagacggagtttcaccatgttagccaggatggtcttgatctcctgacctggtgatccacctgccttggcctcccaaagtgctgggattacaggcgtgagccaccatgcccggcctgaatgattccttctcatcttctgggaggtttttctgacttgctttctcaattccactctcttaggcagagcttatacctcccttcatgtatgttacatgtacatgtattgagtcagtgcatcctcctaatgaaacttttcctgagatctctcttatttactttcttccttttctgaaattctctgctatttagattcagtgccaaagaaattgacatttttatttacttgctgaggaataaacagaactcgaaaggatttgggaacccaagaccaagttttatgaaataactaatcttgtcttcctaaatactataaaaatcttatataatccctaatacttagcatagtgctaagcaccgaataggaatacaagaaatattgcaatgatctgaattgcttacaaaatattgacaacaacttcttcattggtaaagaaaagctgcttttgacctttttttcttcctcaagagtaagtagtgagaagcataaagtacccaagagtttctttgcctttttgattgttgcatggaaacaagtatttgcaaataattaagatgggaaaatttggctccttgaaaaggcaggactgctttcagatatatttgaaatgaacttatacagaagccaacatggttatcagagcaattgggtctatttcctatcatctcttcatgatatcttgtaaaaatgccctgtgttgagagcactggtgatcatagcagtggggttggagtagaatctggtgcgtttcttcctctacagatctcctaatagcacttgccctgttttcacagagccttatcaaagtttgatgtagactccagtgtgtagtagtgggcagtgacctaccagatgacctctttgaacaagagctagtttgagccagtgtatagctctgaatcgatggaagatccattttcaaatttcaaaagggctgttaaaacacttagttctgtattatagagatacacaaatggatataacaaactggatgtctcttctgcagctgtttcaattcgtatgccatgttttctatccttcttgctcctggcaattttctttcctgaagcatatcacaccttcttacatttgacaagcattttcacagctactgccactccctgctgccaaacaaaacccagccctgtttgaattcttgagggctgagggatggagaggagacctgtttgactttgaaatggttttaacgtcactttgtatacagaacaaaaatggaaaaccagatcctgtgtttgtctaaaaactaaaatttcaaaacctaacctgaggtggagaaacagatactacagggcaaggaaatgtctgggctcaccgcaaaggaatgcagcaagggaaccacctgcagacacctgtttaagagtttacgtttttgttcttccacacgattattatcttagtatctcaactggctatacatgcttttaggaaagttgcagggatcatattctaaggcgtatcaaatatgttcagagtgcaagcatgagcagaatctctcctctctgctagtgaggtcctgtaggtctacaagttactaacttcaggcttacagaatgttagaagtaacgggtgcatatcctgtaatcaatcccggtattgagcaaacaggcacaaatgacacccagcaagaaaaatgacttgctcaagacaccacagcaagttcatggttttctgaactgaattccaagtttcataacttctaattaatcctcctttttttcccccagtacagctaatatgctttttgtgaataataacatataataggtgtaatctgtcagaactatttaatagttgatagtatgtatcctcagtttattgaggttcaagctcttctgagtattataatactttctattggtattttctctcttgagctattccctaccttgaatctttcagactagagatttcagaagattacgtagtgtctgtgacttcaactacacatggatagtccacaggactctggactttcacggttccatgtcagttggacaggtgttactctaaggccctgcaaaaatataaagtagtttgagaatcactctcctgttaatcttcagtaaaattctgagctatttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctatatgtcaagccactaactgccagccatcagtttgaaaaccgaagcaattaagatcgctgtccatcttacctgaaagggaagctttgcactctaacttgaagtagcctagaaatttcagaaggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgtgtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattaacttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatttcctcttagaattcattctaaacttctttaacagaaattatctttttttgattcatattctcccttttgtcctggttaccagacagcacaagtgaccatcatgtttagatttctgatacagttctctcttccattcctctctgtagcctctgatttttttttcagacttcagttggaaaaatcctaatgaatgtaacttttagttacaggttgaattcttttgaatgtgtatatttaaaataagtaatgcacatagttaaaaagaaacatgtttttaaaacagtggttctcaattatagctaaatatttagaattatctggatggttttaaaactctgatacccaggcagcatcctagatcactcaaatcagaatatctgggtttggtcacggacatcagtattttttttttaaagctgcccaatgtcattccaatgttaagattcattgttttagatattctttattatgatgttcatcatttttacagaaacacatttccaaaaggataaatttcaaaatcacctgtaaacccataatttattataagtcactcttaacacctaaaaatagctaacctgctaacctttttcttttgctttttccttcttcttttaaactaaaattacaataatatatgtgcatatatagtgaatgtattcatttatatattagacacaatttacatatttatgcttatatatatatggcatacatgtacacgttacaatatgtgtatttgttttattccaaatctgttttattctcagagacattttcccatatcttcccagatatattttctgagaacctggtttttaatgcttgtataacattaatacttgtagttagaccattttttttactcattcttctattcttacatattaatgttgcagacaacatccttaaacaacttttgtgtgactaatccaatttttttccttgggaataaattatgatctattgatttatttctatgtgggctgaattttgtccataagaatgaaaatggtagccccctaagatgctgtttgctccctgatatctcatttttctctagaatacgaaggaatggctgttttctgctcttcctaaagattcaggatgtaataatatactgtcacaggtttcagaagcatgggaccttggcaccgaaagggtctctactagctaagttgtcttggaaatgagtgggtccacttcctcttctgatacaggaagaacagggaggtcattaaatgatgacggggctctttgaagtgaaatgaagcaacattggagggtgtagcatgtaaaaactctcttctcggatacaaaaaaaattgagctacttgggctaggagaagtgagcctggatttggaggcttaaggtttcaggaaggtctgagacaaacttaagaagaaatgcatcaagagggttggaagggacagacgattgatgagagcactgaaattccagtgtgatttgggtcacccgtgtgacatggcatatatttatgggatacctggaaaataagggagaaacaagacatctatctctgtcacactttggggaagtatacgattaagttccacactctgtggtggaaagaatgtcctggaggcccccagtctttctcactgtgatgccatgctcatttgataacctcataaacacatttctgttcttattgccttacccattctgatgcactgatcattttttaggccatgtgaacagggcagagcttgtcattatgcctgggacatagtgggcattcagtaggtgtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttacaattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtttaaacattgtgtccattcaagctccattgtagacctttcttttaaagagagttcaccctgggatattaaataaaatggaatttggatggaaagttggcatcccagttcggaaccaatttttattgggcacagacttggggggagcagaaaaaaacaaacacaaagtctatgttgtaaatgataataaaaaaagaataagtaaaacaaatgaaaatgtttcgttttactaaggcttttttgcattcccatgacttcaaaatacttttgcattttatggcaatctataactgctttagtatagacagacaaagaacaaataaagttacataaatgcagagaataacagaagaaatatgtagaatgacagtggtcagttggtaaagattctattggaggttttggaggtttttgcataatttgtattagtccaaaaatattatgaaattaataataaattttaaagtgtatacgtttcttaatgtcttcaacttgccaattctgttgttagtcataaacttttatattcctccctatgtttatctttcccatctctccggcttgcttttgttattactgttgctgattctcaaaaccattagatcttaagtatattccactaccaaagtcattaattttaaggagaaaatgggaagttagaagccatgattttacttataataatccatttgtctcatactttcatctcaaaaatatgtatttaagtagaaagagagccagaaaaataaccgagagagttatattgtaattctggctctactgtatactagtagtgtgattttaagttggtaatttatcctctgtagcctcagcattgtcttctgaaaagtacgttcactcattcgggtggcgtgagatttaaaagaaatgactcctggtagagtagaatgaagtagaatgtagaatgcggtagcaatagaatgaagacatgagtattgatgatgtagcactggactgtgctatatgatagttaccagccacatgtggcttctttaaatttgagctaattagaattaaattaagttaaaaatttagctccttagtcatacgagccacatttcaaatgctcaagaaccatttatggctagtggctacaatattggacagtgcagaagaactattccattattgcagataatcctgttgaatagcacagacctagaatgacagctccgtgtagggcactgggaattgctgtttggggatggtatcaccttgagttggtctgtgacctgctgggagtaatgcagttctcaaagaactctaactctcctttaaccgcgtgcaaaattgtgaacctgggatgcgtgagggagtggttattttgtgctgaatggtatgtcagctacatcaccacagatgtgagatcagcagacttgcttattctgagtgccgtcagaatcgttaagtaccatatgtccagtgtcatctttggcacatttatctggcttcatctgagttccgaagtgaaatctcacagccgccttcataaatttagccatcaaagaccaaggtgatgatgacataccaagctttagaatcctcaagtagggtgggatattggtgctgggaatgacgaatgaagggacatctgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctctgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgagagagtaatggaatgtgtatgtctctgctcttgaagataccaggggcacctcgaaaactcccctccccagcccagggtcaccacagccttaaccgactgcctcctttgcaaacctttaccatgggtacctagaaaaagacatacacacacacatttcagcttatggtttttgttcgtttgtttttgttttttgtttgtttgtttgttttgccagatacttaagatttaagggcaatcttaagggaaatctcttctcccatcttgactgaggcacagagatgtcctgttcccatgctgttgatgctgacagacgtaggacacgtttttttctccgtgtgccaccacactcaagcagaatgtataagatattttctgtctaccaaggatacctggtgacataatcatacctagcctttctttcctccctccgccccctcagcctctcaccctgccctcccatgggtctttatgtgtgctactctatgtagagtacaactcataccggatagcctgttacttattttggttcaggagcagctgcagaggatgaactggagaggacagtctacttgcaaacacttgtagactctccagtggacaggttacctctaaagaaagagaagcctacgctttcctactcactgaagttttttaccatttgcaagtggatccaatatatgtttgttttgggtgaggggctaacaaaatgctctgcggtttctgcaggtttccttataggagatcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgataataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggagtttccattctagtggggacacaataaacaaaataattggcaaattatatagaatattggaaggaagtacatgctgggagagaaataagctgggagggaaaagggagtgctgggggagaaggagctaagagtctcagttccagagttaggcagcctgagctggaattagaaccccagctgcatgcagtggctcatgcctgtaatcccagcactttgggaggccgaggtgggcggatcacctgaggtcaggagtttgagactaccctggccaacatggtgaaacccagtctctactaaaaatacaaaaaaaaaaaaaaattagctgggcatggtggcgggcacctgtaatcctagctacttgggaggctgaggcaggagaattgcttgaactcgggaggtggaggtttcagagagcagagatcacgccattgcactctagcctggcaacaagagcgaaactctgtctcaaaaaaaaaaaaaaaaaaaaaaaaaactcagctgcatccttcccagtcatgtgacctgggcaggttaagagaactccctgagcctcagttttcttgtctgtttatcaagagtcattagggaaactagtatctccttgggttgttgcagggattcaatgagatgacacatgtaacacaatcattacctcgggcctgtctcctataaatatagtgattgtcacgtttgttatttaaacaatattatatattgtgttttaggtattatgtatgtaatatatagtgtgaatatatgtatgcgttatgtatatagcattatctgacttcgtgcctctagtattacatgcttctcaaaatatctatagttttgtcggtatttctttctcctactagattgtgatcttttatcggcaaagaccacctctcgtttatctctataccccccattgtgcccagcacatcagagattttatgtttggctgctgaatgagaaacaaatgggatactgttcttctaagcacaatcatcttatattagcattcatttttggaactcttctctaattcctgtcatttttgtatcacatcagaagaagagctatattccctccaccgcctctcctcgcctattaatcaccataccttcccacctcttacgggaataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaatgtcatacatcttttcatttgatacttagagtcactgtgtgaggtacaaacttcagatattaccagttgcatgttactaataaggaatcagaagctcagagagggggaatgaaagaatccaagtatatgtggctaaaattggccacgtcgacacctgaaatcctattatctggggcaatatacatactgggtttgaaaaagttcacacttagcagttgaatgacctgagtcctcaccccagcttggctacttactcaccatgtgaccctgaatagtgccttgaagcctcagggtttttttacttctgtaaaacagtaactcttgccctcccggacacatgggatagtttgaagattaaaagatacattggctgggcatggtggctcacatctataatcctagcactttgagagactgaggcaggtggatcacttcagtccaggagtttcagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgagtttattggacactgcagaaattcatttacattgtgtgcttaccctggattgttgttgagtccagctgactgttgcttcacaaattaactgtcctttgagacttggaaatattgaaattgcatagagtttttgtgaaatctcaatcctgtagtattgtgtatattacaacaggtgctcaatagacttctggattattaaattgagtaatatttgtagcaaagatctgtaggctgaattataaagctaatctgtggggggatgccaagatttctctatcattctgctatgtttgccatggtctaccaggagatggcgcctggtaagagttccatattttaatgtattctggtccaaatcactggagttggcaaagatggagaaggaggaactgagcagttcatccccaaagacatgatgacaccactataagtgtgaagccagcaagagtgcaaagactgagagcagcgtggtcatacctagacatttatctggagagcaaaatcaagcactggggctcaaagggttcagtcccagcagttaggagagagaggagtctcctaggagtagttgccccaacagctgctagaaagtcctgatcctttttggtctgagccaaccaggtctcagcccagtcccacttgcctcaatttaaagtgacatttttggtctctagctgggtgcttccccctctgtagcatataacaaggatacactttcaaggcagggagcctggaggacaaggagataaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgcattaccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgttggggtgtaacttaccatgattacatgttgtgatatacgagtccatctcagcagatagagagactctccttgacagcttgaggaaataagtgaccatatgagagaagctcatgaggcaaggagctgtgagcaacctttaggagctaaggacagcttccagcagacagccaacaaaaagctaggatcctgactcacatacccacaaggaaatgaattccgccaataatctgaatgtgcctggaaaagattcttccacagccaaccctccagatgagaatgctactcagctgacactttgattgcagcctgtaagactccgagtggaggacccagccagagtcatgcctgggccctcagaaactgtgagatagtaaatgtttgttgttttatgccactgagattgttagccaacaatcaaaacctaatacaataataccctttactgttttctagacagctgctatttagaaaagcctcccacccaataaaagagtcccctttatagttttccaagtaggtggttatcagggttctgcttcaccatcttcagtggcaaggaacttccatttcacagggcaaccatgtgtgtattacagaggcttgcatgttgtcaagttcagctgtggtcttcagcgggagcctaggacatgccagggatttcaaggtaggctggtgaggggttcctggttttcttggtcctgaaccatcccagtgccattctaacagttgcaagtctgcctccttcatgacaaaaggactggaggaaaatgtatctggcaagtcgataacactggatcgtttgctcccagctttaccacttggcatcagtgcaaactttcacccagttaaataacttaatgagccctgctctgcatgcttgcttcacagagttgtgacgatcaagtaagacagcatctatgacagtgtttgttggctgtaagtcagcaaatgattgcaaatgatgattattattaaaataatagtcatttgtcagtaaatatttgtcaaagctggtccacactgagggagacaggctctccagggaaactgctgatgcagagataaagaggagaccagccccagtttggaattgcatcactgattctgaattccccatggtacatttcaggtcttgcttcaggaatttgttttttgttttgtttggtaggaacaagaatcccctagagccagttatgttgtcatcaaacttagttgctaattaggcaccaaagcaaacctatgccagtgagacagagttgaaacttgaattcctttctgcaggtggagcgttggatcctagaggcggtgtatacagcttggctattttgatgcttctgcatgcaagaaggtttaagagaatctgagtaaagcaattagcatccctctgtctgcaggcaaaactggtttggacatgcttctctcttcttgaagggctgttagagccttggcagtgtatctgacgaaagatttcactaagcaaaatgtcttcacttacaaatccagccactttgcactctcagtcagcctcaaattcatttattttctttagagtttccctacaaccacgaaccaccaagaattaaattaatccccaagagcctgagcaattatgaggatgttgaatctatccattcaaggatgtcccagcaaggactgttcattcttttaacgtaaactatttatatgttttgattctcctcatttggaagaaagaaataagttttcatatatgtatttttcagggtgtattttatatatctgtttatattacactgttcacattactattaaagcatccccattttattgtaagtttattttgcctgcttcgggaagaacaagaccaagatcccattattaaaaccaaaatcttccacaaaagtttccttttaaaaacttagattaggaaattttcagtcagccagccaactctatagcctttgatacttggtcctacaaagttttcttcccctttggtctgaatgttttcctttgtctgtgcacactctattctcctgccagcatgataatacatgctgctttgatatcaagtggcgggaacatatagaaatgtgctattggtgctgcaatttgtatctttgttttcatcaaacttattatttaccattttaggatttttttgtttctttttgggtggttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaatcagctgggcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtaggatcatgtttggcttttcaaaactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttggcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttttgtgttctttgcagtagagtccaaataaatataaattaaaatgtttccaattacagaggaaatattttcagtatcttcccacaaataacactgggtttataaggcttggttcccgggtttcatggtcatgcttggttgactaactttgtgttcatgtggcataagattctaaactgtcagaactacgtgggcttttagagcccatctaaatccttctcactcacagacgagcaagctgacatatttgcctcatttattggcagtgaatgaattaaaatattgtgccttcatcaagatattgtgtgtatattcacaatgttgtttttcataaatatgtagcattactctgttttgtgactgctcctagactggctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaacatatgcaaacttgtcttattaaaaagcctatctctagtggttcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcatatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggcacatacacgccatggaatactatgcagccataaaaagggatgagttcatgtccttttcagggacatggatgaagctagaagccatcatcctcagcaaactaacacaggaacagaaaaccaaacaccacatgttctcactcagaagtgagagttgaacaatgaaaacacatggacacagggaggggaacatcacatactgggtggggcctgtcgtgggggtcgggtgcaaggagaaggagaggattaggacaaatatctaatgcatgtggatcttaaaacctagatgacaggttgatgggtggagcaaaccaccatggcacatgtatacctatgtaacaaacctgtacattctgcacatgtatctcaaaagtaaaattttttaaaataagaagaagttgaagtcagggtataggaatcacaatttgcagtgctatctttcacacttcttaccacctgatgaaaatcaccaaatagtatttcttcttttacctaacatctctaggaaagagagaaccctgactgcacctacaagtagggaaaggcatttgagttacgcaaagctgcttttaactctgaaactgtcctacagtgtagcatataaacagggaaaacattttattggtgttttaatagaatcttatctaaatatctggaatcttactgcaagggccgatcattactctaggtagatttcaaggcccacagctccattatgatgtcaacaaggataactgatgtttattctgtagttagagcccccaaggcttcagcaaacattttgctcatcacttgtaggactagcagtaaatgtaatcattgcaagactgagctaacacatctgctaacagggttgttcatttgagtaaacagcaaggtgataaggcgcagggacggaccattggattgagtcagacaggcccgagtacaaaaaccagcctcactacttaaatcttacatagcccattaagagtaagttgcttcactttgggaggctgaggcggacagattacgaagtcaggagatcgagaccatcctggccaacatggttaaacctcatctctattaaaaaaaaaatacaaaaattaactgggcatggtggtgggcgcctgtaatctcagctactcaggaggctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaacggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatattgacactcccaaggataagggaaggcattacatcatcctttgtaatggtgaatcttgtgcatttgtagagggctggactttggcttctaccatattgtttagctctgtcaaccccacacaaggactttatttatttatttagacagagtcttgctctctttcccgggctggagtgcagtggtgcaatcatggatcactgcagccttaacatcctgggctcaagtgatccttccacctcagcctctcaagtaactagcaacacaggtatgtgccacctcatctgactaatttctttttaattttatatagatgggatctcattatgttgcccagcctggttttgaactcctggccacaagcattattattatcctcatcttacacatgaggaaactaccagtgaagtggcttgcccatcatgtgaaattacatatgccagtactagcctgttctgaaatccagcaacattcttttccacctctagccttgtttctagcaccctttggcctccagagcaagctggggttcattttacattaaaagtagagccatctgatgtggcgggcatccaaaacacttgggaaaatgctactctgtttagaactcgcttttcttcctcccgggtcccagtgcaggaggtactgtgtgctatgtgggccatcagactgtccctggccatggcaggagaattaggagaccaccagggctgtagttaactgtaggtccttcattaagaccagccaattgatagcgtgtgttcatgagtccttgtgaagtcttttcatcagccacgtggaagaccccttagaaaaacaatctctgtaatttgtatttttggacatagtgctttaggaaggtggatgtctgaaggtgggctgggtttgaaacatctctcaatgccatgggacagtgtggtacagtgtcctgacaacttaagctcatcctgacaacttaagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgatccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagcttaaggagattttgggctgagacgatggggttttctaaatagacaatcgggtcatctgcaaacagagacaattagacttcctctctttctatttgaataccctttatttgtttctcttgcccgattgcactggccagaacttccaatactgtgttgaataggagtggtgagagagggctaatttacattcccaccaccagtgtacaagggttcccttttctccacatcctcatttgttttttccagaagacagcatttgctattacctgtcttttggataaaagccattttaactgaggcaaaatgatatctgattgtagttttaatttgcatatctctgatgagcaatgatgttaagcagcttttcatatgcctatttgccatttgtatgtcttttgagaaatatctatccatatttttcgcccaattttacatcagattcttagattattttcctatagagttgtttgaactccttatatattctggttattaatctcttgtcaaatggatagtttgtaaatatgtttccctttcactggtttttgtcttcattttgtttgtttcctttgctgtgcagattaacttgatgtgatcccaattatgcatgtttgctttggttgcctgtgtttgtggggtgttactcaagaaatctttgcccaatccaaagaacattcatctttgtcaaatgagctatagaattaatgtttttcctatttttatttattcattttatatttatttctattttatatattcatataacaatatatttattcataatatcactttgaatatcatttgttttcatcttgcatttttctcatttttcattgaggcctaatttacatgcaatgagatactcagatcatgagtcgtagttttaggagatttggcaattgtatatattacccaagaaagttcccttaagttcccttattcctctttctattcaagtcccatctgccaccctcagaggcaatgactttctgacctctatcaccagaaattatttctatatgttcttttaaatcagataagaatcacaccatatttattttttgtatctggattctttcattttgtgcagttgtctgagattcatccatgttgttgtattagcagtcttcatctttttgttgtttagtatgccacgattataccataattaatttacccatttttcttttttatcataatcttatataagggaaaaacatgggaatacatgaactgtatctttggctcaaatccatcttctatcagttctaagggcctcagggtatttgccatgaggggctgtgacaccagcctggactattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaagtatccaaagcattggattacttgagataatatttctggtcctcttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggatatgaacagtaaaggagaatatttttctagcttgtgttaaatcaataatgtagtgattccaagggaattgagaggttcgtgtatttattcatatattagtcaaaaattcaaaattctatctctaattaaaaaggaatttgagaagtatctaccatttttattgtccatctctttggacatatgctttgcagcacagtggagcggaaggagcgtagacctacagaaatttagagggctaaatttttaatattggcctggctacattgcctggactttgggaaaatcacttaagctctcttagccttagtctttttatctgtaaactgagaataataatgccagtttttcaaggttgcattgaggatcttaggtaatacatataacattcatggaacataaaatgtgaaccaatgaaggtgccaatgcaattacaccttcattaggagttgtcatttctgcggcttctcattagaacatcaaaattagttccttcaatctttactgaggcgcagagctttaaactctaactttgaaacttccaaaatgaagtgtgaaaggtctgaggccttgtgagtttgaaaatgcagttcacacttcattttagaagctccagaattttttaccaaattgagattggattcaggaaatcatattttaaagccctggttcatgccattttctaaagaagtacctagaaggccataatcagaatgcttattaagtgaccacactttgaactgcattgcagataaattacctctgtgtggggagatgtgtcttgagattctgcggtcaaggctcagacagccccagagctggaaacctcagagcatttatgcctctgtcactaaaggatggggttatgggggctggacagaaagcttgagagagatgaaaagttcagtgggcttgagggaggattactgaattacaataatatccacaccgtaaagtgaatttgtacttgcaagagacacattatttatctagaattttagaaagggtctcttttcaggtcactgtgtagattgcctgtgatttgttctccttgattgaatgtgagtgagtgtgaagcatatctaaacaggtctcacagcaagtttctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaaggctttggagaacagggcacacatgatcggagactttactggttcagtcagctatataagtgataaggataacatgaagagaggtgccaagggcaagaaagtataagatatgtgtagaggctgggtgcagtggctcatgcctgtaatcccagcactttgggaggctgaggcgggcggatcacgtgaggtcaggggttcaagaccagcctggccaacataatgaaaccccgtctctactaaaaatacaaaaattaggcgggcatggtggcgggcacctttagtcccagctacttgggaggctgaggcaggagaattgcttgaacccaggaggtggaggttgcagtgagccaagattgcaccactgcactccagcctggttgacagagcaagattccatctcaaaaaaaaaaaaaaaaaaagagagagaaaagaaaagttacatgtagagaactgtaagtaatcttatctggctagaatatagggtaccataggggaatgactgagcatgggtcagagttgtaaacatccttatcatgccaatgagttggatttctccagaaggcatagagagatctgtttatagtttctaggtaagaaagagtttatgaacttgcctgtgtcttcgaaatatgctctggcagaatagaaaaggtgatcaaccagagtaggacagaggccacacacatctgccctgaggtcagatacctgtacatttattgtgtttgatagccaaatgattttaatgtaaactagttgcaaacatttaaaatttgggaaattttacataaaaatctagattttcgagcttctattaagaagtagagtgcacaatatctgcctagcaagaaacagctgttgctgagaagtgtcttccaccttcagctagagcatgcagtctgacatttgcttttctggttcttgtatttgagtgtgagactcttggagtaaagcaaacccagggtcagaaagatcactggtgatgatgttgcagttgtactgtcaggactgatgaaaacctaaactaaggtggaagccttgaggaatgaagaggagggcaaggatggatttgctgattgtttagatgtgtcatggatgaaagagatggagaaatcaaagaagactctcaggttgtaattttaggtaactgggtaggattcccatgtagtcagaaacccagaaagaagagaaggctttgggaagatgacagtgtattcaatgtggctttttgtggttcaagactttggaaaatattgattagactgttgaaaagtacttataggtcaggaacctggtcagaaagtattgtgctaaaataatattgttatgacccaagcagttgtaaaaataacttttattgtctaactctcacagtttatcttgaactcttaacaggttgtcaggcaaatatctgttcttgaaaccagaaaaacaaatcaagaaattgggatatttgaaatgcctagagtgggcttataactgtaaatgatattttacaatggaaaagtagaaacagtctttagcagccaatgtgaaataactgggtaatgttatttaatagaatgcaaatttgaaatgagtgataaccattatggagaattttgttaggaaaaaaattaataaagtgaatgtaacacatgaagcagagctggaactaggaagaaggaagtcaggctcctggggaaccaaattaaggagacttcccctctcaggcacttgtgggaccctgacggtaagcatctccttaggtactgctcccatcctcatccttgccttgagtttttgaaaaatatatgttagaaatgtttatgattatatatcacaaactgttattctcaattttatgaaattccctagatatgattacaatagtcatttgagatttatgatcttatctaattgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgtgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattcttacctttaaaagttagctatacaagtacatcatataaatgtcatttactttgatagctgtttatattttttaaaaaaagaaagaaaacaagactggtagagaagatagtctgaccgcaagatcaacaataataataataatgtaggaccacagaaaagtaaatgaaatcttggactgcattcatctaaagaggagcatgcagaacagggaagcagcagtgcctggagtgctgagttcagttctgggcgccacatgatgaagggaacctggataaactagaccttgggcagacaaaggtgcttgggagagtgaggtgacagaaatttctcataaggaatgatggaaggtatccctttattccaataaaaagaagactaaggaaaggcaatgttttcagtgctctttagggctgttaaattgaaaaggcaacagatttgtctggagaggacagaagtagggccaatggggaagaagatatttatgtcaaaataagaaagctctaacaattagacctaccagtggaatgaacgaaccaagagagtgagctgtccctggacatggtataagcagcctcaggggctggaaaaacactgactgactgggaatgttgtagagggaatttatagatcagattgattggggaaaatagccccaaaggttctcctctctctgacatcactctatgattctatgtgaagttctagctttttaactatttttttgtataattaaataatttgtctttattgattgagaactaatcattaaaaaagctactgtcttttcatgtctagagatgataagaataatactacatgcttttgaagaaaaggaattttatgcaaataatcccataccagtgtattacgcttttgcagggataatcaagagcttgcaaaatttgaaaccacattttcccctgtatggaggaggaaagtctattttgcatccgtactttatgccttgggcattattattgctcatatgctctaggatttttaataaacctaacctgcttcatgaaattacactgcattaattcaacatggccatgtccaaaatttaatattcattcatttattcaagtatttattcaacaaacaatccctactatatttcatgtgctattgtcagtgctagaaacatcaatttaaaaatgtttaaatcctagtcttcgaagagtttataattaaatataaaaatattgtctatgtgtcaattactgtagctccaaatacctatttactccaaaaattagtgtctgaaaggaacaatcatttattatctcttacagtttggtgggtcagaaatttgatagcatcttgggccaggcgtggtggctcatgcctttaatcccggcacactgggaggctgaggcaggcagatcacttgaggccggggagttccagaccagcctggctgacatggcgaaaacctgtctctactaaaaatacaaaaattagccaggcatgatggcacgtgcttgtagtcccagctacttgggaggctgaggcatgagaatcacttgagcccaagaggcagaggttgcagtgagctgagatcatgccactgcactccagtctgggggacagagtgagactctgtctcaaaaaagacaaaaagaaagaaagaaatttgattgtgtctcaagtgggcaagtttggcttggggtctttcatgaggtttctggtgtgaggtctctcaaaggctgcttctccttacacctgggccaggagtgtttgaacagctagtctggaacaacttggggtcttcaggtatctccctctatctgcatgtggtctctccagctttgggataacctaacttcttacatggtaactgctatagtttgaatgtgtcctttaagttaatgtgttggaaacttaattcccaatgcaacagtgttgagaagtggggtataataagagatgattaggttatgagggctctccccttatgaatggattgatgccattattttggaagtaggttagttattgagagagtaggatgttataaagtgagtttgactccctcttgctctcttgctgtcatcctctcttgaccttctgccttctgccctggaatgacacagtatgaaggccctcaccagatgctggcaccatgatcttggacttcccaccctccattatcataaaccaagtaaatttatgttgttcaaaagtgacacagtcagtggtattgtattatagcaacacaaagcaaactaagatagcaactgaggacttcaaaggtatgtatttcaagagaaaactatatcacattttaagattagcattaggagggctgggtgtggtggctcactcctgtaaccccagcactttgggaggccaaggcaggtggatcacctgaggtcagcagttcgataccagcctggccaaacatggtgaaaccccatctctactaaaaatacagaaaaaaaaaattggtgagcacagtgtcgggcacctgtaatcccggctactcaggaggctgaggcaggagaatcgcttgaacccgggaagtggaggttgcagtgagccgagattgtgccagtgcactacagactgggcaaaaagagggagactctgtctcaaaaaaaaaaaaggttagcattagaagtcaggcagcatcactgctatgacattctcttggccaggcagttgcataggttctcccaagacctcacctcttagtggtggactgttagtatcacattgtgagatgggatgtgttttggtgtagtcatctttgaaaattacaacttgccatagcatatgaacagataacactatacttgggttctctgctatggtgctgtgaaagaacagaagaggagagtgattaacagaagaggtaacattcacatatcatgggccatataatttgatgtatgtaacttgttaaggaaatacgttcaaggcaggggcaacagcagatggaaaggcatgaaagaacaatgagcacaaagtgtttaaaagcttgggttgacaggaacaaagactgagttgtaggagaggtgacaggctaggggcctagacaggggaggtaggacagcatcctgaagggccttgaacatcaagttaaaacgtttggctttggggagcagtcactgtctttagagcacaggcatataaactgatcgtctttggtaatctcttccatctacaatctttctttcctttgatagtaaacatatcatctctgttaaagttgcttcctagcttaaactgaacacagactccaaaccattgaagcactttagatttttttctttttttttttccttttcttttactcaccacaaacaactctagaatggcatgcatttgaacaaaccaaaagtgatttcactcttctaattttcagtgctttttggctaaatgcagagtgagaaattcatacctttttcaagcagtgtgggttctttttcccaatttctgtcatccatctggttctctggaggtcttggaatccaggaaagtgttagttcactgtgctgaaatccaaaaaagactgctaaactgtgaaagaaaatttgcattccagagacactgaaagagttagtccaccacccttttgcaacagcaaggagaaaacatctgtatttcctgcctctttgtctttaagcagttatagaatggaaaaccctatactccctggctgtgcgtttcatacctagttaatctaaatcacttttggcagggtgggggaggaatcaaaacatggaattattttatttctagtgtcagaaaatattacagccaagatactgtttaagggaagcaaattacttcaccagcttccttttgagctcctcatgaggtttaattctcatgaatgggtcctagagccgacatttgacatacacatcagcagtgccctcttcggaagggaaccgcacagtcacagccatgatgttggcatgtctttatggccttcctaagtcatgtgctgtcttttgtcttccattggcagaaatacaattagaaggccttgttctcaacagaagccaaatgattgccaaatctgttcaactgatctctagagaattgaagttagctcatggccctctggctgttctctttgccactcccaggagttataggcttaaagttatccctttcttttgaaagaggatcaagtttggttcaaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtatacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttataatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgtgcaacaatcttgttttgacagcgacaaaacccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgtatggatttggggtataataaggtttacacagaagaagagctttttcacaaaattcccaggaaagcagggggaaactcacttagaaatctagaagcccattttatattatgacattatccaattatcccagagtatcatatacacaattccttagataatccatttgttgaaaggacagatataaaatataggagaattaatggtgaagggaaaaaatagaaatacggtgcttcagtgtggtagttacattaaatgatcaaaggatgacaagttaattgaataaatgtcttagccccttgaaatttgtatagggaatttataaaactaacatttattatatagtcaggactgggttctcgctttgataatatgtgaactcatttaaacctcacaacactgcaatgtagacatttcagtctacaaaaaccaaaggccagaaaggtcaagaaaattgcctagcttttcgaacccagatcacctttttcctactgtttcactaattctcttactataatatggcagaccttctttgatgtctgagttaataaatcttcacatgacttatgttgtaaaggcaaaatctatcatttgacttgtctcggaaggaaaggaactcaattcttttctttctctctcaccatagtcttagtcttctctgatatgttcattatgcccatggcatgagggtctgacccacagtcctcagctcttaggccccttccccctgccccacatttttcaaggatcagaacacattcaaaagaagtgttttggaagacctagcatgtcacatgggttatgcattttaaagtaaaatattacctctccgggcattaaggtataaataaactaaatgttctataattgagattttcttttccgatttagtaaagctcagatcacaatcctaaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagttttttttcaagtgccaaatccaatcccaactagaatagattcttaagagtcatagaccaccaccatactgcctgctctctcaccattcataagtaattactctcttctctgcgttcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcatctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatcatttgggaagcaatcttgatgaccagaatcaaggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattacttatgtaaatgaagactgtatatcttgattttaaatactcaaaattgaacacttacatatacctatgtaatatgtaaataatggtaatattcttattctttatcatctcattagtagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactcttacgtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttcttgataactaactgtgtgcaaatctgcttcagaatttgtttcctaggaaacacaacctcagactatggcttcatgggaggagagaggagtgattgcagtttagtcatagaggttgacataaaccactaaatcaagtacattgtgttcagtgtcataggggaagcataatacaatcctatgggagtggaagaagttacttacttttcttggaatacaacagaaaaagatttaggaaagatttttcagaagaggtgacatttgagtttcactttgaagaatgagtaggcattctctaagcaaagtagaatacaagatagtctgggctggtaaaagaatgttgcttattaaagatgtggcagaaagctcagtgtggcagctgggaggaggagtccatgggaccacgatggagctggatcagcagtccagtcacaaagcacgctactgatattgaaggttcataagctggaaggtgctcttttcttttaaatccccagctatcaatgctggcaaccctactagacaaaaaaataaataaataaataaataaaagaaaaaagaaaagaaagaaagaaaaagaaagagagagagagagaaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcatgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggataattcatattcttcacctagcaactttcctttttcatggccacataatgaattccttagctccctctctgcattattaggagtcaggtaactggggtaccagtcccacctctgcatctcatgctctccacaactcaggtccagcacatccattctcaaagtctgcctgctcacctgtggaatgagagtctggactaagggaactcccagccccctcctcctgacactgtgagtttttcctttctcgaaggctactggtaggccccactggagactgaaaggggaagattgcagtaaaaggcgcaggctgtcgaaggataacatgtccttctacatcattcactagcctaggatgccagtcaacttcattcttggaacctttattttccaatttgcgggcattttgcaataggctgattttaatcacattttatactttttttcctttgttgcagaaatgtttgtattacctgttctttgaatgcagcatctgtagaccacaaggtctttccataggaactaagcctgttatattgctgctagttttgagtaaatgagctgaatcttgcagccaagcctcagtgcaaacaaaaacattttctggccaaacattttctggttattcaactccattacagggctgactaaaaaaaaaaaaaaaaaagtaaaaacccacagaggagcaaaacacaagtcctgggaagacaatttccagccacattagctcacattgtcagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattcgttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggcacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacagacacttcttgcttcatagccatttatatatcctcatggtaaaagagcagctacccctgaatttccacatcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttgtacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaactatgcccatgggtcaaatccagcccattgtctgttttttttttgtaaataaagtattactggaacacaagcatgcccatatgcttgcatgctatgactgctttccagctataatagcaaagttgacttgttacaacaaagccagaaatatttactatatgggactttagagaaaagtttgccatcacccatgctgtaggaaacaagggaaggaacaaggatagcagtcagaaaacacatgtcctcagttctggacttgccacctactacctgagtaatactagaaaagccacttgacccatctaattgtgtttccttctctctataacacacttctttggccagtttgttagttaattggccgataacacttgttttctatttgtaaggactgtattaaagctgtagatgtggtttgtaaatggtgataaatgccttccttagagtggtgtgataaggacctgagacaatctgttttgtaaagatgcctgtcatgcagtatggacccccttctgtcccagtctgacgtggtttctgtttccttccccagaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagtaggcaacctactctctcgtcaccaccctgccagtccttttggagtctgttcttactgcttggcatctgggcatacattcttctctctcagaactacagaatttcaggatttagtgaggcttttaaaagagcttattgatcccctcctccaatgcaagaattaatatcagacaatccatgcagtcatccagcctggtctctgtgtcaaggcttccccagagcttgtccattgcatctctgggtaattctaatgacgaaaaagctggctcagctatagtgtgtatgtgttagaaagaaacaggatcctggcctaaatatgaacaaaatttgtgacatttggcattgttcaacttatttgagctcttcagtttggtctttagatcaaaccctctctaaagctctctcagctgtgatgacccagagttttctcaagagctaatctgtgcatccctgccactctactgatagggagttatggtggacagacacagagaaccattcagtttcttttactaatgcaagcctctcacatattcaaaggcagtttcatgccattgtcaacatattgatgccattccctagccttttcttccacccaagtcttctctttctcaagttattttttaatagaattaatgaatgcaaattgtgtgttcttttgaggaggattaaaaaatggtgcctcaagatcaaggccagttattcatgggcccaaaataatctgtccccactacttcatttatctcctttttaggtccttctttcctgtattacagctggggtctttatgaaaattaagaaatttaaacagttttgtattgtgcttatttttatttgaccagtttgttacttaattattcaataacattcattttatatatatgtttatatatatacataataatatgtaaatatatttttatatattttatatataaatatatttatttatatacatgtatattattattgttattattttttagacaaagtctcactctgctgcccaggctggagtgcagtagtgcaatctcagctcactgcaacctctgcctcctgactcaagcaattctcctacttcagcctcccaaggagctgagactacaggcatgcaccaccatgcccagctaatgtttgtatttttagtagagatggggtttcgccatgttggccaggctggtctcaaactcctgtcctcaagtgacccacctgcctcagcctcccaaagagctggtattacaggcatgaaccactgtgcccagccaacgtttggtttatatttttaagaactgtactaaacctatagatatgatctgtaaatggtggactcaggtttctgtatgtgtttgctgggcagtggctttgaagacagcctttgaggctatcaaagagatgaagcttgtattgctcaccaggttgggtatccattctatggcttccaagtgtgaagtcttctgggttaattctcaccactgtgttgattgtcaacagccaggaagcacttaccccaaggagtttggagatctgagactcatattttaagaatgaatgtcctaaccactttccaagtagcaaagaaagtgaaaacctcaccaaaagacgtgaggttgaatgaattaaaaaatcccagaggcggaaatttgcaacctgaattagacaaggaaggactcacttttaaagggcagtcacagcataaattgtgcttcacattattgatatttttagcttgtaattacacattgaaaaatccctgcgtcttaagggaagtgaaaagatctcaatggggagtatgttctgttactgtttctctcctttcttagacttatcctaatccaagaaagactgatacttataatcggagcacacatgtttctgtggctagaaaagactgatacattacacccctcaattaaaacaggaaatcaattttgacaaatgccaatttatatctatgccatttatctttcatgtctaggggtagggagcataattagagactggtgactgatgacatcagtttgtgggtctgaaagctcccaaaaagcagacttgagcaactaaaagggggaaaaaaattaaaacccccagataaccttccccactcgttcaatgcatgttaaaacataaattaaaaatgataataatgttgtcttcatgattggcaggtatgtagggagagaagttttttgatcctttctccatttcctaaaggaaaataagaaactgttttatggaactcttatttataagccttaaaattactagaatacaaagcagctaaaagtccagcataggctaatcactgaaagaccaaagagagggcagacaaagggatattcctcctccagacagtttttggggccttgtttgtggtccttttgaatgggtctccttttgtggacctttagaaaatgcatgttaattcagttcaactcacatttataaagaaccctctgtgtgccaattgttgcattaaatgctgaaggagagagatacaaggagagaaattgtgcagatatatatagagaagtcactgtcagcaaggagcttgccaggaggagggcagagaaagtgtgcagacagggagaaagggctgaactccatgagacaggcacaggtaagggcttgcactgtcaaagtcagatcacctggctctgtggtcagaataggctttgtggacggagaatgtcaagagtgttttaagtgggaaacaaggagattcctggcagagggaacaactcaggcaaaaagcagaggcacagagttagtaaagggttctctgtgttcagggagatttgctttgctgtaactagagcagcctgggagtagagattaccttgagatacaggagacccataagaagggatttacctcacctgcttagcctgccttttatttatttatttgtttattttatttatttattttgagatggagtctcactcttgtcacccaggctggaatgcagtggcacaatctcagctcactgcaacctctgcctcccatgttcaagcaattctcctgcctcagcctcccaagtagcttggattacgggcacccaccaccatgcctggctaatttttatatttttagtacagacaaggtttcaccatgttggccaggctggtcttgaactcttgacctcaggtgatccacccgcctaggcctcccaaagtgctgggattacaggcgtgagccactgcacccagccttagtctgcgttttaaaccagtgcttcccaaactttaatgtgcctgtaatccacagagggatcttgttaaactttggattttaattcaggtctggagtggggcctaagattctggatttctgtcaagctcccaggtgcccatggcctgcactttgtgtaacaaggttctggaatactgtttttgagaacttgttaatggaccatcctctacataaacacctttggtcaatgttgactcatatcctccagcctactggacatgcaatctttcacatatgtcatttcagatgaccgctgcaaccactgcagtcttctggaagactatctcccctaccctaacacacacgtacacattttctcatttcacctaaatggttatctttaaaggcccaactcaattaccgtttcctggaagaaaacttctctgatctccacccctcccttttctcaagtttagatttacatcttaatctctgtgttttatagagttttataagtctgctgtagatagcacttaccacagtctgactggtatagaaatatacatatgtgtgtgtgtgtatatacatatgtgtgtttgtgtatatatatatataactttacaataatcatcttgtatcatttttgcaataaggatttgtatatataaattaatagaaatactgcagaaatatatagaactccttctcaggtctgtactggaagtcgttgcttattcttgtattcccagtgagaaaacccagaaaagcagatttctttaactgactctttgcatgtatggaggctttattcccctatctgtgctttcttatcaggaatattaccctcattcatttatgtatttaatcagcatccattagttgattgccagaaatgtgccggaatacaagatgaccaagatcatccctctctgagccttcgctctgttggctgtaaagtagaaatgataaaaatacttcctcataatgttgctgtcagtagaaaattacgtcaagtgtgtacagcacttaacagggcttggcacataataagcactcaataaatggtagctttaatcatcgaaagttgttttcatcaaatttacttttacgattattgtccactcagtgagctaagccttgaaatagaccacctgggattgtgagccctcctcgaattgctatcggaggaacactgtggggactatgagaaccacctcctgcctcttcgctttggtttttctcattatggaaatgaggccaattggtaggaaagaatcattactcagcaagaatacagtttatgtcttcccaaagaggaagaaccttgagattgaacataaagcccaactaatatctttttttatacagaaatatggcagattcatttcattagatacagcccaactttttttttctgcaccagtcacagtggttgttcctggagactcagagatggagcaaagtcctatcttgtggaaacttagagtttagtgccccataaatatatccaaataattactaccaaaatggataaattcaatgacagaattcttatcttagaggagtaaataattctatttggggaaattggagaaggcttatggatacactgaaaaggaaaacatacttctgctcccacagagtttggggaaaggaaattttgcagttgatcccagaagcctacttatttcaccactgatgacccagatttaaaaataatctggtagtccaaagcaattttttgccactgaatataaacttcttgcataaaataccaattataacaactctgattactgctgcagtggtaccatgatccttctaacttttctttcacagcaatcaattgatctgctgcttaattcatatttatttagattgcagccatacagatgctttttgggtgctgccaggaaaattaattacctacatatagaatataatgtatgtagaaatgctttgacaaccgtaacgtgctctgcaaagagttagattattatcattatttctttttaagtctcactacaaatagataaatttttaacatcgtttatcttaaaaccagtaccatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccatttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccaccttttccttttacctctgcgtcccacctcagtgtcgacgcgcagtatctaaccagaactctctcttcactttcaggaaatttgccccgcgatgttctgtgtgcaaggagcctattatgccagccccgggccaggaggagactgtccgtattgtggctttggatcgagatttccatgttcactgctaccgatgcgaggtctggttgacagccctgccctgccagtctgtggcaggcgttgaaaggctcgttcgagctaggtttacatagatgtagcaattactaaatctcagaacggccttagtgcctgtactcataggacttgggttttagatttgacactagtattccgagcacatgctgttgaataagtcactgtacctctctcagtctgcttgctcaccggaagaaaggactcaagtccttaactcctccaaatatggctgtgagagtgaaatacaaaattgtatattaaaggacattgtaaattgtgaaatactaaattagtgagaaatggtgttattgaacatttaactttggctctgaggctttggttagaacttcttgttcagagtcatggagatttatttatttgttagcatgcactactaattgctcagtttcctgaacgcctctagagctgcagtatatctgcatgttcttttcagtaaagccaaacttcccgcagagtataaccattgctgctattgtgttctggataccccgttaacttaaatttcattctatgtcaaatgaagacatgaactccattgacctccttgccaccatggtagatagcagaggcgaggttcatagctgttgtggcctttgagagtttatactaaagttagcaaacacacacctcttgatgaagtactatgtatttattttccaaagaaacttctattttctccaaagacaaaggccagcatttaactgttatataacacttttcaaaatggaccctaagaggagctgtcagcggtagtatattcctttacagttatgcagttctttgcatttttttttttgatccattatcttctttgatcctcttaacagcttggtaaggtagaaaaggcagaagttattttcagagtggcagtcggcctgtgtgcattgaggcagactgtagcaaaactgtgggtggtgctcaggaggcctgtcccctggactagcaatctttgctctccacaatgctgtctcctttagaaagtacagcaaaccactactccccacaaactttaggattttattttcttactgcagttgaagtaaatacaccgaacccactggtggcccttctgcttggcagacatcagtctacctttgctctaggccagaaatggccaaaacattccattcctgtacctgtgcatgcattttgagagatccttaaactaatggtaaagggtaaaaaatgcatcggtggttagggacattcttattttctcttgttgagtgggggcagcaaacttctacatgggagccaagatgggtggcctcttctcttcttatacctgtatttcatatcaagtgagcttaggaggattatatttatgtccatttatatttatgtccccaatctctaattcaattacattcaagatatactatgttatatattgggagaaaggatacaggggattagcagaatgtaaagcaggaaggatagtaagtggccacattatggaggccttgaatagaaagctcaatcatgatgttctccacatgtgtacttaacgtttttacttatgtcgtttccatctgtctttactgttctaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagattttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcattattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtttcatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataactattgtattttcagaattttaacacagattaacacttagcctgtaagactaataatatattgtaatagttgatactaaaatatttttcagcaggttggacagcaccagtttttcttagatcacagactacaggcagaatttcccttcaatccagaaaaaaggacactaatttccttttctatttaattttcctggcccttgtgcaaaaaattgtggactctatcttagttacaacatgcatgtcccttattttgtggagagctgtgtgaaagatgcgttttttttctttttttctttttttttttttt

SEQ ID NO: 14208 - DNA, 10344 bp, Human
cccagtccagacctggccttctggccttcgaagctgtggggagccctggcccagagccccctctggagcccccagacttaccccaggccctccactgagatcaagttttgggagcagacagacaaacatcatccctcacagacaggcattccgttggctattctcttgcaaacagaatcaagcactagaccagcagcatgagcctcaggatactcaggccaggcccagaaaaacagaccctgaaggggagcttagggcagccttcctgcacccctccacaaatcactcgccacctcctctgcgtctttctgccagccagccccactaaacaaagcacatccctcaatcttccgggctcggggagggatgcacgatgaagctggacgcctgagttccccagaggaaggaggaactagatacctaggtccctgtagggggcccttggtgcccgtctgaggctcagtctttgaggggattgcagaggggggttgctggagctccttttagcgtctctgaaggggattctgtgtgaggggattgggactggggggttggggagcaggaagcagtccccaggggagccatccaggcccattcaagggttgagcacttgtttagggttagagctgccccctctggggaccgggattgtccagccaaggccattgtcctgcccccttcccccagtccctcccaggcttctttgaacctgaagtcagatattttttctccacaccccccaccccctggttttccccacccagggcctagggctggaggcctgggccagggaggtgggggagggagaacggggcctaccgtggtattagatgtctgagttttggttgagaggggagcaaggaacctgatgtgcaggttccatagtggagggggcccaaagcgggtgtcttatcactctgtttcagcaaaggttgggaaactgaggcccaatcagtccaaagtctggtcccttgaaggggaagtaggggccaaccccttagtctgttagatgaggagagtctggagtctgattctggaagacggaggggtggggggatggggggtggggggatatagcacggaggccttgtctggcagtctactcttgaagatggggtgaaatttggcaggctgggcagatggtgccaggcacccaggctgcggggtggctggatttggccagtatcgggatgggaatgcctaggattctggatggatcgggggaaggcataagggagcagctggccattgtgcttatggctgttgatgcattgagggatagcgccacacacacattcaataaatttgaggagctgagagggtgactggcccctgaaggcacagtgccagaggtctgtggagagggggtcaagcacctgggttcctgaagaacatggaggtgtgggagtgattccagacagctgggatgtgcagagcctgagagagtgccagggagcgggttgggagttgaaagttgggtgtggtggctcacgcctttaatcatgacactgggcggcagaggcgggaggatttcttgaggacaggaattcaagaccagcctgggtaacatagcaaggccccatctctactaaaaataaaaaaactaacagggcacagtggtccaagcctgtagtcccagccacttaggaggctggagcagaaggattgctttggcccagtagatcgaggctacattgagccatcattgtactccactgcactccagtctgggcaacaaagtgagaccctgtcttaaaaaataaaaataaaaaaagtttctgtgggggacctgcactgaggtcctggaggggcgccagttgtgtctcccggttttccccttccacagacaccattgccaccaccattaggcaaacatccttcgcctcagtttctccccccacctccctctcctccacccatccagggggcggggccagaggtcaaggctagtgggtgggactggggagggagagaggggttgagtagtcccttcgcaagccctcatttcaccaggcccccggcttggggcgccttccttccccatggcgggacacctggcttcagatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggtgaagcaggagtcggggtggagagcaactccgatggggcctccccggagccctgcaccgtcacccctggtgccgtgaagctggagaaggagaagctggagcaaaacccggaggaggcaagtgagcttcgacggggttggggtgtggggaggtggtcatgacagggcagcctgatggggaagtggtcacctgcagctgcccagacctggcacccaggagaggagcaggcagggtcagctgccctggccagggaggggtgtgtatcaactgcaggcagccctggcaggcaggggccaggtgggaactggaagctggatttcgaagagacaactgcaggtgagggcagagcggcctgggagagtcggaagctggcccaggctggcctttgctctgtctggcccagcccttgtcagggtctctcacatctcctaggcctgcccagggtctggtcactcattactggcccagcaccagacccagcttggggttggtttgagccccttttcccacccttagtcctgcttgaaaatttgacccttatcagacccaagattttggccttagggttaagcatagcctgagggtaaaaacagtgctcattccaggattattgttcctgaaagtctagggtgtgactcgtttctgataggatctcctgtttgggctgtgtgtgtgcgcgttgtgagctgggtttacctccagtcaagtatagggcttgtcttccccggatctctgcctcaggccaatgactggccactgtgttaaggtgcacaccctggcaccccttgtagaaagctggattttgattgacttcagcctcagttccaaagttgtaaacaagaaaaatggtgagagatttctccaggccatttgcaaatatagagctgctgcgggattgaaggcatccagccctgctgaggactattaaagatgtatcttccagtcctccaaggcgacaagtgtaagcaattagagattaaatactaagccttgagacctcacagaaaggtgtgactggtttctggagtgaccgagaagccccaacctcttcgcaggaggtcactgctgagccttgaatgataatggctggcaattgtggtccacttcctaagtgcctggctgtgtgctccgtttatacatcattatctcattaaccagcacaaaatctcctagggggaggtattattatcctatttaacgggttttaactgctaaatgatgaagcgaggatttggaccagtgtttattccaaaaccccaaaacagaatttggaaaatccaggatagcagagggcatttatcagtttgagttattggctgagcagaagttggggatgaaaacagcctatttgaaattgatatgatcaagcaccattgaaacacttccttgaggcttcaggactacaaaaaggccttgtttttttctcactagctgtgcacctctgtccgccggcagcctcatatggcatgccccagggctcagtccttcaacctctgctctatctacccttccttcctctcacccaccctcaaggcttaaatgccatttagacaccagatgactaccgcgttttctgtctcttgtgatggctccctgaactgctccaccctgatcacccagttgctcaaggccaaacccagtcatcctcagtttctttcacgtcctacatcctatccttaagaaacatcctgaatcaatcacaacctaaccctggcctcagccaccatcatctctgctgggattaccgcagtagcttctcaaattatactgcttcctccctactgtctgtggccaacacgtcaactagagtcagtgttttaaaaggtgtggccaggcactttgggaggccgaggcaggcgaatcacctgaggttgggagttcgagtccagcctgaccaacatggcgaaaccccatctctactaaaaatacaaaattagctgggcgtggtgacgcatgcctgtaatctcagctactcaggaagctgaggcaggagaatcgcttgaacctgggagatgtaggttgcggtgagccgagatcgcgccagtgcactccagcctaggcaacaaaagcgaaactctcaaaaaaaaaaaaaaaaggtgaggctaggtgcggtggttcacacctgtaatcccagcactttgggaagccaaggtggacagatcacttgaggtctcctgaccagcctggccaacatggtgaaaccccatatctactaaaaatacaaaaattagccgggcatggtggtgggtgcctgtagtcccagctactcaggcggctgaggcagaatagcttgaacccagaaggcggagattgcagtgagccaagatcacgccacagcactccagcctgggcgatagaacgagattccgtcttggggggggagaaaaagggtgagagatcatttcacttggactaaaacaaagtcactatgtctgcaacaggatctacctagccaccagaccagctttgggctctggaaggcccacttcagggccttgccacattagactcttgtcctttgctcaaacaatcaccttctctgtctttaaaagtgtcaccctcctccataatctccttccctcctttaccctactcctatagactgctttattttttttttaatttttgagatggagtctcactctgtccctcaggctggagtgcagtggtgcgatcttggctcactgcaaactccacctcctaggttcaagcaattctcctgccccagcctcctgagtagctgggattataggggagcgccatgatgcccagctaatttttgtatttttagtagagacagagtctcactatgttgaccaggctagtcttgaactcctgacctcaagtgatctacccaccttggcctcccaaagtgaagggattacaggcatgaccactgcgcccggactgctttgcttttttccataatatatatatattttttaaatagaggcagcaggggtgggagaaggggcggcacgggtctcactatgttacccaggctgctttctaactcttgggctcaagcagtctgcccaccttggcctcccaaagtgctaggatttacagacatgagccactgtgcctggccattttttattttatttacttttttatttttcagagcaggagtggaagtttattattaaaaagttatagggcagggaaaaaaggaaagtgcacttggaagagatccaagtgggcaacttgaagaacaagtgccgaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgaggagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttctttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcatgagccaccgcgcccagcaaagaacttctaaccttcataacctgacaggtgttctcctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttggtgggttcccctctgcagattctgaccgcatctcccctctaaggagtatccctgaacctagtggggaggggcaggggcagactctaccctcacccatgaagaggagtagggagagggagaagatgcttgggctttgagctccctctgggaagaggtggtaagcttggatctcagggtcacaagggccctgcgtgctccctcattttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggaggtaagggtgggagggggatacccggggaccttccctttcttggcctaatttccattgcttccatcactggctcgtagctctccgtctttggtgcagtggttctcagtgggatggagtgaaattcctcagttctgctgggataaggtccagagccaacccttccaggatcctgccttttcacaccaccacctggctctgctgacacatctagtcacagacccctgtgatgctgttactcagcaagtccaaagcttgcccttgtcacccccttcccacctgcacagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtgagtgccatgtctctctgcgggctccatctctttcccctgtcaccacctcgctttccctagctctggctcctccaactgctctagggctgttggctttggacagaatgtccaagcagtcaggcctgtctcagctcattctctaatgtcctcctctaactgctctagggctgttggctttggatagaatgtccaagcagagtcaggcccgtctctcagctcattgtctaatgtcattctcctttctgtcattcactggcaggtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacacttatcttggtttgtccttcagttactgaggtggggatgggaatatccaatgctcatacccaagtgaccctgaaactaaggtgccatttacactccttaaggtcacacaacatcagagggagagctgggattgcagccaagtttatttgtacagggccctgtgataggctagttcccaaaagcctgtgatgcaagaacttttgcccatagactcagtcaccatgtagctgttacctgttcagagctggctttttgctttcccaccctactctggaattcttaaatggctttatacttagaaatcatcttatttctgttgaacctagatcaccccaaccagaaacttctattaatactttgtgctttcttgataccagggtctatttggtttccacttaaggtttttgcatactctgcccataagtgactcattagttactcaagttttattcctggctctgccactagttcattaggggtctttgccccagagtcatttcttccatgtaaaaaaacttgggctcattaaatctaggtaggaaagggcggatgtggcaggttttaatagaacaggtcaagataaggctttatttctatagaaatgatgctttgacaatagtttggcttggtgtaaggctcacaaaagaaaatcacatgtaccatgtgtgggttaagcggtttgattcacactgaaccaggccagcccagttgccctctgctgtgtccacccgtggagtggagctgtgtcacagccatcacactggtaaactgctgtagctggtttaccaggctttctcttgccctgacagtacaggtgaagcctgtaaataaatcttctgctatctttgtgaacttaaccaaatcccagttaccttatttaaatggcaatagatctgttttcccttaaactagaaaccttaattacctgtattcctacctccagctcaacccatatatttgcacctttccagtaagcaggtttgtatttccatctctccccttcccctaagattctgaattagttctccagaccttgccaagcacattctccctggaaagcaaggaatatcacagacccacaagaagagtaaatgcccaggagtgaatgaagcggcttgtccttgacttggaaataaaagcaaagctgtgaaaagccaggtcgctacgattttgttggcagcaggactagccacagagtagggaagttttggggccaggccctaggttttcccagaatgccttgggtgatgccaccaagaaccttaagaactccctcttacattttccatcggttgcaggcatggcttttgcaactgataggtgctctgactacagatattctggtgtccatggcaacatggccttatggcttgtaatagtgggaacttccagctcactggcaatttcctggaggtggcaatatctttggcaggaaaccatctcttctgtcttggccaccagggtctgctccaggccctgaatgagtccacatcaatccatccttcttccctgtagtcattccctcttggggagggaagggaaggggggtatttatcagacctatttgctcgctgctgtgtctactcatgggcaggtgtgtccgatggtgccttggcggtggaccttaggtctgaatgccagcccggcaccctgggcatcggaagtcggcctccctggcagcctggatgctgcagccaacacaggccacatggaaccagacgtcacagccatcacactgaacccaggccactgtctcttcctggggcaggcagcaacaaggagctgcacagggctccccgcccccaactgcagggggagccatgggagcgctcactgggtacttccgaggacggccacgtcgatttctgaaggaagtgacacagacacaagggtcaccggaaacctgtaggagaaggcctagaccttgccaccctatggctggtcatagggtgaggccacagaggcacagtggtctgagaactaaggtgagcctggactctgtcc

SEQ ID NO: 14209 - DNA, 83210 bp, Human
  misc_feature (1)...(83210): n = A,T,C or G
gtctgtggaataggctaccataccggataaagctaagaggaaatctctaaaagtcactttcccagcccccaactaggataggaaatcataaacaataacatgtccccaaggggaatagtggagatcagtgcaacccttaaagacgtaatggttggtagtctccatcacattcctattgtcaccggtgtggctccagcaaaaaccagacaaattcaggaacttgacagtagactactgcaagttcaaccaagtcacagcctcagttgcagctgtggtatctttactacagcagattcttaagacctcaggcatatgacatgtggccactgatctggcaaatgcttcttttctatcactatcaggaaaggaggccagaaacaagaatatatatttacagtcttattccaggactaaataagaatacttttatcaaggcaacggggccaaagtaagaaagaagtacatggacaggcctcatggacagatggaaaggtaagatcgctaccctagcaaagggataatagatgggatttgtattcagatttctgataaccagtccatacattaggactatacctgattgaggcaatccaagttttaaaaaaaattccaagatgaagcaacttcacagacccccttctgtattcgaatcccatgagtataatgggatgccttttttaacggaatgtgatactgatcatgaatattcagtgttgctccccaaggaatgagtaaattctcctgcccccatgaactcaggaatgacgatgtgacttgttctcgccaataaactaggagaatgtgaaatgtgtcacttccaggcagccattttaagagctaaattctcttcctgactctgtaataatggaagcatgtatcaagatggcgcatctatcagcctaggtacctgtgtaatattaagaacaggaactaggacttatctttttattgccagcacctgatagaatgcctggcacaaagtagatgtttgtaaataatctttgatcaattaaatagggaataaaatttcataccacctgcaattagaaggaaagctacaggcaagcaaggaccatggctgtcttctcactactccatgggggagcctccagagagagcctttcacttgcgctgggatctatgtgcaccccttaacactttgtgccagactaagacactaccaagtcagttgaaacgacggagtgcaaactctggcaggggaaacagtattaaaccaaatctccaaattattttcaatttcgattcaaaactcatgaatgatagcttttttaaaaaatcagttttttaaaaaagcctaacttggggatattcgcccattgggcaaccaacactatgcactgtccctaacactgcaacagatccaggcaatcaatgcaattgtatgcgtttcttgttgtcgttgccactgtatttacacctcacttacacagggactggtaacccatgctgccttggcaagccaactgcactcctctgtcccaacaagcagggcaatggattgcgaagaggcctcctccgtccccaagcagctacgtcgcccaggggaagagagaaggcgggaaagtccaagagaggagaaaccaaggcccgcgcttaggtgggtgttttagtgacgagtctgcggttacagccgagcggagttgaaagggctgttagaagaatggagcagaagtcgcagttgggacgaagctgaagagagctggcattcgcccaggtctacagccagccacctggtaacccctgcccccgcccccagagccaatccagcgaaactaccgcgaattcccgggaattccctccaactccgggaaaactcccggaggggcggggcaagagtgggaggagaccctgcgcgcggccgccagcgctccgggatctcgagatagccgcagctctcgcgatctttctggagccgcacctccacgcggagtccgagcgcgtgtgctgagaccccagggtcgggagggcggagactgggagggagggagaagcccctttggcctgccttacggaagcctgcgagggagggtggtgtccactgcccagttccgtgtcccgatgcccagcgccagcgccagccgcaagagtcaggagaagccgcgggagatcatggacgcggcggaagtgggtttcctcctttcctgggcctgggaggacagacccctgggccgggctgcgccgagggagggaggagggggagtggggccctacaggtccttgtcggcacgttctccgcaggctgcgggcgtggggtccgggcgcctagagcccttgccccagcagtggggccagaccctctccggaccgcgtttcttgcgggggtcacctgggagtttggcctactagaagcgtgtccccggggtggggaggacgggaagaaccagccgccccggaagtaggagcgcggcgtcacacttgagtctctctgggttaggcacgtcctgcacgtaatgcacaatccctgggaaaattttaataagcactagtaatcgatatgtactcagccctcgtgttcctaatgctttagcaagtaatgacagtacttagcaaaaccatctgccaatatgtttaatgaccatttcccatgtgacagctttaaagaacacatgtcatttttatttactttctccctctcagtgacccggtaaggtaggtaataggagttaccgagaatgcatttgaggtgaagtgaccccaaatcacgtggataattcataacacccagtgatccttcggtgcttttcagaaatcaaagtttgaaaccatcctacaagttatgtgtgctgtagtactgttaagccttaatttccgtctggctccctaatttttctataaggagttctgagtttgtggtaagcaacatgagaagtaaggtcatcttagaatactaaatgaggaagagtcactgaaatattaatagtactaattatgaatgcaacttttttgtccttcacacaatttaatctccttctgttgccctcaggcttcattgtgtgactgtatctctctactctggccagggttatctttttctttaaattgttcagtaagcgccttaaacatgtctggttttattttggtgtaaacacaaaatccagcaccctcctgctctaaaggagaggattccaacaggtagctgtaaagtgacagaaacttaattgtttcatacagatcttaagttaccttgtaaaaactagggcaattatttttgtgtactcttaatctgcttaattacataaactatcagtgtacccttacagatagtataggtctagatacaaggtagacattgtggcagagttatgccattttatagctagaagaatcttagatcattttagaggtaaagtaagattgaaataaaggccacttatctatttaataagtatattttgttaacagattggaccctaggtcttctgtttcctgttcctaactctaatctgtaacaagaaatttgatattattatattgtcagtgtcaaactcctgtaacctggtatcctgaatctggtttttagaaacaggaagctggtgaattttttgatgatgttttacaaaaggaaagttgtagttagcttatacccagcatctccagtttctaaaaactgtggacatctggtgctcagaaagcttacccaaaacgttggttctctttgaacatttcttcctgtaataggaagttaataaaactgtggtacttcatcctactcccttcacagaggaaatttatgtccctgctttgaagtagtttcatctttttgaagaaggtagttaagatgtgttgtacatatgtgtaaattttatctgagaatgttattaagtatggtaaatccatctaggagtggtgatcttcaaaacaaactaaccagaaacagtacttttctgttttctgtagagtacatatgtaaatgaatgagagatttccacattatgaaactactgactttctgaattaataaaatgatcctgaaagttaaattcatttttatattctattattagtatttatgtgtttactgtgctcttagtgtttacataaaaagtcacgatgcaaaaaactttttttgtaggattatgctaaagagagatatggaatatcttcaatgatacaatcacaagaaaaaccaggttagtagctatgtgacagtaaataaagcttttttgctttctaattccaggaaagctctaaatgaaattttaagtaaggttggcataaatctgaaggtataattctgaaaagcttaaatgacattaataatccaagtagatgtcataaccctgtgtaaacattgtcagtttagggttccaactctagaaaaggaaaaaaaatgttattaggtattgtaggttaaatggtatgttttaaatggtagattatattttttaaatattcctaaattattaggtaagattcaaccgttgtctaggagataggagagtggctaataactgccttcatcacatgtagcctttttgcatgctttaataaagctacctcttttacttcccccaacccccacaactttacttctctgactgtttttagctattatttattcctattttgcttgactcttcccaaacatttatattttcacttattctctacagcatccttgaaaactaaggaaccaaagttgaaagataagaaacttgacttacacagagtctgccagacttgggattagaaccaaaggccatctgaccctagagtccatgggtccttccatcttacatcttctctggcttctttggcagtactatgatttgagttttaaagcctccacccccactccattttgtttactcgtagctttagtgtctgggaatgaaatgaattattcttagaccccagtctatcttttcttataaccgctcttttttgttagtgtatgttggcatctttatatttcttttttttttttttgggagacagaggctcgctctgtcgcccaggctggagtgcagtggcatgatctcggctcacttcaacttccgcctcccaagttcctacaattctcctgcctcagcctcctgagcagctgggactacaggcgcacaccgccacgcctcactttttttttgtattttagtagagatggggtttcactgtgttgcccaggctgatctcgaactcctgaactcaaggcaatccacccacctcggcctcccaaagtgctaggattacaggtgtgagccaccgcacccggccttatatttctttgaaattgacctgactcatgttgtttctctcagacctgtagattttttatttataaatgtttgcctttcttttacttctattctatatatgtaatttcaacagatttgtcttacttaactatttgacagtaatttttcttttggtagacacttcaaattacgtctctcactctttggtgcagtaattgtagacgtttacattcttgcccattggaagcactgcttccagtttagagggctgcctatgaatattatgctttggaaataaaacacctctaggttaattttattgttatatttgatttgccacatgatcacaaaatcacttttctttcccaggcttgttgggaaagaatacaataaaagaccaaaattcagagactgagttgggaggatcacttgagcccaggaatttgaaactagcctgggaaacatagtgagaccccatctctacagaaagtaaaaaaattagctaggcgtggtggcatacaccttttatcccagctactcaggaggctgatgggaggatcacttgagcctgtgaggtcaaggctgcggtgagccacgatcacaccactggacttcagcctgggcaacagagtgagaccctgtcaaaaaaaaaaaaaagccaaaatttctgaaaatcatttccaaaacataaagatgaaataaagtaattgagtacaggttgagtatcccttagccaaaatgcttgagaccacaaaagtgttttggactttatttttttggactttggaatatttgcattatatttaccacttgagcatccctaatctgaaaatccaaaatcctccgatgagcatctcctttgaccatcatgtcagcactcaaaaagttttggatttgggagcattccgggttttcgggttaggaatgctcaacctatgtaaaatagactatgagcaatagagtataggggatgatattcctctgccagggcaagcaggaggagacacttgagactttgttttcaggttaggtgtctttctcaactgtacttccttgagctgtaacacaaagaagctcactggagtttaggtctttaacataggcccaaagcagccattaacataattgctgttgttcttttgctggcaaatccacagacagttgcgttcttccacttagagagaaagataacctatgtatgtaaaattcggcctttggttttacctctgcaaaaatgccaattctttgctcaaggtggtttcctttctcatctgcttccatttctctgcattaatcactctgatgcccatgactcttaaaagtgcagttttcaaactgaaatcctactaccttggttgttactggttagccagtcatagtgatgtgagtatggcatgggcttcgggtatgttcgggtgtattaaaggttgagaacccctatgctagttaattgccatgccacaagaaagaagagccattaccctttttcttctccaaagtgctagtaaaattatcctaattatcgcatatctcttagacttctgcttttctgttttgtgtggttttgagttgtgattgcttggttagccattgctttttcagtcttggcattttcaaatctgccttttaaaatcttctgctgatgtgtctgtcttttctctttcacgctttcttttgcctgagtttacacagcagacttggaagttggcttaactcataaagtctgttggcagtgttttgcagaaatcctcttgtgatgccagtggctttaaaattcctctttcattctctttgcttttggctatgagaaccgtgttatttattctcctgtaaatcagattctctctgcagctgcatcttttcttcaataggcaaattataaatacatttagaaaaattcggtaagacatacagtatttataatttgactttatgtctcaaaaggtattctcgatattgtaatgtcatgtctattgctatgtttaatttaactaatacttaaatgtttttctctaatcaaatgattgcatttagaagagtagcaaaaatgattgttgaatgttgcgttgtatacacatctttacataacagttgttttgtagctgttttcctgtttaggaactctagatgaatgtagtattttgtttagtattaggagcataatagttggggctcacttacagccaaaaggctcgatagggaaatgtatgagatgacatcaagcatgattggatcttggggctcaggaagcatctacaggcctttctctctccagcttttggctctgtttcctttaggatattggcctccttctcgaatcctgcaaacatagcaggaaaggtgaaagctgcagccctgggcctgcaccatgtcagcgcagcaatcccaggaaagagagcttcattcccagcatctgtatatttagtcccagagaaagacttgcattagctcagttagagtcactgcatcctggggaataggatactgcgactgttcagacttggtagagactagctgacttaggtactgtggcaggcaggcaaaagttccatgtcctaggcaggataggctgtgtttggccttacaagtcattgaagtgttcagatttgcattttgaaactgtctgacttcaaaggagactgaattagaaggggacacagggattgcagttaggaagctattgctgtagttcaggtgggagacaatagcttggtttagtatggcggcagtgaagatggtagagaaatagacggattttaaaaatatgtttagaaagcacagttcacaaaacttgaggcaaattgcacatggaacatgatagagaagacagtgttgtcaaagattgagaattattcaggatggttccaagtacttatgctagctgtcaaaaataattatgatctctttgtaaattctgaatttaaaaattattttactatataaaaatcgtttactgttattacagatcgagttttggttcgggttagagacttgacaatacaaaaagctgatgaagttgtttgggtacgtgcaagagttcatacaagcagagctaaaggtaggattggtttcattattaaagctctttcggtaaggactccgaattttttgtcttacatattcctcacagaccaaagtaaatctttaaaaacaaaacaaaaacatgtaacttttctttcttaaaagtcactgtaaagtattaacccatggttaatcaattttagattcctgtaaaacatccttacaaataatttgaccctaaagactgatgaaatctaagacttcaagctacttttctagcatcgctctaaagtttaattattttcagctggagaaggagtagctaaaaaaaaaaaaaaattgaaaaaaaagagtaaactttaattatttaagtgaagagtgtttttgagaaacttcccgtttgttaatatttttatatttgtaattatctagatgaggagagaagtgaacaaaagataagactgggcaattcaatacagtaaccactgaccacatgcagctatttacatttaaattcagtaattccgtcacactagctgtatttcaagagcttaatgaccacatgtggctaacggctcccattttggacagacagcacaaatacagaatattctcatcatagaaagttctttcagacagtgctaaaaatttagcctcaacaacagagaagaaacgttaggatcatttagacagaccctgttcttatagaaaattggcctactgtagtgttcagaattgtctaaaaatatcaattgacacactagtttataactttatacttttcatactttttcacatttgatcatccctgcaagtttgtgaagtaggcagaacaagcattcctattccactttataaatgaggaaacacgttcagaatgaagctacttgcccaaagtctcatagtaattggtggagtataaacagaagctagaagctttctaagacatctccgtctctttagcagagttctttgcttctgtagtatttaatatgtcccatgataatagcattttttaattgtgttttataatatttttattgtagaattaatacatgcccattattttaaaaattctactttgcttctatagtatttaatatgtcccatgatatatagcatttctttccttttttctttttttctttttttttttttttttttttttgagacagagtcttgctctgtcacccaggctggagtgctgtgttgcgatctcggctcactgcaatctctgcctccagggttcaagtgattctcctgtctcagcctcccaagtagctgggattacaggcatgcgccaccatgcctggcaaagttttgcatttttagtagagacagagtttcaccatgttggccaggctggtcttgaactcccgacctcaggtgatcctctcgccttggcctcccaaagtgctgggattacaggcataagtcactgcacccagccgatagagcatttcttaattgtgttttataatttttttattgtagaattaatacatgcccattatttttaaaattccagcactttatacatacatttcactcttagggccaccattgttaagagtttgtctattctttcagtatcctcccctgatgaatactgacagactttgagaagagtactggtggagttttaaattttcaaataatgttgatttgccttcctgaaaggttgggccatttattctgccaatagtcagtcacattgtattataatccttcatttactcgtctctctcccgttatactgagagcctttgttctgtccaaatggggcactttttcctaaacatagtaatttagcaaattaaaagatagaatgcatgctacaagtaagcctgaaccaagaatatttcccttcacacccatccctttattttacgactgccatgtctgtttcttcttaacagttaaaactcatgagtgatacttcccagtggttatgaataagaccttttcagtgagacagatgtgtgtttgaatcctggatttgtgcttacaatctgtttactctacgcaaattgcataacctttccaatcctcagtgtcttctcttaaaacaagtatatattaatacctagcttataagatgttatgtagtaatatttataaagtatttagctctatgcttggtgcagtgtaagccttcgataattgagtcatgttaatgagcatgacagttacttacttgccttccatcgtagttttttgtgggtcttatttcctgttgtcagctcttggaaggtgctactgcttattttcttgctttgtttggtacacaacacataataagaaccctaccgaataatagatgaataaaacaggtgttttatacacatataatagagcattgtcttctgggtcttgttcttgctgtccagtagctcactctaattgagatcagcatgtaagtatgaagcatcacgtaagtgaaaaaatatacaggttgagtatcccttatccagaatgcttgggactggaagtgttttggattttggattttttttttttttttttttggaatatttgcattactggctgagcatcccaaatctgaaatccaaaatgctccaatgagcatgttttttgagagtcatgtcggcactcaaaaagtttttggattttgaaacattgcacattttcggatttgagaatgttcttcctgtaccatctgctagtgtttttttttccatttgtgacaaattattttagtctcttaattgatagtgcctcctgcctcaaaacatgaaacaaattgcaaggtgtaaggactttattgatgatatgagctaatcatggtgggtggatagggagaatttatgagtgtcaatgttatgaacagactgaacggtttaaaactttcttaagagtttttaattgaggaatttcatagcactttttattagtatattaactgttattctatctcaaaaaaataaattatttatgggtattggggaattttggaggggctaaatgctaattgcactattttaaaactcaaacagcacaaaaactaaagaataaagcagaaagtgtaattcacttgttctgctcccaagagaataaaaacactgtgaaagtttgaaatgatagaaattgctttaaacaaaaattgatactttttcttttacaaaagtgagttcatatgctgtatcagtgttttatgtagctctacatgatcatttacaatatttttaatttgcaaaattgaaaaatttattctagattataaaagtaataaccattttttgttaaatactcaagcattatagaattaaatcaggtataaagtggaaaactgactgtaatccttctttacagatttgtgggtttttttggttggtttgtttgaggtggagtcttgccctgtcactcaggctggagtgcagtgaggcaatctcagctcattgcaacctctgcctcctgggttgaagcaattctcgtgcctcagcctcccaagtagctgggattacaggtacctgccaccacatccagctaatttttgtatttctagtagagatgagggcttttttttttttttttttgagtcagggtcttgccctgtcacacaggctggagtgcagtggtgtggtctcggttcactgcagcctccttagctaggactacaggcatgcgccaccatgcccagctgatttttgtatttttagtagagacaagggtctcaccatgttggccagggtggtctcaaactcctgacctcaggtgatctgcctacctcgacctcccaaagtgctgggattacaggcttcagccactgtacccagcctcagatttgtttttatgaggaagttgagggtcaatgtgagtgtatatgtgtgtttgagctaaaatttttataatactctgtattattttataacttgcacttttctttatcttttggatatcttttcatgtctgtgcgtataggttttttttgtttgtttgttttttgagacagagtctcgctctgtcgcccaggctggagtgcagtggcacagtctccgctcactgcaaactccgcctcccaggttcacatcattctcctgcctcagcctcccaagtagctgggactacagacacctgccaccacgcccggctaatttttttgtatttttagtagagacggggtttcactatgttagccagaatggtctcgatctcctgaccttgtgatccacccacctcagcctcccaaagtgctgggattacaggcgtgagccactatgcccggccgcatcattgttttttaatggtttcatagtatttcatagtatggctatatttttttacatatattttatttttctcatttgtataaagttcagatttatccattgttgctttaatttgtgtttcagtcattggttagattaaacttcttttcctgatatgttaactattttgaacttcttttatatattgtttgttcttgccctgttcctattttattaaaaaagaacaaataattttctccaagtctgtttgcatttcagttttttgaggcgaagagaggcattacaaatgatgatcattatgtccttttctttcaaatgtttgtatctcatttcttgtttctctttgcaatactagtaggttctctagtacttcagggattcacacaatgaagaatttttgaaagagcagaaattccagttctaaatgaatgattttgagtttaaggttctacataaaatgtcattagaaaataaatggcaaagttttaaaaagtagattaaaagtagtttcccagccaagttttctgtttgtcaggaggagatgttgaattttatcagacctttttctagcatttcttcccttcaaaatataattgtgttatgtgatgtatatgtagagaggttcattatactattcactctgcttttgtgtttgttggaaattttctgtgtaataaaataaattttaacgtagttgatcctcattattcgtggactgcatattcgcaaattcacctactggctaaaatgtatttataaccccagaacacttgcagcacttttgtggtcattctcagtcatgccagacctgtacatgtgcagagtggcagagtatttgcgtcatccagtacacacattcccaattaaagtcaaacacagtaatgttctgccttcttgtttcagctctcatactgtaaataagcgtccctttcacagtctctttaatgccacatttatgccttttaaaaaaggacttttaaaaacttttgtgtgggtacatagtaggtgtatatatttttggggtacataataggtgtatatatttatgaggtacttgaaatattttgaaacaggcatgcagtgtgtaataatcacatcatagaagattgggtatgcatcccctcaagcatttattctttgtgttacatacaatccagttatattcttttaattatttttattttttaaattttatttattttttgagacaagtatggcccaggctggcgtgcagccgtgtgatctcaactcactgcacctgtggctcctaggctcaagccatcctcccacagcctcctgagtagctgggactacaggcacatgtcaccacgcccagctaatttttattttttattttttcattttttttgtaaagatggggttttgccatgttgcccaggctggtctgaaactcatgagctcaagctatctatccacctcagcctcccaaagtgcttggattacaggtgtgagccaccacgacacccagtcattcttttagttatttttaaatgtacaattattattggctgtagtccccctgttctgctatcaaatactaggtcttactcattctttttttttttggtacccattaattttcccagggccccccaccttcaacccctattacccttcccagcctctgttaactatctttctattctctatatccatgagttcaattgttttgattttaagatcccacaagtaagtgagaatatgcgatgtttgtctttctgtgcctggcttatttcacttaaaatgacctccagttccatctatgttgttgcagatgataggatctcattcttttttatggctggatagtactccattgtgtatatgtagcacattttctttatccattcatctgttgatggatacttaggttgcttccaaatattggctgttgtgaatgctgctgcagtaaacatgagagtgcagatatctcttcgatacactgatttcctttcttttgggtatatacccaacagtgggattgctggatcatgtggtaactctatttttagttttttgaggaacctccaaactgttctacatagtgattgtactaatttacattcccaccagcagtgtaccagggttccccttcctccacatcctcaccagcatttgttatttgactttttgatataagcctttttaactgaaaggagatgatacctcattgtagttttgatttgcattcctctgaagatcagtgatgatgagcactttttcatatgcctttttgccatttgtatgtcttcttttgagaaatgtctatttaaatcttttgcccattttaaaattgtattagatttttttcctgtagagttgcttgagctccttatgtattctggttagtaattcctcgtcagatgggtagtttgtaaatactttgtcccattctgtgggttgtctcttcactttgttgattgttacctttactgtgcagaagctttttaacttgatgtgatcccatttgtccatttctacttcagttgcctgtgcttgtggagtattactcaagaaatttttgcccagaccagtgtcctagagggtttccccaatgttttcttgtagtattatagttcaaagtcttagatttaagtcttcaattcattgtgattgatttttatataaggtaagagatgggatcaagttttagtcttttgcatatggatatccagttttcccagcaccgtttattgaaaagactattttcccccatgtatgttattggcacctttgtcaaaaatgagtttactgtagatgtgtggatctgcttctggattctctcttctgttccactggtctgtgtgtctgtttttatgccagtaccaagttgtttttggttactatagctccgtagtataatttgaaggtaagtagtgtgattcctccagttttattatttttgctcagcatagctttggctattctaggtcttttgtgatttcatgtaaattttaggatttttttttctatttctgtggagaatgtcattggcattttgatagggattgcactgaatatgtagattactttgagtagtatttaacaatattgattcttcccatccatgaacatggaatatctttccattttttgtgtttcctcttcaatttctttcaatagtgttctatagtttttagagatctttcacttctttggttaattcctaggtgtttaattttatttgtggttattgtatgtgggattacttttttttatttctttttcacattgttcactattggcatatagaaaaatgctactgacatttatatgttgattttgtatccttcaactttactgattactgaatttatccgttctgataggttttgctggagtctttaggtttttccaaatataagatcatagcatccacaaaaaaggataattttacttcttcctttccaatttggatgccctttatttttttctcttatctgattgctctagctaagatttctagtcctatgttgaataacagtggtgaaaatgagcatccttgtcgtgttccagatctaagagaaaaggatttcagtttttcctcattcagtacaatactagctgtgtgtctgtcgtatatggcttttattatgttaaggtatgttccttctatgcccagtttttggggggtttttatcatgaagggatttgaactttatcagctgcttttttagcatcagttggaaatgatcatatcgcttttgtccttcatcctgttgatacaatgtattacattgattgatttgtatattttgaacctccttgcatccctgagataaatcccacttggtcacgatgaatgatctttttaccgtattgttgaatttggtttgctagtattttgttgaggatttttgcatcagtatttatcagagatagtggtctgtagttttctttttctgatctatctttggttttggtgccagggtaatactggcctcttagaatgagtttggaagtattttctcttcctctgttttttggaacagtttgagtaggattggtgtgagtcctttaaatgtttagtagaattcagcagtaaagccatcaggtcctgggcttttctttattgggagactttttattacggctttaatcttgttgtttgttactggtctgctcagattttggatttcttcatggttcaatcttggtaggttgtatgtgtctagaaatgtccatttcttctagattttccaacttattggcatatattgcttatagtagccactaatcttttgaatttctatggtatcagttgtaatgtctcctttttcatctctaattttatttatttaggtcttttctcttttttccttagtctggctaaaagcttgtcatttttgtttatcttttcaaaaaaccaactttttgtttcattgatcttttatattgtttcctttatttcaaattcatttatttctgctctgatctttattagttcttctgattttgggttcagtttatacttttctagttctttaagatgcattgttaggttatttgaagttctttttttaggtagatacttataattttcctcttagtacagctttcactgtatcccatatgttttggcatgttgtttccattatcatttgtttcaagaaattttttgatttccttaatttcttcattgacccactggtcatcccagagcatattgtttaatttccatgtgtttatatagtttccagaatttctcattattgatttgtagtgttattctgttgtggtccaagaagatgcttaatgggctctttttttttttttttttttttttttgagacagggtctcactatgttgcccaggctagagtacagtggttattcacaggtatgattgcagcgcactgcagcctccaactcttggcctcatacaatcctcctgcctcaccctcccaagtagctgcgactgtagttatgcaccactgtgcccagcttgcttttgccttttaaaatggccccaagtatggttctcaaatgtttctaaagttcggaagcacaagaagactgtgctgttcccttaagaagaaaatacctgtgtttagatatgctttgtttaggcatgagttacagtgcccttggccatgagttaagtgttaatggctcaccaatatatattaaggtatctttaaacagaaacacacacaaaagaaggttatgtattaatcagttggcaaaaatattgtgaccataagcgtgaagaaacctaaccctaaacttccctcaggagcaatgattcagtatgccctaattcagtattgtggcagctttacagagcataacttctataaataacaagaatcaactttatgtaattgcagtgagtgacaataatgtattttataacattgaaccatttttagattctttgaataaactcaatttggcaaaggtgcgggtggcttttttttttttagtatagtgcttgtttaacttactttttgtggaattttgcatttataatctggtcttcatcatttttaactggaaaattctattctaagttataatacttaatgtaagttactcaaataatacattaatacttgcacacgaatctttaaaagaatacagaaataatgatactcccttttttcttctatactacctatcctctgccccaaccttttctattcattcttttttttattattcattcttaatttgttctgtgtctttccaaatctttataatgcacgtatgtgcacatacacacccacacacacagtttgttttattttggatgtgtgtatgtttaatatgtcttgttatactttacatattatttttcaactttttaaaataattaacagtgtttcttggaaacccttccatgataactagttacagatctacacgaggtagtatttctccaagatgggtgtatagaaatgaaattgctgggttaaagggcatgcatatgcatttttaaaatttctaatactagatcatcctcccaagaggttgtattcaaatatattcccacaggtatgtcacagtaccactttctccacatccttgctgccatggtttcgttatttttcccatgctatattgaaacttaatcctggtcaggcacggtggctcacatgtgtaatcccagcaccttcaggggcttaggcagggtggatcacttgaatccaggagttcaagaccagcctggccaacatggtaaaaccccatctctactaaaaatacaaaaaatagccgggcatcatggcacacgcctgtaatcccagctacctgggagtctgaggcatgagaatcacttgaacccaggaggcggaggttgcagtgagctgagatcgcaccactacactccagcctgggtgacagagtgagactctgtctcaaaaaaaaaaaaaaaaaaaaagctgaatccccagtgtggcattgttgaaaggtgaggcctttaagaggtgattgggtcatgagggctctacccccttgaatggattatcacaggagtggcattagtgactttataaggagacctaaactagcacactcagcttttcaccttgatgccctctgccaccttagggctctgcagagtccccaccagcaagaaggcacttacaagttgtgtcccttcaactttggacttcccagcctccagaactttaaaaaaataagtttgtttccatataaattacccaatttcagatactctgttacaagcaacagaaaacgtactgagacacttgtcagcagtgattgtcagtgttttttatttctgccaatgtagattatctttatttattttttgaaacagagtcttgctctgttgcccaggctggagtgcagtgatatgatctcaactcactgcaacctccacctgccgggttcaagtgattctcctgccttagcctcccaagtagctggctgggactacaggcatgcaccaccatatccagctaatttttatatttttagtagagtcggggtttcaccattttggccaggctagtctcaaactcctgacctcaggtgatctgcccaccttggcctcccaaagtgctgggattacagatgtgagccactgcccccggccgtagattgtgtttaagaataaaatcttgtgctctgaatttgcaaaaaccctgattgctagtaccctcttcttcctatatcttatgtacgaaaaatcatatcaataaatatgacttacttgggatcgtttgtgtgctttaaccccaggagtaatatattaaagctgggcttcaagaaacaactcatggtggcagtttctagtagagcaaagccctgagaaactgtgaataaggaaatggaagtgtcaaaatcctagtgtcaaaagtatgacatttagaatcctataatgcaaaaataagagtctcttcgtataaaaaaacaaaacaagaaaagcctgtatattttttccttaagggcagtgtttcagacattttttaaaatgaaaatcagatttcttatggtaggtttatatataacatccctaaagtgaagtgttttaaataggagcaaggagaaatttcttaccttaatgatatgcttaaaattagtttctttcaagcgtgaaacatatgagcataagtctgcatattgaaagagtaattggaatgtctgtcattcctttcaaattttatacgtaccatgtggaaggcactggcacaaaataattatttcagcactattcttcctaaaaacttacttacacttccaaaataacttcaacttaaatctatgcaggaacatttcaggggaagcaataagtggaaaatacttcagaacgttgagatctttgttgttttaatccctaattgattaatacaaatcatgaaggaaaatattaaggttggatattaggaagttaaggtacattatctaaataatgaatccagggggcttagcaagctaaaagtcagcaggaagagatgaaaacataggattgcctcacatctttgatactctggttctcccatgaaggcctatttcattgctgagccatcaccataatggagctgagaagaaactttttgtcctaactacctaccatgtttgttcttcagctcagaaataaagacttcacgataaaaaatttctgactttacatttttctaaaacactacatccatataaacttaagaaataaactgcttcttctgaaaacttaatcaaaatgcagcacaaagttttaagtgttaagaatttaaatttaaaatatcaaaagatagaccaggcttgtaatctcaacactttgggaggctgaggcaggtggatcacttgaagtcaggagttcgagaccagcctgaccaacatggtgaaactccatctctactaaaaaaatacaaaaattagttaggcatgggattacacgcttgtaatcccagctactcgagagactgaggcaggagaatcacttgaacccaggaggcagaggttgcagtcatcgtgccattactctccagcctggacaacagagcaagactctgtctcaacaaaacaaaacaaaacaaaaacaaataaaatatcaaaagatagttcattcagctgttttgaacactgactttgttttctataaactgtcttttgtgttggaaagttccaagaagaaagattaataatatttagcagttgattaatctgccctctaaagttcatataccagcttttcaagtgagaactttttactaaactgaggaattatatatttgcttcttaaaatagaaagtaatttatgggtatggtaaaaataaaaattccagtagtagaaaaagatatggaaatagaggtctcacgattctcctccatctcaccacagtctcttccctgcaaaatagccactgttctttcttgtgtgttcttgcagaaaaaaaaaaaaaaatacatttacagacagacaaaatatacatacagacatgaccatattttttgttttttaaatttgcacaaaaaggatcatgtacacactgctcctgtttatctctcagcatgtggaaggtagtgccttgtaaaacatggaactaagctaatcatgcagtaaggtgtgtcaccaaccagagccaaagaaagaacaattttgtttcctaatacatgacaagagcttggtctcaaaagtgcttcatagagaagtagtctgagtggacagttctatttaccagggagccagtactgatggtttgtttgtttgtttgagtcctttaaaaatcattttaagtggaccatcaaggttcttgtattttaaagtgctttgaacgtagaaagcttgaggaccatagcattagtcacaagtagttctgtttcaatttccttaacatatattctaaaaaatgtatttattgagtcaaagataacgtttttaagccttttaatgcttattgccaaattgttctccagaagcattacacaaatttaccctgccttcagcaagttataaaggaacggttttacgattttaattctcccaagcattgagtaataattcgattttatattttgtattttttaaatctttgctcatttgagaggtaaataatctgtcgttgtttgcttcaacttgcattacttgcattaccagtaacatttttttccttatacggtatttacttactatggtttttttcttgttccttcagattatctgttttggtctattgcctgtttatctattgggatctcagtgttcttttctcataaatctttaagatccttatgtattaaaaagattaatttatataggttatatgctgttcagcacttattttttctcagtgttattgttcctttgatttattttgtatatagatgttctttcattcttaaacttagaaagttttcccttcctccgtgatatagtttaatattcagttccattttttactctgtattcgttggggtgtttgtttaaatttcgtaatgtcctgaattctgtttagaattaggatctcctttatctaatacggtctattatcaattttttcttatgttctattgatctggttatttttgtactggcacacttttacatactatataggtttttgtaaaacaatatgctcatagactgttctcactacttcattcccttcctcccccatctgttgcctttttttaataagaaaaattttttagaattaaatctaataagcacagtaaacatttaaagggtatagtgaacattcttcacttctttttttttttttttttttttttgaggtggagtcttgctctgttacccaggctggagtgcagtgacacgatctcagctcattgcaacctccgcctgctgggttcaagcaattctcctgcctcaacctcccaagtagttggtattacaggcacctgccaccacgcccggctaatatttgcatttttagtagagatggggtttcaccacgttggccaacctagtctcgaactcctgacctcaagtgatccgcccacctcggcctcccagagtgctgggattacaggcgtgagccaacatgactggccttcacttcacttataaccgttgattttctttcttttctctagcaggcatgcaaatcttaggaggtacatttgctcctatgtttagctgtctaaaacttcccgggttctacttactgcttgtgtttaattttgaacttggccaaaatttcctttcagcccttacctttcttctgtacctacctgtgagtgtatagttctcttaaaaaatttttattctgattagaaaagtagtgcatatttattgtagaaagttcagaaaatacagaaaaatacagggacagaacaatttcctataatttcaccattcattggtagccacattttggtggtttttttccccatatgatcaatcttaatatacttcttacacaaacaaaattgggattacacgttacatatggttttatcactttttcctcatgtaagagtctatcatgattttctaacaaatacttacgttcgtgttcccagcgccctgcatactttttgtatatagtcatccagctgtgaaaaaggaatgataattaatcatcaaataagtagtcagtggtagtggtgttactaataatagtcattaaggccaggcgcagtggctcacgcctgtaatcccggcactttgggaggccaaggcgggtggatcacctggggtcacgagttcgagaccagcctgaccaatatggtgaagcccccgtctctactacaaatacaaaaattagccaggtgtggtggtaggcacttgtagtcccagctactcaggaggctgagacaggagaattgcttgaacccagaaggtggaggttgcagtgagccgagattatgccattgcattccagcctgggcaacagagcgagatgccatctcaaaaaaaaaaaaagaagtcattaataggccaggcgcgatggctcacacctgtaatcccagcactttgggaggctgaggtgggtggatcacctgaggtcaggagttcgagaccagcctggccaacatggtgaaaccccatctctgctaaaaatacaaaaattagctaggcctggtggcacgtgcctgtaatcccagctacacaagaggctgaggcaggagaatcgcttgaacccggggggcggaggttgcagtgagctgaggtagcgccattggactccagcctgggcaacaagagcaaaactccatctcaaaaaaaaaaaaaagtcattaatagttaacattaattgggctccgtctcaactttaaacatattataaaatccttatgattatgaaagaaaacctcatgactcttaccgtctccattttccagatgaagaactgagatataaagtggtttaataattttcccacaggccccttcataggaagtgataggatatgataccaggccttttgatttcaaagcttttacttttttttctaccagacacactaattgttaccccctagtgccgacccatagacttatcctgtgctcaccctttgtaagtcctttagagttctccattctttctccagggtctttgtgtagcactgaaattatcactggacagctttgtgaggcagctaggttggtgctgcttctgtctggactattagagtagctaatacactctgactacattatggcttagcctagcactgtcgtgtgcacattaccttccatttcacagtaacatacttttctaagtggggtaacgtggctgtggtttcagtagtagttcctaggaaaatgttatttttattcatctgcaagtttctctgtggtaataacctttgtccttccaatattttaaaactcctttgaatttgtttcctgtattaatacaacttcgttttttaggattttactttgtgactggatcatcctccaaagcaaaagggaaaattaagagtgttttttagtggttaaaaacctgccaatcatatatgactctaaagtcaatagattatgtctgtgttgacactttgtttgcaacctgtcttttttaacttgtgattgctatctgatttgcatttcaaaatactgtatgttgaaagtagtaactgtaagtctgcttgcatttttgctttcctttttctttcttcttttggttaaggcccattctaaatgtaaaatataatgctcagtttaaaaaacaaaatcttgtgatgttttacaaaacaatctgatgtgtaaagtggtcttggagagattaacccattttttatgaagaagtaatttcccagaatttgatcagagacttaagaaggatctgctttggaggaaaaagggatgtcacaaggatacataataacgaaatatattatgaataatgtttttcagaaggttaagaataaggagtaacagttctttatcaaagaagaaggaataaagaggcccaggatatgtaaaaataaaactggttatagggcttgaagaaaatgatctttaatagacaatataagttatttggagtaaaaaaaaatgcgagactcataaaatatgaaggactaggaaggtgataaaggaaaaatgaagaacgtagaacatgaaaggcactagcctgtcaatttaaatgctctttaaaatgtactttggtaggaagaaactctgtagatggaccaccccatagtgtttgtgtccttgtttttaagcactgtgttagcacttttgtggttgcagtattgaaacttccatagtagtacagtgcctttgcatgtggaatatactaactattgaatgaatgttgaaagtgatctcaagttacttgaaatttgtttaataaatcaatgcaatgacaaaataattttcttgatttagaagtttttttgaaattggtgatttgcctgtgttcttataacaagttgaaagcatttcttgttactcatcataggaacttgagtttctttaagggttgtcagttgagtgtgagtattttgtctgtggaagccaaatggatagtatacacatgcatgcgtgcctgatgagtatagtaaattttggcccacttttaaagtagagagcattttccttctttgtaaaacctgaagttgcgtgtccttaatacatttgtgttctttctgtctttttcagggaaacagtgcttcttagtcctacgtcagcagcagtttaatgtccaggctcttgtggcggtgggagaccatgcaagcaagcagatggttaaatttgctgccaagtaagtaagcaattatatcctgttgtcagaataaacaatggtgggaaccaagactcccaggggtttggaccattttcatacattaacatcaatgcttcgtttgtttaaaaatgtagttatttaaattgtcagttcagtgttgctgaatacattaaacttacaaaagagaaaatatggagcacaggcttgaaattcatttggaactgctgaagcagcactctctacagacaagtcacatttactttcaagtagagtaacaaaaagcctggcagcctcaacatagcagagcaactttattttgttgtgtttgttgagcttcatttcctccctccttccctccctcccccagtttgagatttgcatgttgagcaacaagttttctaaccaaaaaataaaagtatataaaataaaagaatgtagtttggcaaatgattgcctccagaaggaagtaaaacaaatgttttacaacttttagctttgacaccaaaagggtttaggagaaaaaaggtaaaacttgctttttcctcctgtaaaagtctgggctgtctggctcagagttcccgtagaagcagcacattgttttgttcagcttgcaggaggcagatatagagatagaagtgtggttgtgtgtgcagtggctctaaggtgatgagagctgttttacttggtagtggtgatgtggctaattttgtttcatgttttttttcaatttcatcagaattttatttccatgataatgatctcagaaaacatgagaaaatggatggtctttgtgttttaagtaataaagtaatttcatagtgtgtaagtgttttttaaaagaaagaattcaatcagagtaaatgatatattttttctattgatttttttaaatgtttgctttttagatgcatgctttctaagaatgagttaatacagatggaattatgaattttagaattggaaagaaacttaaaaattatctaattcaatatcgtaatttagctttcagccctccctgaccctctagcacaatgttatacatataaaggatgctcagcagctggttttggtttagatatttatcaaattacgtcatagtaatacctgcactcggatttaagaacttaagtgccatgaattgtatcgattcattgatgagatcagtagtattttaatactactaatacagtagccccacctctccctatctcccagtgctgcccagagatgaccacttttcttctacgtgtgtcttctggtaattaggtttgcttgtttcgtctcctggttagagtgtgtgcttgtggggtgcatttgtcttccaaccttttaaggttagtgtgtatcctatgaagtcaaacataaatgagcttggtccctagaaattttatctgcacagagaaccttctataaaagaaaaaaagatggtcctggaaaccgcagacatagatgctaaattctattaaatatactgaaaaatactggaaaaaagtcaacctcaaatcaacaaacaacttttgtataataatttggttttgaaaactaatacatgaagccgacagttacatagagaatatatttttccattaaactgcattataacctcggcgttacattcctaaagcttccagtggaaaagccttttgaaaatcccagttacccataatattcagtgagaggcattctactgacaagtggacggttaatccatgtgatgtgtttagaagcagacacgttaaagtactccgcaaataagttattcctattattttggatcttctcagaaactcctgggacttgactaaataacagcgattgactatatcagatgtcaaccatagcttaatagctaaaagagctactttcaaatggtctcccaaacagaacttagttcactaatgccctcataaaattaaagaacatctttttatcattattttattaaaggctttcatccaaatgggatgatatacgggcgatcttttttttttttttttttttttttttttttgagacggagtttcactcttgttgcccaggctggagtgcaatggcgtggtctccgctcatcgcaacctcctacccggttcaagcaattctcctgcctcagcctccccagtagctgggattacaggcatatgccaccaccatgcccagctacttttgtatttttagtagagacgaggtttctccatgttggtcaggctggtcttgaactcccaacctcaggtgatccgcccgcctcagctgttcaaagtgctgggattacaggcatgagccaccgcagccggccatgggtgatctttcttttagacaagggaagaatataggtaatttagcctagattttttaattcctgaagtggaactccataaggatctagatgcagttcaggcttaactaaattgtgacttgatttttttttttttaagcaaaggacatgcagctatttttagtccctttaaaaaatggactttatataaagtagcaatgtgtaggaaaaggttgagctgttccaaattataaaccttgtcactggttatatgtaagtgaatggagccaattttatacaataggttcaacatgtggtacatagataactattattaaacttttggcactagcatgttaaggaatcgagcctgaataattaccagtaggtgggttaatggcttttgctatcttgcgaaaaaggaaaattcttatggctaagactcgttggcaaaaaatgatgagtttttaggttttgtagttggttaagataattttcttaggaacatgattttatgttccagatgggtcagtcagtttgtcctttctgtgtgatgtaacctatacttctaagatagttcagaaatcctgatccttcttggtaggagaagtctacttttagacttcggcaagaactttttagaacttttttagggaaaagatatatggggtttttctttgtcttttaaaatccttttcctaaaaattgttaactgtgttttagcgcataaaatgggtatgcgctaaaattgtgaaagcaaaaattaaggtagctttcatacatttatctttgaggtcacttgtttaggcagcagatcactagtagtataacagttggatgcaaggaaaaatgtttctatttctagttccagttaagttcagatacttgataattcatttgatacaaattttaactaacaatgccacattaactttcacataagtaagacagttttataaaatgattgactgatactttatttaaattgtcattcttagattactctttgcagaattttggttaattgtgaagctgaaatatcctgactctacctcaaagttaatgttttaggtaactgaacaggtattcttcccattactagtattgaagtcagaatacagaaacaaattaattatggaactggctctaaggctacaagctttatagagtaaaccaaatgtcagcaatttagttttagtgaaattaaaaattaatattacttattaatttgaattttgtttttatttaaaaatttatttctattttaaagttaagggctataagcataagcatttacagtagtttggtatttgtaggtctttaagtaacatgacagaacttatttaagtgattaatggggtttgctgacattttttattccactaaagagaacctatagagtagttttagaactgctggtctgtgccttgttgagtagtgcatacttctcaccacgcttattttggatcagctgggcatggtggctcatgcctgtaatcccagcaatttgggaggccaaaatgggccgttcacttgaacccagaagtttgagaccagcctggccaacatggcgaaaccccatctctaccaaaaaaattttttttaaattagtcggccgagcgtggtggctcatacctgtaatcccagtactttgggaggccgaggcgggcagatcacgaggtcaggagatcaagaccatcctggctaacacccgtctctactaaaaatacaaaaaattagccaggcatggtggcgggcacatgtagtcccagctactcgggaggctgaggcaggagaatcggttgaacccaggaggcgaaggttgcagtgagccaagattgtgccactgcactccagcctgggcgacagagcgagactccgtctcaaaaaaaaaaaaaattagtaggatatggctgcatgcacctgtagtcgcatctactctggaggctgaggtgggagaatcacctgagcccaggagatccaggctgcagtgagctgtgattgtgccaccgcagtccagcttgggcaacagagcaagactctggcttaaaaaataagttatcacaggccgggcgcggttggtcacacctgtaatcccagcactatggaaggccaaggtgggtgtatcatctgaggtcaggagttcaagaccaacctggccaacatggtgaaaccccgtctctactaaaaataaaaaaaaatagccaggtgtggtggtaggcgcctctaatcccagctactcgggaagctgaggcaggagaattgctggaatctgggggatggaggttgcagtgagccgagatcacaccattgcattccagactgggcgacagagtaggactccatctcaaaaaaaataaataaataagttatcatggtttaaagaatgatttaaatctttaatttttgcaaagcatcagtggacagatgggtgtaatagaggtagagagaacgcaaggatttagttccctactgactagtgacaaagagtccctcattgaccaaactctcctcagattcctttgaaagaactttctgctccggtaagcctcgacttttttacttcatgtttatgcctgcattgttcagttttagtaagaatcctgctgagttgctttaactataacccctgtcatcccccctcagtatctgatcacccgccatagctaattgggttccttctcctccaccatccctcaggtgatgtctgatcaccctcgcctgccttcaacaagaatcctgttaggtcattttagccagaatcttctgtttctcctgatggctcctcttagtaattttccatccactgactctatattcccatctttgggtctaagtttccacttgccaatcgtgtattcaaagttaagcctagttctatactcagatctcttttcccctattgcaataatcttgaataaaatttgtttttaccactttaagtattgtccatctctggttttccctgacacaaccatgtgacttcttacattgtttactgtttgcttatcttaactcattcttcaaagctaagatgctgattcaaacacttatttctacttgcgtgagaaatataaaagtctgaggtctagtgtggtactaattcactataattgaaagaagtgcttgacctataaatgaagcttatgcttaccttagaattgaaacatatggctgggcgtggtggctcacacttataatcccagcactttgggaagccaaagcaggcagatcacttgagcccagaagttcaaaaccagcctgggcaatatggtgaaacatcatctctaccaaaaaagtcagaataattagccaggcatggtggtgtgagcctgtagtccccagctacctgggaggcgaaggttgcagtgagctgagattgtgccacagcactccagcttgtgtgacagagcgagaccctgtctaaaaaaaaaaaaaaaaaaaaaaaaaaaaaaagatttttattttcaaaaggtggtggttttattattttttgaagtacttacctaatttatttttgttcttttgatgctgttttaattagcaaatacgtggtttcttgtgtttgggcattttgtacttctttgcctcagtgaattgtacatttaatttataacattgaagcattttatgttggtgcattatttgaagaactggtgtgtgacaactttatggcatgcctcttttctaactaatcttttttcaccccccttgcaaagatttaaaaattactcatttgaatgtgggtggttatgtagatctgtaagtatatttatcattgagtatatagtaagatttaacacattatttctgacaaccagaaagctaaaaaatgtatcggttttgctgaaaatctttaatagtcaagtttctgtgttaaaaattttagtagtttttgttgatataaggatatataaatacgcaaatggaaaaacttaatgtacatagtgtctctttcaccattattgacttttttttttttttttggtggtggtaataaatggaaatagtttagaaaaatatgagccgatgactacccaaaaataaaatttggtcatcccccagtctctaccaactgccaagtttatccctactgttaacaagacaatcagaatacatcaatatataggatttctgttatattttaggcctttattgagactatctagtataatgaaatacttcaaggtgcttaaatctgtggtacctagaatgatgagaaataaaaggtaacactattagtgtaaaggttatgctgcccatcttctgtcatcttgggtttattgatagattatgtgaataatgatgggctactcttcctcgacctctgtagcaggtgtcatgtattttttagatgaaaggtcatggaaaacccatcccctaccacataccagactcgttgcatgtgaaatattatttttaatatttaagaagcttaatctgaaattaaaactcagtatagtaactacacttgctttattttgccacctttccagtgtctagcatggatttttatgcttatttggatgcctcttctctgttagtccctgtaccagacccaaaagttacagtacagtggtcaccagcatcttccccagttgatgtacaggggaaataacaggttcccttataataactgactcttattctatactaagcgtggagccacaaagtgccagatttttttctcacttgatccacacaacagccccatgaggtgtaaatactgtttttgtctttttttgttttggggcggagaggaggttggttctgttctctctctcttttttttttttttttttttggttttgtttttttggttttgtttttgttttcaggtgaggaaatcgagatgtgaaatattaagtgtcttgactaaggtctcttagattctggattcacactctagtctctgtgtcatcctgcctctctgaaatagtgtgtaatggtgttagatcaaaaccctccacattatagctccatttagaatacagtttgttagctagacactgctcccaaggtattacgagtcaaaactaaagggaaaaaagtttagtttaaaaaatagaactgggccaggcgtggtgactcatgcctgtaatcccagcactttaggacactgaggtaggaggatcacttgagcccaagagttcaagaccaacctggtcaacatggcaaaaccctgtcgctacaaaaaaaaaaattaaataaataaataaaaattaaaaataaataaaaagtggatctgattataaagtaataaaaaatatttttatgtttgagtgataaattcctgctaaaaattccaaaggaggaatttatttttaaccattagtaacactaatgagtttgtctcttccactataaagcagtagctgccttctaaggaatcaccctattgttaaaaagcatgctctaaaaataagggggagggacagggagttggaacctagagagtttcatgttttcagtgacagttattcttcctgaataatctcaataagaaaaattttgatagttaaaaacatgaaacctaacaccactagaggcaaatctaataatcaattgcatctacttttgcttaggctttgggcttttttttcttatcagcactgccattaacacaacacaatacgttttgcacctttgtatcactctcttgagaagtaaggcacaaagtcactcaaaaaagcagctgtgtggtgtatgccactgatgttgaaaataaaaccacagactcagaatttaaaataagaatttatcttttactaagattgtggatgcaggaaagaatagaaaggatttggctggataactaatactgttccttaacacatctaattgcaggcgctttgttagacacttgtaccaactaaagtcctttcctagaattgctccatcaacagcaagggagaagagatcttggaacatttaggtatgggtgtccttttagattagctttttgtagagtgtgctaatgtactgtcagttctgctatgtgacatacgcattcctaaaactaaccgtcctatgcaaaattgtgcaataaaaaccacagtgtttatggagaaaatgagattaatggcataacactcaaaaacttgatgtggagaaagggaaacccctcatacactattggtgggaatgtaaattagtatagcctctatggaaaacggtatggcggctcatgagaaattaaaaatagaactaccatatgatccagtaatcccattatggggtaattattcaaaggaaatgaaatgattatgtcaaagagagatacatatttgcactccaatatttattgcagcaccattcaccatagccaagatatggattcaacctaagtttccttcaacagatgaatggataaagtgtgggatatatacactctggaatactattcagccataaaaagtgaaatcttgtcatttgtggcaacatagatgaacctgcagagcattatgttgagtggaataagctggacacagagaaatactggatgatctcatgtgctaaagatgttgatcacatagatgtagagagaatagttggtggggggcagagggggatgagggagagattggtcagtctgttcaaaattacagataggaagaagagtaagttctggtgttctcttgcacagtagggtaactatggttaacaatattgcatatttcaaaacagctggaagagagaatttgggaagttctcaccacaaggaagtgataaatgtttgaggtgatagatatgccaaatgctctgatttgatttttacacgatgtgtacatatatggagacatcacactgtacctcataaatatgtacaattatgtgtcaatttaaaaaaaaaaacttcattaatggcatactttttgaaaagatgagacggagtctcactcttgttgccaaggctggagtgcagtggtgcaatctcggcttactgcaacctctgcctcccaggttcaagcgattctcctgcgtcagcctcctgggtagctgggtaaattacaggcgcccaccaccacgcccagctaatttttgtatttttagtagagacagggtttcatcatgttggccagcctggtcttgaactcctcacctcaggtgatccacccgcctcagcctcccaaagtgcagggactacaggcatgagccaccaagcccggccagtaacctaacttcttaaaggtaacagttttatactcgttgaatggttaagaaatacataaatactacaataaatatagcattttaccttgaaaaaaatgtgcagtttgcttgtggaagtgggtatcaaaagaaaggcagtttgtaagttattttgaagtgatggaaggaacagtgtctgaaatcagagggaaagttgtaacaccagatgtggatgggtatggctcataacatgagttacaagtagatgtttaaggtgtgtgcattttgtatattcctgcatggccgagtgcacccaagtgttgttgtctgcattgaccgagtgttctcactgatgaaatctggcataggcaaaagcaaaattctcattatactcaaattgttccctaatgtgtcaacgatgttgaaacaaattcacattttcaaaacaagctttatagcaaaactgtactcttgaaagtgacaacagggtttgctagtgaatggataaaacatgaatcttatctgtttgcttacaacttatgtgtgggggtaaggaaaataatgaattagaaaattactggtttgagaaactaagtggaagtgacaccattaatctggaataaattgccaacatggactgagagtacacatgacccactctttggaactgagatgggctcatcttcccatatggcacttggccaaatatagagtagacaccaaagaggagtgaagctagcccctttagcaaagaagaaggcaagtccattgggcaggcagccagtagtgtttcctaagcttaactatatcgagttaattgaagagaagttccaggcttttgagtttagaaaaagcccaacaggttgttttacccaataatcctctgattataatttccaccaatctgcctcccccaggctgcctcattttccgttggacctcatcaagacttctagtctttttatccatctccacattctctcccagtcttttcagcctcttcctgacctcatgtggccccatgctccattcctgaaactacgctctgcacctttatccactgttccccgcccctttgtttctcttgccccacaaacaccctacaaactcccctgtcccaaagactcctgattccatcatctaacaccaggctagagtatcctgtgtgttcatggcatgacaactgattcctattcctcagctgggcccactagtgtatattctactttataatgaaaatagaggtttatgggctgtgcctgtgttttcgttgtttcactgacctcttcaggatctcattcctctttatctcttagtttctaagtataattggaaaggcaaaatttggaaagcactgagttccattgcttagtattctaccacccttctgttattattaaaaacagtacatcaccaacatctaaaccaattctagtgagttctgttgcttaaataaaacaaaaatctttacttagaaacttgaggatcaatgaagcatgagataattcagaagaatatttagttagtaacacattctctttgggaagctagcagctcagttagtgaacgagctaactattctgccagaatctggtttggaaaatagtatggagagaaatatgtctgtgaggaaaaggccatttctaatctccatttaattttaattctgtcttagatcagttgttatatataaaatgcttggagctagaggagtgccttaggactatttgtttattttcaagatgtttcgtttccattttgaatgttactgcccaaagagactggacattaaagcatgtgaactcatacacaacaaagtgggagaaacaatggtgtttatatgttaattccatgaagccctatatttaactctattccctctggccatataccaggtggaaaaaagcaaggactgtgctattaaaaatatcaaatcagatagttccagctggggtttcttaatcatttaaaaggcaaaatatgaggtcacttttaatatcttaagtagataacgatcttagcatttactttagatattaaatctgaagtgcttatcttttgccttactggctagacaatactactagcagtttctagctttggagtattttccttaaaagaaacattggaatttaatacggagccaactattttgcctcaaattgtctgtcttaggaatatccaattcatcaatagagtaatctaaaaagttgattcactaattggatttaagtgccacaggactcttcacacattattttaatcaatttgttggaaagatcaattttctcatggatgaatgcatataaaaatgaagcaattgaatgagttacataggaaggttggcacatctaattccctagaggttctaggaacaggttcttaattatatatctgaaatggtttgaggtttttaaatgaaatttgtctagaagcaggaagatgcaatacccatctatccaggcctgtatttctggatccccatcttatctaatatttaatagttgatcctgaagttgagatattatccctttattcttttaaaaaaaatttttttgtatgtgtgccattttaaagtaattaacagagtagtttgtgttagttttggttaagtgttataaagccagtttttttttaaaggaagtcctggaggcctttttgtattgactgttagagaggacagtgagtgtaaacacaagtttttaaagtttaaagttacagtgcccactataaaggactacaattaatgtgaaaagtagttttaaagttaaaatttatatatcgctgtttgtgcttatataatacttcccactctccccaaacatagaggtattctgattctgaaaataagccttttttagtaccattatgtgtatacatatatattttattttatttttctttatattagtcattgtggttaaatgatttattggtagctgatgagtcacaagtatgtttctcattctctaatgagtcacctagctacctacaagtttgtttattttctttcctttctagatctttcacctaaaataggtgttttactagttggtaggttaaaatttcagtttgctacattaactttttttttttttttggagacgggagacggagtctcgctttgtcacctaggctggaatgcagtggcacaatcttgactctctgcagcctctgcctcccaggttaaagcgattctctacctcagcctcccgagtatctaggactacaggcacacgctaccacgcccagctaaattttttttgtgtacttttagtggagacggggtttcaccatgttggccaggctgctctcaaactcctgacctcaagtgatccacccgccctggcctcccaaagtgctgagattacaggcatgagccactgtacccagcctacattaactattagatctggaaaataccaaaataatactcagaagaagtctcattgatttttacaaacttgtatttagcacgtgctctggtccaggtactctgctgggcttgagtatgcaaagatttatgtgtgtcatatatatcttaggagaagcttaattttgggagagggcaagggagataaacaactgcatgcagaggcagggtatacaggtgctgtgataggagtgtatattgtctgtagttgaggcccaaagagaggtgtgcatgtggataccccttgagcatccatatggataagttggtgaatgtaggcaaggccattatactgttgtgtattgcaactccttgaacagttgcacctacattttatacctctttgttggaacagggtatttatctgttagaggaaaaacagcttctattttcagtcctgtccactgcaacatctgtattgaaaatttggataatgctaaaggtgtgctaagaaaaaaaacgggtctaaaatctgctgtcagaaattttcagatcgtttgtgggattaattctcctgggctaaatataactttgtataaaacaatatgaaattattatttaaagattttgctgaatttctactaaggttggcaacaacagcaaaacatcaagatacatcagtgttactggggaaggtagtatgattcctggacatttgggaaactattactaaagggcctattattttcagttgttgttgtttttttgtttttttttttttcacagaaactataaagcaatctagcagctcatgagcttctaagaatgaaaatgtattatttcatagtgagctgatgatgcattctgagatatttaaatttagttctaatttgtcagtctgtaacagaactgtctagtgcaataatcattaaatgatcttattagctatgtgatggtagtctaattacttaaccttgtagagtctcagttttctcatctgtaaaatgttgataatacctaccgtgtaggcctttgtgaagcgcaaatgagatagtgtctacctaaagcacttcacacagaacctggaacataaaagggaattgctaaagaaataatagaaataatactttagggatttagttgttaaatctcttttcttttttctcttttttctttctttcttttttttttttttctgagatggagtctcgttctgtcacccaggcaggagtgcagtggcacgatctctgctcactgtaacctctgtctcctgggttcaagcaattcttctgcctcagcctccagagtagctggggctacagggccacgccaccacacccagctaatttttttgtatttttagtagagactgggtttcaccatgttggccacgctggtcttaaactcctgacctcaggtcatccacccaccccgacctcccagaagtgctgggattacaggcatgagccaccgtgcctgggctaaaatcactttcatttgagctataaaaataaaagtgtgtttgccaggcatggtggctnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggcaacatgatgaaaccctgtctctacataaaatacagaaattagccgggcgtggtggtgcctgcctgtagtcccagctactcaggagtctgaagtgggagggtcacttgaacctaggagatgagtttgcagtgagttgatcccagtgattcttctctatatgctcaggaggactcgtcagagtcaaaacctgatactgggacccagcagcaagagataaactgctttttcccccgatttatgtctccatttatttgcaagatggtgacctctttgactggagttgtgtgctgttaaatattttttcacgtgtctcctatacagaaattataccttcacccttgattttcagatcatctacggtagccatttctcagggtttatgattcttgttctctaccccagtgctctccaaagtgtgatatgctcaagattacccattgagggaaagaaaataattcaacttccttcattccgcctaccctttcttccctgcttttttcttttatctaaaaggatgagaatgaatttgagtttttccaatagttaatttatacataaacactggacccataacttggattgcttctcagaaggttacatatcacctatagcatgtgaggtttctgaaggaagattgtgggattccagtaatgaaaagaagctagcagtggtaccctcattctcctctctcctcccttctttcttcccctcccctcctttcctctcctgtagatattatgccatcttcatatacaatgtcagttaaaaccatataatcagactctttctacagtcagtagaattttattcttctactgcagtaatgtacgcaagtattcctgtctctcttgttttgactctattttatatatacacacataaaaccctcggatagtctgaccctttttcacaaatggaacctttttgattttaatgttttttcttctgaattcactcatgtctacagtaagacaaaaatggatgtagatacagatgtagctgtatagagataatagggctaaattgtccaaaatcatggaatagttttactaatgtctaaataggttatgatttttaacagctgcatataataaggggaaatactgagattggaagggttaaaaaaaattaactgttctctatgtctgattaatcctgccttctttcccgttgattcagtagaacaatttgtaattgcagaaatttataatagctttggccctagcttaagaaatagtttgtggtttcagaagttaatttgtaagttgtttcgtcctggaaacaatgttctaagtggtagttgttttctagactagctgatctaatattttagcactcagtactacgaaattaaagtactaaaggtagatatagttccatgtttcaggtcctgggttaaaagagtcatctggtacttttgaatgagaaagaagagggaatttttttttgctttaattggacctacagccagccctgggcagagtatctttgactacattccaccttctttctagaaggatactagcatgacgctcagtccttaaaagcagatgtgtttgggccgggcgcgatggctcatgcctgtaatcccagcagtttgggaggccaagacgggtggatcacctgaggtcaggagttcaagaccaccctggccaacatggtgaaaccctgtctctgctaaacatacaaaaattagccaggcatggtggcacatgcctgtaatcccagctactcaggaggctgagacaggagaatcacttgaacccgggaggcggaggttgcaatgagtcaagatggagccactgcactccagcctaggtgacagagacaagaccctgtctcaaaaaaaaaaaagtagatgtgtttgacttgagttggcctgaagaagactgtctgataatggaaggtgcagagggccagcaaatgccttctaataggagtcaaagtttgtgagacgaggggaccaaggggtcagggatatagaagaaaggtagcagagtggacctctacttgggacaggtcaggttgcttgatgaagcagtacattgatcgatacagaggagaaaaccttccttgtgaagatgtgtgagataagcaatagaattctcaccaggcctgaatatacactcagttatcacatttactggtaggtggcagtcaaattgaagatagattcagttcagtgacactagattgcaagtattagaaaactttgtaacagtccactggagcctcttgatcccttcaagcctcagaagagccttatcttagttcaccaactacttcttttgccataataaattctgagtttcttcagtagtcaagattttagctaggtattaggtgatagccccagtgcaggagacttacgagagtacaagagatatgcatgctgttgattttttttttttaagttagttggtaacagacataaagatttctaggcagtgtagccaagtgacataaacaattttctttcttaactactcttcacctattatcctcattttgatcctttttcattgaaatggattctggtgttctcttgtttaaagtaagtactgtctggtttctggaatgtctaattgcaccacaactactaaagacccaaatcctcatcagaatgaatagaatttttccatgaaaattaaatcttatccttttcatcaactatattgtgatatactttgtcagtacaagaatatacacaaaagtaaaactggtacattttgtatgggaatcaccattttggagtatacattttcttccttggttatgtactagtgattaaaaaaataatcattgtgtttaataagctactttataaattttgtattttagaatttcagtgtctggtgttcagaattcaagttattataaaaataagctgtccaggagatgcatttattttacactcatcatatattaaacttcatataggcacccttttaaatgggagtacacaatccaataatcataaatctgatgacggagtatactcagaagctaaaggtagtgaggatttaattgcaaaacagcacgctaatgtcctcttattaccttaaaatcttttcagttgaccgtcttctattatttaattccatcacataccagtaattgcatttattgaagccagtatttctcattataggaaatgctgatcttagtgattctcaaaaatagggagggaaatgttctttaataaataattaaaagactttttactacttttcccaattcggtactggttttattaccttttatgtccagagtattttataagtggtaactaaattatggcatctaaaaaatcatctcttcaaggaatctcacaaggtatgctacgtaatagcttattctaagtaggttaaatagactggctttatctcaagtggcttactgtattaaaaaagagtttaacatattcagctttactgctgaaacaccagaggagttctgacacctctgatgagatgattcaagttgggaattttttctcttgacagcatcaacaaagagagcattgtggatgtagaaggtgttgtgagaaaagtgaatcagaaaattggaagctgtacacagcaagacgttgagttacatgttcagaaggtaagttttttcaaaatataaaatcgcatatagaaatagatttgggttctaatagttttcatgtcaaatttatatgttcttactaattaatgtaaaatactgaggtttataaattagttactgaatcaattagcttttgttatataacaaatcaccccagtacttagtgacttgaaacaacaaacatttatttgcttacaattctgtgatgcacccaactgagatggctcatctgctccatgcaacattggctgggctcactgataaatctggcacatctctttctgtggcttcctctcatccagcaggctagcccagatatgttgatattcaggtaccaggagggttcccaaaggcaagagtgcgaaaccctaagaacagacacttttcaagcttctacttgtgtcacatctgctaaatattccactcgtcaaagtcacacagcaaaacttagatttaaggggtagagaaatagattctagcccttgatgggaggaaaagcaacatgattgcaggggaatatacatgcaggagcaagaggaagtattgcagccatttttgcaaacagtctaccacagccacatagggaaaaatacaaaacacatctgaaaaactactcaccaatataagtgaataataatggacctatcttgctataagttttttgatgatgtacttttattttattttatttttcagtttccatttttacttttcctttatttttatactttaagttctaggatacatgtgcacaacgtgcaggtttgctacatatgtatacatgcgccatgttggtgtgctgcacccattaactcgtcatttacattaggtatatctcctgatgctgtccctcccccctccccccaccccactacaggccctgatgtgtgatgttccccttcctgtgtccaagtgatctcattgttcaattcccacctatgagtgagaacatgcggtgtttggttttctgcccttgtgatagtttgctgagaatgatggtttccagcttcatccacgtccctacaaaggacatgaactcatccttttttatggctgcatagtattccatggtgtatatgtgccacattttcttaatccagtctatcattgatggacatttgggttggtatcaagtttttgctattgcgaatagtgccgcaataaacgtacgtgtgcatgtgtctttatagcagcatgatttataatcctttgggtatatacccagtaatgggatggctgggtcaaatggtatttctagttctagatccctgaggaatcaccacactgacttccacaatggttgaactcgtttacagtcccaccaacagtgtaaaagtgttcctatttctccacatcctctccagcacctgttgtttcctgactttttaatgatcgccattctaactggtgtgagatggtatctcattggttttgatttgcatttctctgatggccagtgatgatgagcattttttcatgtgtcttttggctgcataaatgtcttcttttgagaagtgtctgttcatatcctttgcccactttttgatggggttgtttttttcttgtaaatttgttggagttcattgtagattctgaatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaattcttgtataaggtgtaaggaagggatccagtttcagctttctacatatggctagccagttttcccagcaccatttattaaatagggaatcctttccccattgcttgtttttctcaggtttgtcaaatatgagatagttgtagatatgcggtgttatttctgagggctctgttctgttccattgatctatatctgttttggtaccagtaccatgctgttttggttactgtagccttgtagtatagtttgaagtcaggtagcgtggtgcctccagttttgttcttttggcttaggattgtcttcgcaatgcaggctcttttttggttccatatgaactttaaagtagttttttccaattctgtgaagaaagtccttggtagcttgatggggatggcattgaatctataaattaccttgggcagtatggccattttcacaatattgattcttcctatccatgtgcatgcaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtttgttattggtgtataggaaggcttgtgatttttgtacattgattttgtatcctgagactttgctgaagttgcgtatcagcttaaggaggttttggcctgagacgatggggttttctaaatatacaatcatgtcatctgcaaacagggacaatttgacttgctcttttcctaattgaataccctttattcctttctcgtgcctgattgccctggccagaacttccaacactgtgttgaataggagtggtgagagaggacatacctgtcttgtgccagttttcaaagggaatacttccagtttttgaccattcagtatgatattggctgtgggtttgtcataaatagctcttattattttgagatacgtctcatctatacctagtttattaagagtttttagcatgaagggctgttgaattttgtcaaaggccttctctgcatctattgagataatcatgtggtttttgtctttggttctgtttatatgctggattacgtttattgatttgcatatgttaaaccagccttacatcccagggataaagccagcttaatggtagtggataagctttttgatgtgctgctggatttgttttgccagtattttattgaggatttttgcatcgatgttcatcagggatattggtctaaaattctcttttttttgttatgtctctgccaggctttggtatcaggatgatgctgacctcataaaatgagttagggaggattccctctttttctgttgattggaatagtttcagaaggaatggtaccagctcctctttgtatctctggtagaattcagttgtgaatccgtctggtcctggactttttttggttggtaggctattgattattgcctcaatttcagagcctgttattggtctattgagggattcagcttcttcctggtttagtcttgggagggtgtatgtgtccaggaatttatccatttcttctagactttctagtttatttgcatagaggtgtttatagtattctctgatggtagtttgtatttctgtgggatcggtggtgatatcccctttatcattttttattgcgtctatttgattcttctctcttttcttctttattagtcttgctagcggtctatcagttttgttgatcttttcaaaaaaccagctcctggattcattgattttttgaagggtttttgtgtctctgtctccttcaattctgctctgatcttagttactcttgccttctgctagcttttgaatgtgtttgctcttgcttctctagttcttttaattgtgatgttagggtgtcaattttagatctttcttgctttctcttgtgggcatttagtgctataaatttccctctacacactgctttaaatgtgtcccagagattctggtatgttgtgtctttgttctcattgatttcaaagaacatctttatttccgccttcatttcattatgtactcagtagtcattcaggagcaggttgttcagtttccatgtagttgagtagttttgagtgagtttcttaatcctgagttctagtttgattgcagtgtggtctgagagacagtttgttataatttctgttcttttacatttgctgaggagtgttttgcttccagctatgtggtcaattttggaataagtgcaatgtggtgctgagaagaatgtatattctgttgatttggggtggagagttctgcagatgtctattaggtccgcttggtgcagagctgagttcaattcctggatatccttgttatctttctgtctcattgatctgcctaatgttgacagtggggtgttaaagtctcccattattattgtgaggaagtctaagtctctgtaggtctctaaggacttgctttatgaatctgggtgctcctgtattgggtgcatatatatttaggatagttagctcttcttgttgaattgatccctttaccattatttaatggccttctttgtctcttttgatctttgttggcttaaagtctgttttatcagagactagggttgcaacccctgttttttttggttttccatttgcttggtagatcttcctccatccctttattttgagccaatgtgtgtctctgcatgtgagatgggtctgctgaatacagcacactgatgggtcttgactctttatccaatttgccagtctgtgtcttttaattggagcaattagcccatttacatttaaggttaatattgttatgtgtgaatttgatcctgtcatgacgttagctggttattttgcttgttagttgatgcagaaaagctgaaaattctaaaaatcagagtgcctcttatcctccaaaggaacgcagctcctcgccagcaacgcaacaaagctggacagagaatgactttgacaaattgagagaagaaggcttcagacggtagataataaacttctctgagctaaaggaggatgtttgaatacatcgcaaagaagctaaaaaccttgaaaaaaagattagatgaatggctaactagaataaacagcatagagaagaacttaaatgacctgatggagctgaaaaccatggcacaggaactacgtgatgcatgcacaagcttcagtagccaatttgatcaagtggaagaaagagtatctgtgattgaagatcaaatgaatgaaatgaagcaagaagagaagtttagagaaaaaagagtaaaaagaaacgaacaaagcctccaagaaacatgggactatgtgaaaagaccaaatctacgtctgattggtgtacctgaaagtgacagggagaatggaaccaagttggaaaacactcttcaggatattatccaggagaatttccccaacctagcaaggcaggccaacattcaaattcaggaaatacagagaacgccacaaagatactcgagaagagcaactccaagacacacaattgtcagattcaccaaagttgaaatgaaggaaaaaatgttaagggcagccagagagaaagctcgggttacccgcaaagggaagcccatcagactaacagctgatatctcggcagaaactttacaagccagaagagagtgggggccaatattcatcattcttaaagaaaagaaatttcaacccagagtttcatatccagccaaactaagcttcataagtgaaggagaaataaaatcctttacagacaagcaaatgctgagagattttgtcaccaccaggcctgccttataagagctcctgaaggaggcactaaacatggaaaggaacaaccagtaccagccactgcaaaaacatgccaaattgtaaagaccgtcgatgctaggaagaaactgcatcaactaacgatgatgtacttttaaagaatgattaattaactaattcttagtcttataataattacttttctgatattttttacaacatagagaagtcaaaataaatagtaccttattggtcttatattccaacagtagcttcctttttttttaaagaagacttatctctgatctgtttttttctcaggattaaaaactgaaagagctcattatcattgacttaaaataccataagtgtcacttgaggtcaggagttcaaaaccagcctgatcaacatggcgaaaccttgtttctactaaaaatacaaaaattagccaggcgtggtggcaggtgcatgcaatcccagctactcaggaggctgaggcaagagaattgcttgaacccaggagacagaggttgcagtgagccaagatcgcaccactgcactccaacctgcgtgactaagtgagaccccatctcaacaacaaaaaaaaaccataagtgaattcacacatatttagtactattgaaataaccctgccagtttgaacctacagtgctcagatttaggtctagattgtatctacaatatacatcactaaatttctcttaaggagtagtctttaagacagcatggcctcttcccgccctgatccgtgtgcacatgcatgaccatatgtaagagtcaggcagaccaacaggcagacagattcagagataggcctatatgtacttactgatttaagagtaacattgtatttagctggaatctgttttcttggaactcttcaagacttacaaaaccttgtaatttttactgacctaatttgacaaatgactttgttgtctttgtgtaagtctcatcttgaaacaaccccaccaggaagtttgtaacctagtaaagacaaactgaccaaagagtaagaataaagataaatgaataaacccatttatgttgaccaagaaagataactcccacatcttccaagtaacacatctttttcagtacttgaataaagaaaatttggccagatgtggtggctcacacctgcaatcccagtgctttgggaggccagggtgggaggatcacttgaccccaggagttggaggttacagtgagctgtgatcacaccactgcgctctagcctgggtgacagagcaagaccctgtctcaaaactaaaaaaaaaaagtgtatgtgtgtgtatatatatatttctgtttttttactagaagcaaatgtagttttaagatattcttattgtctagatgtgtgcaatgcaacattaataaatattagtaataaattttaagccagaagagcttacagaatttgccataataaaaataaagtatttcacaaagcatgaagtattacctactaagtagaatcttatataagtagtgactttgctttatcacttatttatttattcagccagcagttactgttgataggtgctttgtgccaagcactatgtgaagactctggggtcagagtactcatggtctagtaaagaggatgatgaattcccactagttataaaagtagaagtagcagctcttcagctctccagtttggattggagatgaagtttctgttaacttgtcaaagggaatcctagaatttgggtttagggagtggtgacaaatagttctattttataataaggaatactagagtatcctacactatttcttggagtatctaagctgaatgccaatattgatctgccaactagaagagtataattccctttcctgaagtaactaaataaggtatttttcccgtttgtgctttagcaggttttccagacatagtttgggttaactaatatgataaaatggtttttaaaggtagccagaaaaacaaaaagcaaaaaactctagttcagtctttatgacccagttgctttttatcactaaaatgtgaaattagtgtgagtgaatattgatggaatttttatttatttatttatttattttttcgagacagagtctcgctgtgtcacccaggctggagtgcagcggcgggatctcggctcattgcaacctccacctcccaggttcacgccattctcctgcctcagcctcccgagtagctgggattgtaggcacctgccannnnnnnnnnnnnnnnnnnntgctaacttttcaagtgacttcaactattttgatgatgaattgagcttcttctctagccagtgatgaaaaacaacatagataatagtctctgcagctgttgggaggcctgtctctctctctctctctctttttctctctctctctctgtgtgtgtgtctgtgtgtgtctgtgtgtgtgtgtgtgtgtgtgtgtgtgtgttttgtctagattagctgtcctggctacatcaattcatgtgctttaccaagcaaaatgtctccttcctaaaatagggtagtcaaagaaaccagatcaacctggaaggaaacataaaaccatgggaaagaagataaggctgaccacaccacgtaatttttttttagtagagatggggtttcactctgttagccaagatggtctcgatctcctgacctcgtgatccgcctgcctcggcctcccaaagtgctgggattacaggcgtgagccaccgcgcctggcctattgagggattttgacaacataaaggaacatcctctagggcatttcctaaccaggagactggcaggaaatgagatgtttgtaacatgtttaatgagagagagcaatgaaggggtacttgaaaggagaaagaatgagaaaagaagtgcagcagagctggactgaatttggtcctagtggtggcagtggcagtggcgctggccaaatgctgttaaaaataacaagatggccgggcgtggtggctcatgcctgtaatcccagaactttgggaggccattgcaggcagatcacgaggtcacgagtttgagaccagcctggccaacatagcgaattgctgtctctacgaaaaatacaaaaattagctggtgtggcacgtgcctgtagtcccagctactcaggaggctgaggtgggagaatcgcttgaacccgggagacagaggttgcagtgagccaagaccacaccattgcactccagcctgggtgacagagtgggactccgtctcaaaaaaaaaaaaaaaaatgatagcaagtcatatgttaattgctccttcacatgagtaaagtgttttcacatttattattctgtttgattcttatagcaggctttattttaattgaagctctgagattaagtgatttccctaacaatagcttttttgtgtttatgtttgtttttgtttctgtttttgtttttttgagacagggtctcactgtcacccaggctggagtgcagtggtgcgatcttggctcactgcaacctctgcctcccaggttcaagtgatccttgtgcctcagccacccaagtagctgggattttaggcacgtgccaccatgcctggctaatttttgtgttttttgtagagacggggtttcaccatgttgcttagcctggtctcgaactcctgggttcaagtgattaacccaccacagcctccctaagtgctgagattataggtgtcagccacagcaccaacccctaaccatagcttttttgacatagctagaccgtaagccagtgcctacaccccagtcattacttattacattggtaggcatcttagaatttacaaataatttttatatatgttaccttatttgactgttctaacaaccatagaggtaggcaaaaaatattattatccccattttaaacaaatcatcaaggtgaaaaaacctgtatcatcttgtttgatttcagcaagtagtttcaattaaagatgtatgcaaacattgcttcatgcttaagtcaactgtagattgttttttaagaaaaagatgcagattttgtgtgctttctactatttttggtaatctctcacttacagatttatgtgatcagtttggctgaaccccgtctgcccctgcagctggatgatgctgttcggcctgaggcagaaggagaagaggtaaaaattatacttatgaaatattatgcttccgctgtatatttagtttgcaaaacattgaaaacctgatgtactaagggtgtctgtgaattgattttgagctccattgttatttaaacttactcttaaaatcagcaattctcaaaccttttggtatcgagttgccttttacattattaaaaataattaagaaccctacaagcttttgtttttattggtatatatatcaatatttacagtattgggaattaaaacatttttaaatatttattactttattaaaaattatatatacattgcatacatgtttgcatatgtagtattatgtaaataatgaagctaataacattttatgaaaaaattacagttgtccaaagcaaaaaataattattgttaagagtgacattgtatttagcagtccattgccttaaccactcagctccctcatccttcggatgacattctgtttatataaccacaattctttgtgatttctggcttaatagacaactagattctcatattgcctctgcattcattctattgtgataatacacatcatagaatctttagcagactgctcagtatactcatgaagagtgaaaaacaaaaagtattattatgaaaaagtaagtttgacttcatcaacttctggaaagtctcagggaccttcactgctccccagaccacattttctgaaccactactctatgtcagcttttatctgttccttcaaccttgggctagcaggttaaatccaggaatcaatgaagaagtgggtggttaatttttcttatatcccaataatgaggcaaggctttgaggggtggaggagggaaagaaccattaatatctgttcattctttgtcttctttccatctctcttttaacgctaacttctctctggccgcactttgtgtttctaccattatctgattttcgggcataatattaacgtacacacatcctactcaattaaaagtaaacatggcttctaaaagtattttttgtgctcttcaaaatattagtaaaatttatttttttcttttctttttttttttttttaggaaggaagagctactgttaaccaggatacaagattagacaacagagtcattgatcttagggtatgcctcatttatttattaagtgaagcaattatgccgcattagagaggggcagggataccatacctgtctcaggcttataaagctaaatggtatttgcctgactgtaagtatgataatacaggaaacaatttccttttctgactgacccttcccctaaaaagaattgcaggcaacaggagcggttaaatactagttaacaggatattgactttctttgttttaaaatgacaaatgaatttgaagccagtaaatgatcttgcttccaggtgatatcttttttagacaagttattcagcaagtagaaacataacctttaatatcactacaaagttatgaaaaaaattacatgcacatttgagatcaaccaggtggagatgagtaattaatgcttcaatcctttgaatttgattggagcaccaaattaaaaatatagaagcagttggctctggtggtttatgcagtagtctcatgggtcttctgtttccctttctggtttggttgcaagtgaaagagagtttagtggtttcatcattgttgtagtaaaaccattgcatctttcttaatattttgaccacatcttccttttttacttaaatattctactcaagctcaaattttttgtcaccttaagagttcttcttggctattctaccatcatgtgagtctacccttattatatactcatgttattcctaattatttgctttttgtcttctaccttttccattttaatttgtatatgaaaagcaagcagtaatccaaagtcctcttgatactacctagaaacctcaggtttttcatgtatgttggccacaggagtgagacatcattctttatttatttgcccttgctagttgttcacacaagttattattggtttgtgcctctagaatttgacctgaggagtttttgggttttgggttgtattgttttgtttaaattcattgccaccattgaaaaatgggttttcacattaaaatctggatggcacttcttaaaaagaggagaatctggaacatgagctagcatgctagataggacatatacaggattcttacactgtcttttgctttgccctgcaccacccagcaaatatcattcatttcattcattcatgttatttggcccttgcaagcgttcacatgcttaactcttactttgactttacattttgggagatgttgtgtacattagtaactttaagtttttaagcaccttcgtttccttctaaactactgtcttggtttggtgcagtgtctcacacctgtaatcccaacactttgggagcctgaggtgggaagaatgcttgagcacacgagtttaaaaccagcctgggcaacatggcaagacccctgtctccttaaaaaatttaaaaattagccaagtatgatggcatgcatctgtggtcccagctactcaggaggctgaagcaggaggattgcttgagcccaggaggttgagtctgcagtgagctatgtttgtaccactgcactccagtctgggcaacagagcaagatcctgtctcaacaaataaaaaataaactactatctaatttagtccccaactagctctttcatagactctcagcaaagtcaagggctaaagaatttggaaataaaaggcaaaattgccattcttcttctataatacaaacgttctaagatatatcctccgtcaggttctagtgtagcctgacttttttctcgtatatgaatggttttctctctgaactttacaggcaggtgccctgattaaaaatacttcaccttccagcccccaagaaggttaaagcaattttcattcctagaaaagtgaattaaaatgtctttggcacccttttcatacatagcactcacataactcatattccagattggcacggcaaattagcttcatcctcataggttagcaggttgttaggagggttttctcagaatctattcaggagagttccctttagatcagaattgtcccctttatttcacctcactcttaggtacaggtgaaggttgtcctaggagtaaatgttagtcttccctcttgagaatcattgtttaagtacttttcccaaatacaaatggattcgttggttcaaaattagtctatttcttttatttctttatctagaccccctgtactatagctagtctacaaaatatttattatgttcgtattacaggtttcttatactgtggaatatgtattggtcatcttcaaagaacacatcattttgttggggagataagactagtagtgtgaggtctccttaatagggatgccctcccttgggttgccaggtaagcatagaaactgagccatctttaaaggtgaatcatcagctcttttttgccacttggtttcacatgccaaggggatagacaattcaggactcatgggcatcctaacccttgagaccccatggcattcctaaagttctctttgtttgctaatacaccacattatcctcaatgctacctctgaaatcacactatcaaatagcccctactatgtaattctgtaactttttttcctgaatgtttaggtctattttggcatgcagggattaagaaaatagctatctgagcatatattttatagttcactaatgaaccctactttgaccctgtgggttaatgaatgaaaagtatctgctattatggtgtggtttcatcttatcaattacatatttttgttttgaaatttgtcacctttgtcttcaccattcttttctcttggacagactgttagccccttaactcatgtacttgccttgacttaagttaccagtctgtccaagagaaaagaattacattcatggcaaatgcccccagtcaggcacaacataccatatacataatattcttgatgagcttaaagtagccacacagcactcagggcagcctccactaactgattggaaataagcctatttgccatatctccctgaaactttctattaacaaagccacaaaacgcttaaacaaagaaaaattagataatatcaatagcccatcttctaacacattgcctagctcattactttcaatacatattttccaaactaaaaattaaaatctcaactctttaagagaagtttcgtaattttgtagtataagagattatcctggcaatatagttttaatgccaatatattgaaacttacatgacatttcagtggttttgcagtgttttcccaagtatggtacctttaccactgaaggtacacagtgatttctgggtgttaaacagatgaacattttttattttaatagctatacaatataaccagcaaataaaatccatgttttcatggatattattgcttagagttagttaagttttaaaatgtgatttaaaggaaaatattaagtactagtacaagagatacccagtatgacagaaatgatagtagaaggcaaaagacaagtttaagaaatgctggtttgtgtcagcagtgggcagaaaattggggactcggggctgccatgagaatgataggtgtttgatcaccacagctataggagttctttgaaagtagatctggacattttgaaatagtcaaggggaggtgtcctcagggatgtcataactgttgacctcaagaccaatgcatcagttagaaaaacattttaaggatgctcagcactgctatgtatcacagggtccctccataggacatacatacttgatctgctagcgtttttgtcatacgttagaatgaatgaatatgtgttggaatgtcttgacacagttaacctgaacacatacagctggaatccccctgttgcagttgttattatatgtaatataatagcaattgcagacagcttggattctttctcacagatattccttttgttcaattagaaattctacataattctggccgagcacagtggatcacttgaggtcaggaattcaagaccagcctggccaacatggtgaaaccccgtctttacttaaaatacaaaaattagccaggcgtggtggcgggcacctgtaatcccagctactcgggaggcagaggttgcagtgatccaagatcacgccattgcactctagcctgggcgacaagaaagaaattccatctcaaaaaaaaaaaaaaaggaaaaagaaattctgcgtaaatctggccaggcatggtggctcatgcctgtaatcccagcactttgggaggctgaggcgggtggatcacttgaggtcaggagttcaagaccagcctggccaacatggcgaaaccccgtctctactaaaaatacaaaaaaaattagccaggcttggtggcatgtgcctgtagtcccagctactcaggaggctgaaatcacaccactgcactccagcctgggcaacagagtcctccatctcaaaaaacaaaaaaaaaaagttctacataaatctgattttttaaaataatagttccctttggaattaaatcaggtatcattttagaaatgtctttcccactgccttttctactatctctcctgacccctagtccagcttcacagtagtatctctgtaacctgataaaccataaatgaacaggaattctctacagccattaaaagcaaaagatatagtgggtatcttaactaagatgataacttaaataggtatttttaaaagctacaagtctaatacaacatggaagtaatttgttgtgaggattgtaaggcgctaagtactattaaagattgctgtataaagtttgggtttgtttgaatttttgtctcctatcgaaattctttctctcaacacccttacttctctccatgtacctgcctctcttctccacaaaagatataattttgctttttagtgctatgaggacctcagggaaaggaattctataaatgcagaatattgtttttccctttatttcagatctttcacataatacagaatagcagtgttttaattttaataaccatacttttgggaagtttgctatagaatttaaaagtactattttaatataaggaatgtcaagcttttttagaactaaagttcaaggactgggtttttcgttttgcttttctaaaattaatttttttaagtgtagaaaaattagttttctgctttctgtttagtttatcttctacctcatgccctctgtaatcgccgttatcatctaacacctagcccagtactaggaggcatataataaatatttgtttaatgagtgaggaggaagtattattttttttacatattatggaatcattaaaatatttgtctgacccaaaacaatttttagatttaaacattaaggaaactaatattattagtatggtttataacttaaatgataaagaaggcctttttcctgttcatttaggtatcttaaggtaagggtaagtatagtaatgataaattaaatatataaggtatttgtacattccttgtcagttgaaaataaggttgttatatatttgcattgaaattaacatatgttgcattcattttatgtactatagtttagaagcatttaatttgagatagatttaatatataattaccctattaaacatacttttcttttgttatatacattctgtaatcttactgataagttggatcattgttgatttttaccttaaccgtcaaattcttacacacgtgtagaagtcagttgtagtaatcaatatgtaatggggaaacagttttaaaatgagtctataaaaaaccgattttgtttctctttagatgtgttctacgcaagagtgtcttgttttgatcaggagaagaaaaaataccattaccatttcttattttaactatattgtgttgttctctcatgtaatgataatgctttttgaaggaggaagaaatgtagaaagacaacccagcagtaggtacaaaaagtttctcagactctgatgcagtctgcttagtactcttcctctgctaaattaactgactaacctgggcctgaggacattattttcctctgagcaaagtcagagagtttacaggatactaatcttacccgtttgtcttgttccaaccagcagagatagctagtctgaattcgctcgcacaatgtgattgtttgcagtaatgggtattcttgctagtaagatacataatcaaaatagttgaagatgtattttgaaatatttgtttttctttcttgttatttacttttaaagaacatcttatatttagtaattcctttttgtttaattcttttcccatctacccctgtgattggtggttttcaaattaaaccatttaaaagctagaatcttctagaaaatattctccagtatgtaaatcctaggtggaaattaggatgtattagaattgtcatgtgaataactgttcactgtctaatcaagtaggtgccgtcttcctattagcaagtgccttgaagaaactaatgagaaaaaaatcatttttcttatatatgacagatccgttttccccataaatgttacacattaacatagttgtttgtacaatcaggaagtgaagaagtacagttttttaaaaacataatggtgaaatttctattcatattaaataatctatgacaaccagttcataagtttaatttccatttagcaagatgttgaagtgagtttaggccaggcgtcgtggctcacacctgtaatcccagcactttgggaggccgtgatgagcagatcgcctggggtcaggggttcaagaccagcctggccaacatggtgaaacccggtctctactaaaaatacaaaaattagctgggcatggtgacgggcacctataatcctagctactcaggaagctgaggcaggagaatcacttgaacccaggaggtggaggttgcagtgagccaggtttagttgaactagctaagaggcaagcggcaataaaatgtattcagtgaccctcttatagaatatattctaagtgaaatacatctctgtacatttgtcagtaacagtgaaacagctttttgctaaataggtcactaggcttttgaaagcagaagattatgccatttgttttgattggatgaaccagacgtttcactaaaccacataatgtgaaaaaaatgcaagtctttttctatagtttaaatgtagacatcttgaaaatgagtaagtaatctaataaattataaagacctttgaaatggttttattgttttatgagaaactattgatttgtaactttgaatgtaagttataaaataatgttacttaaatatgaccagtttacatgaatgtttttatctgatctgcagaaattcaagattatttaaatatcattctttagagtgaaagaaatgtaatcattccattaacagtgttttcacagggtactactgtgtaaatgcagaaggggtgagccctttgatatgggagaagtaattgaaattctcgtaatgagactaagaagacaccttcttcacctaactcagttattcacagctaacttagtggtttgaggtcacatgttttactaaacacctacctagtcataggatagctattttttaaaaatataataagccaggacctaaagataagaagtcacttcttttgaccagagaagtggacaaaagttagtctaaagtagagataattacctctagagctttctggtcaccatcacaactgattgaggctaaaagtaaataggaggaccagagaaactgagaaagaaaggagggaaagagagagaatagaaagaacaggcaactgtgctgcacagttggagcgctactattgttttatgtaccacattggaaatcagtgtcatgggatgcctaccccttttattgtatttttttctttttaatttcttaatctaattgaacaaatacacaagtatctgcaattgtattgttgtaatggttaaaataaaaatacatggtttttattcatttattgtcaaataccaaaatcttacttagaacattagtatgctgcacaaacattgctatgtctcactttatgggttggttgcctttaaaaaaaacagaccattcacaagtaagttgtttcactaattgttaagaaacatttttcttttatggaattcctacaaattaaaacatctgctcactaaggatttccggtgaaattcctttatatgatcatatatagtcattgtattccagcatgcctttttgccttgtatttattcgtgtcctttcgtcttctctccaattattagaatttaaaaatgttgaaagcaagaattgttaggtttccacagtgcctagcccacagagttagtgcttagtaattaagtacgttgatttaattagattttattactgtcttctagacatcaactagtcaggcagtcttccgtctccagtctggcatctgccatctcttccgagaaactttaattaacaaaggttttgtggaaatccaaactcctaaaattatttcaggtatgcttcaaaatatttctcttaatttttaaaaataaatttgctctccccagagttgctttatattaataaaatttttaacttgagaatcccaagtgtccattaaggtttattgccatgagactactattttgaagaccatcttatatagcaacaatcatatatcaccaaccttaataagtacattttcttattccaggagtccttttgtgataatgattgtaatgtgaggcagtaacacacaaagcaagattcttgttacagaacttacaccaggaactactttcattatatagatttcttttgaaattagtattgcagttttgttttgtataaactgcattgtaaaatcagtaaatactaatgatgggaaaatttccttaattcttgttgcccaggctggagtgcagtgttgtgaattcggctcaccgaacctccacctcccaggttcaagcgattctcctgcctcagcctcccgagtagctgggattacaagcatgcaccaccacgccgagccaattttgtatgtttagtagatacagggtttctccatgttggtcaggctggtctcgaactcccaacctgaggtaatccatctgcctcggcctgccagagtgctgggattacagatgtgagccaccacgcctggctaattcttattcttgtatgagaatcttgtcttaatcattttaccctttttagatttgtttaacactagaaagtgtgttacaaatggcattttgttacaaattcacaattgaacattgcattcttaataattagaaaaatgattattccaggctgggcgcagtggctcatgcctgtaatcccaggagtttgggaagccgaggtgggtggatcacgaggtcaggagttcgagaccagcctggccaaaatgatgaaaccccgtctgtactaaaaatacaaaaactagccgggcgcggtggttgacgcctgtagtcccagctacttgggaggctgaggcaggagaatcgcttgaacctgggaggcggaggttgcagtgagccgagatcgtgccacggcattctagcctgggtgacagagcaagactccatctcaaaaaaagaaaagaagaatgattattccagctcctggggaaatttttttaaaagaggaaaaatgatgaagaatatattttttcattttaaaaaaaaaattttaacaactccaaaggggctttaatagttttgaaattgatgcagaaagggagcatatatatccacagaagtgaaataaaagcatagccaaagaagtaaatctggtttaaatataaactatttagaatcacatagaagatgatgtatatagactgtgatttagccacaattcttcattttccagtttttgttaaagtgagttacctgagtataaactttttaactagaggtttgcattgataagtttacaattgattataataatataaatataaatgtttacctttcagctgccagtgaaggaggagccaatgtttttactgtgtcatattttaaaaataatgcatacctggctcagtccccacagctatataagcaaatgtgcatttgtgctgattttgagaaggttttctctattggaccaggtaagattttggcagttatgttttatccaagttaattaattatacagcagttataattttagaaacattttacttatataatgtacagacactttgaaagcttaaattattttatctgctgactacacaaatgctagactttgagttagagataatatatttgggtagacattttcttaaaagtaatagtaataataatatggtcaatagtactttaaacagttgagcatcattccatgtgaatacaattataaacatatgtattcttacagaggaatgctgaagaaaatttttatcttgagaatatgtcattttaaaaatgcgtttcttgaaaatatacaccatctgaaatatacctaagtatatattttaatatacctcagtgcagttagaacagaattagctcccatttggactcttttcagctccctatcagcactgaagagcaggtagttgcagtggtcaaagaaatatatgtttttgtcctttataatttcttactcctgtaagtttacagtgtacctctgtctaatttgctatcaattttattccagagctgttctgtttcactattttgtttgtattgtccttactattggtaatgtgctgatgtccattagaaactactaacaaatatgttatatttaataaattatattaatatggtttttaagaaatgtttgctaaaagtcaagcacaggcacataatcatgtggcaaattcttttttgaagctaattgtaagtgaaaagccagcgttactttatttaacacttaccaagttattttatatatgttttttgataccttaataaaaattaaatacttgctaatagagaaactggcaagatcattaagggtcttaattttctgaatttattaactagttatttgttgaacacctgctgcttatataaccttgtgctaggtaccatgtacataaaagaagaaccagccagcacttctcaaatgttaatatgcacacagattacctggagatcttgttaaaatacagattctgatcagtaaatctggggagaggtctgagattctgcagttctcacaagtcctgggtattgttgatgctgctcatttccagatcatgctttgagtgataagggaatcaatattgtgcctgctcccaagactaagacatacatacatatcacagtcatagggaataatcaaataattttcacaatgaatgatcagattgtcctataccatcagcaaatgggtgttaattatgtagtataaatagtaactgtaaaaagagagaaaatggagtttgctagagtcaccataaaagaaaattcaaactgagatgtactttaaggacaaagtaggatatatagacaacagagatggagttctagacaggaagcagagtaagtaaagagcaagaactacacaagaaaacaaaaataagacaagttagtattaagaagtgagaaatataggttaggattaacttacgaaagcataaaggttttagggtttttttggtcattttatgtcttactacagtagtcatttgggaaccattgtaagtttctgagcaaggatgtattataggaatattagtgatgtgaaagatgagtcgaactagagtcaaannnnnnnnnnnnnnnnnnnnnnnnnnnnnnnctggactggatattagctggactgagctaatggctcttaatatcctcagtgccttttcctcctgtccagtcttcctgactctagctcgactcatctttcacatcacaaatattcctataaatgactactgtagtcaaatggaatacgtatgttactttattggtagagtttcacttagtttgagtcaggttttaataaaattgagaagaactcactatcttggtcataattgaatatatttttaaatattgagaagacacctcaggatcttgcattcccccagggttctcatgaacctctcttattaatttacatttggtacggcttttattgcacgaccgtaggagtttataatgaacttgctgtccaagataatgctcaaacagatggttcatcagaggtccttccagccctgtaatatgaaaataataccactggaatccaactaaataaaagtttgtatttaaatccctatttatccaaaattgaaatcagtgtttgctctctatttcttttattaacttcacagtattcagagcggaagactctaatacccatagacatctaactgagtttgttggtttggacattgaaatggcttttaattaccattaccacgaagttatggaagaaattgctgacaccatggtacaaatattcaaaggacttcaagaaaggtaaaaagtattttatgcacctagatggacttaatttcaaatgtttgggccctttaaaaaaaaaattcttcaatttaaacatacaaacttaagtttctatgaacatatatataaagatttaccagttagatgatccatttaattggttggaaaaatctacactcagaatactgcttctggatccaaatcatttgggggctcaactaattaacctctattgtgctagtaaatttaccacattgtgaacagtccaactgtattttgttgttgtttttgtttcctttatactgacatcccgaatgtctcaagaaatacagcatgtgtttcttttaacagtttatttgggaaacagtatgagggtagtgtgtaagaggttggattcagcaacatccagatagcctgagttcaaatcccagctctgctccttctctgtgtgggccttgtgcaggttatttaattctgtgcctcagtttcctcagccattaagtggaaatagcattattacccacctcagaggcaaaaagttccttcagtcaactgaatctgtcgacatgtaaattaagcctggtcaaatatggttaattcttaaatcaatttatatttacattaagtgctcagtaaagattagaaactagtagactgaacggatatttaaatctatttggatctgatgaattaacatttatagaaatattagatgtgttctagatgttcagaaaattgaatcatgtagaatgtgcacttcacctacaccctctaaactggcaaagagctcttccctttacaggtcattgaaagttgtttatttatgatgatgtttaacatagagaaaataggaaaagaaaatagaaccgagtcaagttgattaagaaagtctctatttttccctctttctgtatttgtgactatatttcaagtattaggtaagctataatagtctaagctagcattttaataagtgacagaagatcatatttaaaatttttatttgaagaccagcaattcaactattccttgttgatgtatttgatatgtttcattggtattttaaaagagttcaaaaatacgaattttatttactgcattgcagggctaatgagtatgtttaagaatgtagaaattggcctggcaaggtggctcacgcctgtaatcccagcactttgggaggctgaggcaggcggatcacttgaggtcagaagttcaagaccgacccggccaacttagcaaaaccccatctctactaaaaatacaaaaattagctgggcatggtggcacgctcctgtaatcccagctacttgggaggctgaggcaggggaatcacttgaacctaggaggcggaggttgcagtgagctggatcacgccactgcactccagcctgggcaacagagcaagactctgtctcaaagaaaaaatagaatgtagaaatcaatcactgatcttaagaatactgtagcataagtgccagtatttccaggcattctctgcagctttgtacctttgatagctagttaattgcagacagcctttttctttttatatctttgttctctaaaacattttgatgcagtttattttaatcagttttcaatggttcatggaacaactgataacattttccttataagacaaaatatactttagaactacaatgaaggagcacacacagcttttctcattttctgttcgcatttataatccaagaaagtttcagaaactcattttttaaaaatactgatagcttctccattaaataatagagtttgacatttccactttgatttttataacaacagaccaagcatgaatttgagtccttgggattaatcaaatctctacttacaaattagactcaaacgccattactgctgaactttttcagtagagttaaggtggcaatttgaaaataaaaaccttctttgtatgttcttcaagtcatttaggaattttaagttttggtgtcagggcttgtttattgggttatctgacctgtgtcatgttcctctcgtgtttatcattagtatttacctctcatagaaaaatacatatacaaatgtatttgtattctattgtatgtatatgtattgtatatatatccaaatatatatgtgtataaaatacatatataaatgtattttaaagtattgatagtcatatttttgtactaccattgatagacatgatgaatgggagttgatatataaagcaaagaaaagctatttaaaaatcatttgggagctgggctcagtggctcatgcctgtaatcccagcactttgggaggctgaggtgggcagatcaggagatcaggagtttgagaccagactggccagcatggtgaaaccccatctctactaaaagtacaaaaaattagccaggcatggtggcacacgcttgtagtcccagctacttgggaggctgaggcaggagaattgcttgaacccagcaggcagaggttgcagagagccgagacagctccactgcactccagcctgggcaacagagcaagactccgtctaaaaaaataaaaaacaaatttaaaaaaatcaattatggggtctttttaacccttcttacatcaagattttaataaatcaatggctaagctttattattcccacgaaagcctgtaagaccaatcaagaaatgatagtgttttaatttcgagaatataaattctaggccgggcatggtgcacatctgtaatcctaacactttgggaggccgagacgggcagattgcttgagcctaggagttcaagaccagcctgggcaacatggtgaaatcccatctctgcaaaaagtaacaaaaaattagccggtcatagtggcacatacctgtagtcccagctactcaggaggcttcaggtgggaggatcgattaagcccagaaggccgaggttgtggtgagccaagattgcaccactgcgctccagcctgagcaacagagtgggaccctgtctcagaaattaaaaaaaataaaaatagaatgtaaattctaggtaaagaattctatatataaaatacaaacatacttttttctgtatatagaatataaacatacttttttcaagtctgttaattatggaaaaatttcaaacacatacaaaaggatgtgcaatagtctaatgagcccccatgaactcatcaaccagtttcagtccttgtcaacctgtggccaattgtgtttacccatttccctcattcactattattttgaagcaaatcccagccatcatttaatacataaatactccagcaaaaatagacatttttttctttttctttttcttttttttgagacgagtcttgctctgtcgcccaggctggagggcaatggccgatcttggctcgctgcagccttcacctctcaggcccaaacaattctcctgcctcagcctcccgaccacacccaaataatttttgtagttttagtagagatggggtttcaccatgttggccagactggtcttaaactcccgacctcaagtgatcctcctcccaaagtgctgggattacaggtgtgagccactgcacccggtcaaaaatagaccttttaaatctcaataaaatatcatcttccatagcagaaattcagctcagtgcagtaaacattgtcctgtaccttctatatatatagggtaggcattgtactatagagattatcaaaatgggaaagaaactggcactcccctgaacatacagtgtaatactgatgggggaagataagacaaatactcattaatttggtcttcctcagtgataacaagaattgttaaaggattaaaaagtcagatttttgtaatgcttcataaaatgggcattttatatttctaaccatattaactgatatgaattataaagaaaatttttaatcctttgatgttactgtggttacaaaaacgagattgaaaaatggtgttaaatattttaagtatttaaatttcattctttaataatttgataatgcttttcctggtgtatatactgattcaaagattgatttttgtatattgccacagtgacctcttgtgggggaaacatttatctcatacattttattaactaaatcattctgcaaataggtttcagactgaaattcaaacagtgaataaacagttcccatgtgagccattcaaatttttggagccaactctaagactagaatattgtgaagcattggctatgcttagggaagctggagtcgaaatgggagatgaagacgatctgaggtttgtctttgtggctttttttttactttaagttccaggatccatgtgcagaacgtgcaggtttgttacataggtatacatgtgccatggtggtttgctgcacctattgacccgtcctccaagttgtctttgtgatttttaaaaccttggtaatttggtttaagataagaaaaaatgaaaatattaataaatgatttttttcacctgatacacttacattttattaactttggtatacagtatgatgctcttttatataatgtgtgatctgaaataaaagtgtttactatagtttgcctaagttttcataattttgtttataaacaccattttccattattttcccctcatgtttgtaactctttaaagagtatagagagttttgcctgtgattttatcttctaatatgttacttctctttccagattagtggtattagagaaggtagacagcagtctaaatccatccccacacaggatcggggtataaactgttaacatccaaaagttataaaagtcaatattgtttatatagtgtcatacatactatattatatatagtatttagtatagtattatctaaatttagatcatacgacttataattttgaaacaaattatgtagtttaataaagattgaggctgggcatggtggctcatgcctgtaatcccagtactttgagaagccaaggtaggaggatcatatgagccaggatttcgggaccagcctggacaacacagagagatgctgtctgtacaaaaaaatttaaaatttagctgaacatggtggcacacacctgtagtcccaactactccagaggctgaggcaattggatcacttgtgcccaggagtatcaaggctgtagtaacccatgatcatgccactgtactccagcctgggtgacagagtgaaagcctgtctgtaaaaaataaataaacaaaacatgtaaaggtaatttctatctacttatattttattcaagacttccttgaatgattcctttaaaccatcacaatacatgtgtatttaggagggaaaggaaatgattattgtcactttttagggtttctcaaaaaacaattcacccaaaaccctttatttttgtttaacaaaaaaaaatatatatatatggctttaaatattgcctacattgctagatgacattttaaggcaagatgaaaatcctataagcttaggtagtatttttttaagtattttagaaattgtttttacataagatagaagctgaagtagctacctcttggccatagaaatgtaacgtgtttatataaacacttttaaaaccttggataatactaatttttatttcataaaccattgataaagagtaccaaaaagggaagattatttcatggcaagactagcccatattagtatagcgaacttttattatgtgtaattgtaggaaattacttcatccatgatatttctgaatcaatgaattgctatattctgtttattgctttaattaaatatttgagcagcatctactaagcactgagtcactgtaccaaggtatactcataagtgattttcagtagtacttgccttttaagaaaagagcagaatagacaactgcgtgttctggccaaattttgtaatcccttgagaaactcaaatagaagaagttccttattaatgtttttaagttgccatttgatcttcaaacactgatttcacgtttctttttcagcacaccaaatgaaaagctgttgggtcatttggtaaaggaaaaggtaggactctttatatgctggatttctttttctaattctgaaatgtctcttgggactaaaaacaattgcagaggggtctgagcttcctagaatggtatgattctggaataaataaaaaccgaagaaggacaacattaaaaaaatttttttcttagaaaattgagaaatattcagacagcctgcctttctcccagatgatctgattaactcagtatttaatatttttacgaagttgttctgaggtgtctctaaaagtgatacctatgtcggattagttggaaatgacctccaagttatttgaaaattatttagaaatggtcttccctgtgtacccctgctgtctcatgagacttcaagatgaatgaggttcctctctccctcttatgtaatagctactttccaatctcattttctaaaaccaagactccaaagaggataaaagctaaacttagtatgatctttttaaaatttttaagataatgatataatgaaaaggaaaattagtccttgagctcctcctactggtggcagttgaaactgttagactagagaactgatatttctgaagtcatacaatattcagtttatacctttaaaatgctgtttcagcagagccagtttcagtttgtcagctattaacatcctcatctcaagttttatcaaaaatgttgaaagtcaaaaactgttggaatgtaattttttttttttttgagacggagtttcgctcttgttgcccaggctggagtgcaatggcactatcttggctgactacaacctccaccccctgggttcaagcgattctcctgcctcagcctcccgagtagctgggattacaggcgcccaccaccacacccaactaattttttgtgtttttagtagagatagggtttcaccatgtaggccaggctggtctcgaactcctgacctcaggtgattcacctaccttggcctcccaaagtgctgggattacaggcatgagccaccgcgccgggccctcaaatgtaatttatttatttttaattaaatctaggtcacatagtaagcattctctaaaaaaagtcataatttcaagttaatgtcatttatttctttcagttgtagcattcatttgaagaaaactaccaaaatctcatgtatatatctagataaaaatttaaattcttgggaagataatccatgtttttcaatgatggatattgtaaaatacatcaaatttcccaaaataattcatggacttaatatagtttctataacaatcaaaaggatttgagataatttttttcattataaaatgcatcagaatgactagatgaactagaataacaaagaaaaaagtaaaaatcaaagatgtttatcaaagtgtaatttagaatgggggagaaattagaaagggcttacatgttcaaaaaaaaaaaaaggaaaaaaatgaatatttaaaccgtaggcctggcactgtggctcatgcttgtaattctggcactttgggaggccaaggtaggaggatcatttgaggccaggagttcaagaccagcctgggcaaacatagcgagattccatctctacaaaaaattttaaaaattagccaggctcctgcttaagccatgatctcatcatgcactcgagcctaagcaacagagcaagaccccatctcttaaaaaaaaaaaatttaaaaactatggataataagtaatgcctaaaaattaggtattgcaagaatttatgacaccatggcaaaatgctgtaggataaaaatgttactgaaaaaagcaagatattcattgtatatacaatataattagagtaattacgaagaaccaaaatttttgtataaagttaattaccaaaatgttagccattttactttttaaaaatgtattttaattgcatttattctttttatagtatgatacagatttttatattcttgataaatatccattggctgtaagacctttctataccatgcctgacccaagaaatcccgtaagtaatttggttttaagtaacccattttgaggcagaagggaaattttattgtcactgtcagattgtataataggaataatggttttcattaataatttgcagttttgatagacatacgtattaccattgatgtctgtcaccactggtcaaaatgatattgtaaaatttgaatattctagaaaattagttttaaaaacctatgttaaaatcattttacttggtcatttttctgaagatttatgagagagaaagactatgtaaattataaatagtactactagatttgcatactttagtaaatcatcctgtcattgaccttaaactgggaattcacattgtatcctgggagttaataatctaaataatgtcttacggtcttttaccgtttttccattgcagtggtttctaaactttaccatgcatcagaatcacctggagggctttttaaaacaccagttgctgaggcagaatttctcattagttgctgtggaatgggagcctgataatttgcaggccccactccagaccaagtaaaaaatttctggtaatactgaagctactggtccaggaatcacactttgggaaccactggtttattgaaagacaggggattaaagtaaaaataataataatttaaagactcacacctgttaataacttggagttccaaaagtcaccccaaaataatatcattcttaaaaacatctcagatgataaagtgaaataaggatcagcactgcttcttaaaaattagatgtgatgctctgatttgttattggggggtgtgggaggagagcacagaatctgatataaacaaagaaaaagttattcagccctcagtagtttaattctactttagagaacaagattgcattgttaattgtaggaaaaaatgaacttgctcttcatgcagcagagatttttttccgtatatatgtaatagaaataggatggtagtcacttgaggactggtgttttttctcttgcagaaacagtccaactcttacgatatgttcatgagaggagaagaaatattgtcaggagctcaaagaatacatgatcctcaactgctaacagagagagctttacatcatggaattggtaaacaacttaaaataatttaggggagtgtatattctgaaaataatacattgtaaacatttaaaagacttctcagtctttttaaaaatctccattgaacagtaattgcttttgtgaccttttaagataaataagatgataaattatattttgttttgtgtctttttgcagatttggagaaaattaaggcttacattgattccttccgctttggagcccctcctcatgctggtggaggcattggtaatattctgttattgcttacaaataagttcataagttctaagtataatacaaatttgaattacaagaatttttaaaagtgaattacgacataagtgaaaatttgatttccaagaaacaaaataaacagctaacttgtgtgttataaaatattattgtcataaagttctagccattttttttctcttaagaatttagaagccaaatgtcttgtaagtggagtatcctgttttctctctgctgctgtgagttcattcgcattagcacaaattaaagctctaccttaaaatagctcaaagagctgctaagtgtttttattgagatgcagcacttgattcactttaagatcacttctacagtatatgtaagggactgctctgcaatttaaaatgagcaaatatttaactcatctttggatgtccatatcaaacactcttaaaaaattttttgaatgtatagtttcattgaagtttttatttgttgtttgttttggggttttttggaaaatacaaaatgtacttacaaaattttcaaattaaaattggtcgagagacagttttttcaacagatggtacagaaaaaactaatgtccatttgcagaagattgaaattagacccttacctaacatcatatacaaaaattaactcaaaatggatcaaaggcctaaatgtaaaacctacatataaatggccaataggtatatgaaaaaatgctcaacatcactaaacattagggaaatataaattaaaacctcaatgagataaccatctcacacctctggctgttagtaaaaaggtaatggataattgttggtaaggatgtggagaaaagggaatccttgtttgtaaatagttgatgggaatgtaaaattggtacagccattatgaaaaacaggatggagattcttctaaacattacaaagagaattaccatatgattcagaaattccatttctggtcttacataccaagggaaatgaaatcagcatgttgaagagatttgtgcactctgatgttcaatgcagcattatttacaatagccaagatatagaaatgaccttagtgtccatcagtggatgaatggataaagaaagtatagattgagtatcccttatccaaaatgcttgggaccagaagtgtgtctgattttggatttttttcatttgttatcatatttgcattgtgcttactggttgaacatgccaaatctagaaatctgaagtgctccaatgagcattttttggtttttttgtttatgtttttgagtatcatgttggcactcaaaaagtctcagattttggagcattttggattttcatattaggaatactcaaacctattttatctatacaatgaaataacactctgccttacaaaagaaggaaatcctgtcatttgtagcaatgtagatgaacatagaggacatcatgctaaacaaattagcacatcaggcacagaaagacaaatactgtgtgatctcacatatatatggtaccttttaaaagttgaacccatagacaaagagtagaatggttgttggaatggggagaagatggtcaaagggtataaagattgacttaggatgattaagttctggagatccattgttccacattgaaaattgctaaaagagtagattttaaatgttctttccacaaaaaatataggtatgcaagatgatagatatgttaattagcttgatttaatcatttcacagtgtatcagagtgtcacatcatacactgtaaatacatacaatttttgtcaattataactcaataaagctgggcaaaattttaaaaataaatagcaccagttaaggtcgttacatatggttttttattttttgtttttttaagttctgggatacatgtgcaggatgtgcaggtttgttacataggtaaacatgtgccatgggggcttgctgcatctgtcaacccatcacctaggtatgaagccctgcatgcattgctctttttcctaatgctgtcccccaccccaccctcccgacaggccccagtgtgtattgttcccctccctgtgtccatgtgttctcattgttcagctcccacttataagtgagaacatgtggtgtttggttttctgttcctgcattagtttgctgaggataatggcttccagcttcatccatgtccctgcaaaggacatgatctcactcctttttatggctgcatagtattccgtggtatatatgtactacgtttactttatccagtctatcattgatgggcatttgggttgatcccatgtctttgctattgtgaatagtgctgcaatgaacatacacgtgcatgtatctttattactcagaatccacaaggaacttaaacaaatttacaagaaaaaagcaaaacaaacaaccccattaaaaagtgggcaaaggacatgaacagacacttctcaaaagaagacatttatgagccaacaaatatatgaagaaaagctcaacatcactgatcattagagaaatgcaaatcaaaaccacaatgagataccatctcacgccagtcagaatggcaattgttaaaaagtcgagaaacaacagatgctgacaaggttgcagagaaataggaatgcttttacactgttggtgggaattttaaattaattcaaccattgtggaagacagtatggcgattcctcacagattgagaaccagaaataccatttgaccccgcagtcccattcctttggatataaacatgattttttttaagagttatagagatgaatggcagtgatgattgcacaatgctgtgagtgtatttggcactactaaactggacacttaaaaatggttcagatggtagattttttatgtattttaacgctgttttttaaattggaggaggaaaaagaatagtgcgtattcgcctccctacaggaaagcattgtttctagttttcagcttaacctttgcaaagataccttttcatatacgaaaagacacacacatttctttaaatatttttacacaaattgtagcatactattatatataaaccatttagtactttgcattttttacttaatgtatcatttttttaatatgagtccggatggagaagaaatactttaatgtatcttgtaacttgtttcctatcaatacctgaagagctttttcattctttttacatctctacatagaatcaattgaaaggagagaccataatcttgttaaccaccttccaaaaatcagtttcttctttacagtcaaaacacttagtataataatgtactccagagctttttatcgtagggtccaccatgttaaatgtctataaaattaacagtaaattttctcatacttctattattgcttaagcaagtttatggctctcatcctcattgcctggactgtataatcagagtgtggtatcatttgaaacgttcaagcttataaagtcttttgttttgtttttcttattgttacatcatagattttgttcattcgtatagatttttgtggttcacattttagactccataccactcaaggatatattacttagtccttttcatttatagcagcatctttatttctgaatcaatactcaaaacagttttaaataaacccaaaataataagagtcattttctttcctaacaaggaaaagtatttagtttaacgattacatttatgtttgtagttctaagtaagaccctgagagattttcaaaaaggaattaatgattatttttgtcttccccaggattggaacgagttactatgctgtttctgggattgcataatgttcgtcagacctccatgttccctcgtgatcccaaacgactcactccttaaattcacactttgccacttaactccagtgtggatgacagagcgagaccctgcctcaaaaaaaaaaaaaaaaaaagaaagccacacttattcttttcagtaacctgctagtgcacaggctgtactttaggtacttaaaatatgcactagaataaatttgcaaggccctaaaatatcactgttatttttggagtaattcagtataggttcgtttaaaagagatttttataacttcagacatgcatcagtaggaaataacttgagaaattcatatggttatgttacaaattcatattctgttactacagtaaacgttaagagttttaaacagttaagattgtacaatttttcttcttttctatattacaagggccccagtgttaatgtcttagattttcagtatttgaacttatttttttaaattctgtcattgagataagaataattcaggtagcatctgaaattttaatgaatgtataattggcatatcatggaaaattaaccagaaagtatcagttcttaaaagttatgcctagaaattatgtaaagctaaactactggttagaaagtattcagtgtaatattgtattaatttgttaaattctaaacttgaatttcaataaaattttaaagctaattgtagtttttgtgtaactttgtggccaactgattttgtaagtggtgctaggcattcataatttggtaaaagaaaaaatacacaactagtttatataaataaagactaatatgttgtcaacatgtattcatttcaggatattagtttagatgggcgtagggatagagctcttaaagttgacagcttgggtcggttgacagagttcatttcacatgggttaaaatatattgcagaattttgtttgatttttaactggaatggtactgatacttagtgaatgtcagtaaaatccagtcccatcttatccgtcaaaaagaaatttttgtgtaagaattagttagaaacactttccctctagattattacaaatgttgatgctaatgttaattttacatgaccacaaatattggggaggaacaaaacataacatatttttgtacaggaagaaaaaattacatgcagaaaaatatgagggtcaaaaagttaggaagttacccctggaccacgaacatctgcccattatgtttgaaagttaaagggggtgtttaccatctatattgtacagtctttgaaagtttagattcagttcttatttttttctttcatatcctaccagaataccttaaatatagaaggcaccccaaaagtatttcataatttaatccacagcaagaataaaatatccatcttctatagtgtgtaattgctagaccctaaaatagtacaataatattggccctagagctgttcttaatttcatgtaattatagcttgtttcaaaataaagtttgtaaagtcttagaatgatgtaatcttttttattgtgaaggttttcaaacatgctgaccaaattagaacatgataaaatacacttgtacctattatccagtcttatcaaatctttatcatatttgcttcaaatatttttttttatttttatgtatttgttttgagaccaggttatgagactggctaatttttgtattttggtagaggtaagatttctccatgttgcccagtctggtcttgaacttctggcctcaagcgatccacctgccttcacctcctaaagtgctgggattacaggtgtgagccgctgcacctgacctcttatttatttatttttttgagacaagtcttgctctgtggcctaggctggagtgcagtggcatgatctcagctcactgcaacctccacctccccggttcaagcgattctcctcagcctcccaagtaggtgggattacaggctcccaccaccatgcccagccaatttttgtatttttagtagagacgggatttctccatgttggccaggctgatctcaaactcctgacctcaggggtgatccgcctgcctgggcatcccaaagtgctgggattacaggtgtgagccactgtgcctggcccttactttattttttaaagagaaaagaaatcaaaaaaaaaagaaattgtgggcagttaaggtaccctcttataggaaactattatatgaattcaaacttttattcttttgtttttatattttcactaaatatttatgtttctataaatgtctaatattgttttgcagatttatttgatatgtaaatcctgagattttcattggaactaccttaaatttatagaataatttgaaaagacttggaatttccctctctttagtcttccagtggatgaacatggtatatctcttcatttattgatttttttaattgtagtaaaacatttttattttatactttaaaagtgttttgctttttgtgtgatgttattatttatcctatcagcattttattctcaagattatcaaagaatttagtactgttaatgctggaagcaaatatctttccattttagctctatatccttgtgctttgcagatctgaagatatttcagctgagtcagaacagccttgccaaggatctgctaatcatgtgatgaagggagaaactggtgaggtagcttagtgtttttttgtgggcaggatttaatga

SEQ ID NO: 14210 - DNA, 39949 bp, Human
aggccgaggtggccgaattgcctgagctcaggagtttgagaccagcctgggcaacatggtgaaaccccgtctatactaacatacaaaaacaaaaaaacaaaaacaaaaaaaatcagccgggcgtggcggtgtgcgcctgtagtcccagctactcaggaggctgaggcagaagaattgcttgaacctgggaggcagaggctgcagtgatccgagatcctgccactgcactccagcctaatgacagagcgagactctgtctccaaaaaaaaaagaaagaaagaaagaaagaaaagaaagaaaaaaaagaaaaagaaaaaatttttcaataagttggatttggtggtggcaggaaatcccagctactcgggaggcggatgcaggcagattgctggagaccaggtgttcaaggtcagcctgcacaacatagtaagacctcgtctcaaaaaaagaaaagaaagaaaaaatatttttaatatgcaacaagcctcaaaaaatggaagtggtccccgtttctcttaatgtcttggaggccaaaaaaaggtactggttggtgaaatacacatatagatatcatcagtacccagatgttaattaacgccaagggagtgtaaagggtcgcccaagagagcgactttacgggaaaagaaggctctggaaccagaacatttaaaagactcactgaaggagaggcgcctacaaaggatgctaatcaggaatggccaaagagatggcagaaaaaccaagtgaaatggttagggaaagatgggggaaaaaaacataaggataactcaagccaatagtgcattttaagaagggtattaaggccgggcgctgtggctcacggccgtaatcccagcgctttgggaggtcgaggcagacggatcacctgaggtcaggagtttgagagcagcctggccaacatggcgaaaaccctgtctctactaaaaatacaaaaattggctgggcatggtagcgggcgcctacaatcccagctattcaggaggctgaggcaggagaatcccctggacccgggagctggaggttgcagtgacccgagatcgcgccactgctctcgagcctgagcgactgggtgagacttcatctgaaaaaaaaaagaaaagaaaaggaaaaaaggtttattcaaagtgtcaaatattcctttcttttcctgctccttccttttttttttttttttttttgagacggagcacactgggtggcccaggctggagtggagtgacaagatctcggcccactgaaacctcctcctcccaggttcaagcgattctcctgcctcggccacccgagtagctgggattacaggcgtgcaccaccacgcccgactaatttttgtagggttaggggagatggggggtctgcatgttggccagggtggtctcgaactcctgacgtcaggcgggccacatgcctcggcctcccaaagtgctaggattacaggttgtgagccaccgcgcccggccaatgtcaaatatttcgctgattttcctcggtcagcaccaccacaataattgtgccaccttacccatgcaaggtttagacatctctttgactcttttacagggttttatactgtggtttccattatttcctctaactagacagcagaagcggcttactcatttttctcttccatagagtcttactccgatcgttcaattaatatcagtggaatgatttaaagaacatttgaaaaaccactcggacaaaaccctcagattcgaacttgttccagcagccaaaaatacccgcgggccacggctacactgcgcaggcgcaaaggcagatgggctttctccagaagggctttgcatttggcgcgaaatccctttccgtgggctggggctcttggagaggcgccgttcattggtcaggtttggcgcgaaatctccagctcctgtgtcacgattggttccggccgtgcaggtcggaagagggggcggggcggaagcggcggcggcgcgcgcaaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtaagtcggcgagcgccccgggcctcgcccgcctccggagcctgcggcgtctgggccaggcggtgccgtgtgggcggcgggtgttccggaacctgggggtcgcgcgtccgggaagcgcctccccgcccgccccccaactttaggctccgagcccggcggccgcgaggagcctgggacaggctgggtttttctggagtaaaacccatctcgagccctaagacgctcgtgcccagtgctcagcgctttgcttctgtcacttgatgctcaccaccccgcgagcctggtatttgcacagccctcggtgaccggcgcggaaacctgggctcgctgagtatagtaactgggccgctgggtgcggccaggtcgagtgggaggccgaagtgccattgaatctcgtcggtgccctgctgggccacgcagccgggagcatggtgctgggggttcgcagggcacgggccaccctcgcctcttgtgctgatgaaagtttctgcgtcaactgtggtttgaaagctgctggggggcggagccctgccctgcagagagtagctcaccatatcccttcttctgggtcccttgctcccctttccctctggccttcctttcctttctctactcttctttttttctgtgcctctgggctcctagcttcataaccccaacctcctccctggcttgcctcacccaccggttatttttcctggagcagatacaccacggcctccaggatgaagggtcagcagtttggaatggcttttgaagttcttttttagtaaaatatacataacaaagttgaccattttagccatttttaagtgtagagtccagtggcactaagtgcattcacctcgttgtgcagccgtcaccactctcccatctccaaacttttttttttttgaggcgtaatttagcccttgttgcccaggccggagtgcagtgtcaccatctcagctcaccgcaacctccgtctcccgggttcaagctattctcctgcctcagcctccctactagctggaattacaggcatgcgccaccacgcccggctaatttggtattttagtagagatggggtttctccatgttggtcaggctggtcttgaactcccgacctcaggtgatccccccgcctgggcttcccaaagtgattacaggcgtgagccaccgtgtccggctccaaactcttttcatcttccaaactgacattctgtgcccattaaacacgaactctcctccgttaccctctccctcagccaccgtcacccaccactctgcttcctttcattatgagtttgaccactctaggtacctcatataagtggaagcgtgtagtatttgtccttttgtgtctggcttgtgtaacataatgtctacaaggttcctctgcgaggtagcatgtgtcagaatttccttactttttaaggctaaataacattgtctgtacacattgagtatcccttttctgaaacgcttgggaccagaagagtttgggatcttggatttttttttcagatttggaatgtttacattatacttaaccaattgcatccctaatttgaaatgctccagtgaaaatcatgtcagcactcaaaaagtttcagattttggaccatttcatattttaaattttcagatgagggctgctcaacctgtatatatactgcattttgcttatccattcagtggacacaggttcattccaccttttgtctattgtgaataatgaggttcattccaccttttggctattgtgaataatgctgccttcttaggaaattttggtatacttaaaaccataatttaatttccatttcactacctatggcaatgttattgtctgcctgatagttcctccttcaaagcccagctaaaaactcacacctttgtgaaaccttgtacacctttttgagaggcactaatcctttcttccttaggctcccagggtgctgtttgtttttcattatctctggcagtgtaacacatttacctcctagctacttagtctggaattcaaattccatcctcaaccccacctacccaccacatcacattacaaaggtttttcaataaacgtttcatttcaacaaataatctaagtgccttgactttgcagctagatgataatgatgagacaaataatctctgtgctttgtttaaagaaatgccaactccctgtcacaaaataaactttaattcaccattgcttgtggaataaagttcaaattcttcatcactcctctttcctgtttgtcttacaaaaacaccccagtcatcatccacacttctcccctaccttctctgacttaatcacattcttggaatcatctagtcagtcacttcaccacctgtttttatttgaaatttttaactctttcagaagctgaattccaacgccaccttttatatgtatgacttgtagttgtttttttaggcagaattagtttctattcccctagcacatttcttgttcttctcattaacaggaacatctttcttgtctgtcttcattgcttacatgtctaactccctagacgcagacaaagtgttagttaaccctagggcaggaacaacactgccattttcagcctcagttatagggctttgcacgtagttgtttaacaaatattttaaggagtcagaacatgctgtatatggaggagaaattgattttttcttaaggcgaatctgcatattatgtttgaaagaacagaaataaatttgtatgatatcctgcttgggctttagaagcaaaaataccagcagctttatttagtgtgcctgtttcaattttccctaagtcttgggctgtgaaacacctcatttccatgtattcttacttctgttctgcttcttaaatccctgactaatttgttagtttgcaaattccctacagaaatggaatcattgggtttgagactgaatttcttgatttaacattttccaatcttaattatacatgacagtagtaaaagaagagttagttgttgggtttttttgttagttagcagttaaacctcacaatcatggtggaaggcaaggaggagcaagtcactgatgtcttacgtggacggcatcaggcaaagagagcttgtgcagaggaactcctctttttaaaaccatcagatctcgtgagacttactatcagagaacagcaggggaaagacttgtccccatgcttcaattaactcccaccaggtgcctcccacaacatgtggaaattcaagtcgagatttgggtggggacacagccaaaccatatcagaagggaggagtaacttgccccaagttacagaactgccaaacatgggcctgtctgagcctagttgttggactttaaccaatgttctgaattatcattcaggttctttgtactgcctgtgtccttaatctagttgactcgaatgtacctgcaggtttcagagcagcgatggagaaattaaatacttgcaattagcagaggaactgattcgtcctgagagaaacacattggttgtgagttttgtggacctggaacaatttaaccagcaactttccaccaccattcaagaggagttctataggtatgggcatattaatcttctttactttgaataggggttgaaatccgggaagccagctcttcttggactgtaagtgttcacttgtgtagcagaaggtcagctttcacagttatttcccactgagaagaggcgctttgatactgccagtggtcgttttagtactgctctgaacttcatgtaggcctttgtagagccgaacgtttttttgttgttgtgttttgtttgtttgtttgtttgtttgttttttgagacggagtcttgctctgtcacacctaggccgaaatgcagtggcgcgatcttggctcactgcaacctctgcctcccgggttcaagcgattcttctgcgtcagcctcccgaatagctgggattacaggcgcccaccatcacgcccggctaattatttacattttttaatagagacggggtgtcaccatgttggtcaggctggtctcgaactcctgatctcaggtgatccgcccgcctcggcctcccaaaatgctgggattacaggcgtgagccaccgtgcccggccagagctgaactttttttttcaaatacaaatgttgaaaatctttgctttctatatagttttcccaagaggaaaactgtacttacttacttttgtgtcattccattgatcctttttccccacaggaataggtgtttgtgtgggtccttttcttgtactggggatatctttacagcattgacgttgttgtacttcttgttcccttaaagtttaattttgttttcgcttataaaagtaataggtatatattgtagaaaatggagaagagtaaggagaattaaattgcttatacacttgtaatccaccaccgtcattagcagatctgctacaacagagttccaggagccttccaagtctgcaagtgcagagttttgtaaggatcttctgtcacattttgatgtctttgtgtgtgtgctgtgtatgaaattactcaaattcatataaaatttcttaaactcatactaatagctccaattgtggttttttggtagaaatactatggttagacattatatttaatagaaggcttttattttgttttgacttgttatatatagcaagaaacatctttgcacacaagactttgtattaggattaaataaatgtgacagtctatagaaatagaatcaggttaaaataaattgtggacagttgtgaaagataaatgaaaacccagggataaggaggcacagtctcgttcatttcttagtagattaggagatggaggatttgtctgtgtttctggtcatagctgatgatcaagaataattggagggggtaagtaagcaacaggatttattgtgaaagcatgcagcagtagaagttatagcactgacaaataagggagaggtagacaatcaagcctggtggtagaagcagctgtgccatgcctcatgcacaagccaggcagcagttctctttcctgagagtagcgccttttttagagggtttcagaccccacttcttaaacaaactaagctggagtaggtattagaaacatatcaaaaggacatgcatacttcactctcaccagtcaaatggagcatttttgccaatttgttctcacattagtgcacaaatacttctcctgtcctcatccatttcttatcaaaccagccagatgtggtggctcacacctgtaatcctaacactttgggaggctgaggtggatagatcacttgagcccaggagtttgagaccagcctggacaacatggtgaaatcccatttctacaaaaaaaaccccacaaaaattagctgggcatggtggtgcatgcctgtagtgccagctactcagcaagctgagatgggaggatcacctgagcctaggtagattgaggctgcagtgagctgtgatcgtgccactgcactccagtctgggtgacagagtgagaccttgtctcagaatgaaaccaaagaaattgactgacttgacacatgacttactaagtcataaacagcccacagaaaattcacagtattgagcataatattgacaagatgattgttcagctagtcatcttggacagaggaatggccaacagtgtgggtgctctatgattatttatgtgctatatgataatcaggtatggtatgacattttatatttagtgttccggtgggataggagagaactgaaagagggtcctaaacctagagtagataatagaagtgtcctacacagttaagttctaaggtttagttgtaaccagatgaaattccttaatctcggctgttggtaggtatgtaaagggaaggaggccttggtaaacctctaaggtatcagctgacttttttgtttttcagagtttacccttacctgtgtcgggccttgaaaacattcgtcaaagaccgtaaagagatccctcttgccaaggatttttatgttgcattccaagacctgcctaccagacacaagtaagaaacccttctctggaaaaaaaggaattcaccaaatggtataagtaccacttagctgacagtcagaaaacttgagaggttgccttgatctgctattagctggctatttaacattatacaaatcacttttacctccctgagcctcagtttccttgtctgtgaagtcttttggcttaggttttctacctaaatcatgcaaaaaataggtttgttgctgtaaaattactttttcataattgataatcacaataattataaaacaagtacttataaaattgatgctgtaaaataccaggaggaaaaaatagtggtttgcattcagattttgtagaaggttgacttttgtaggagttatacccacttatccagaaagtttagtgttggagaaatgtattttcctatggagatgggattagatgtaaagggagtgaagcaaatttttaggattatcacattttagggcgccttttagggaaatttgggagaaaattgatcaagggagaaaatatgaaattctagaaattcctgaatctctggaaatttttgttggtttaaatgcataattttcaaacacccctttggcagttattttaagaataaatttactggataaaattgaagtgatattttgaaaagttaaactactgaaattataaaattaccaaattacttcacataaaatgggtttgtaaaggaagtgtttctgaactttgagtacaaaattttttctcatgataggattattatgtaacacatgcttttttttttagaaattgcgggtaagcaaaaaagtatttgcatataaaacaaaaacaggatcattctgtttttttttttttttttttctgagacagagtcttgctctgtcacccaggccagagtgcagtggcacgatcttggctcactgcaccctccacctcccgggttcaaacaattctcctgcctcggctccccgagtagctgggattacaggcgcccgccaccacgactggctagtttttgtatttttagtagaggtggggtttcgccatgttggccaggatggtcttgatctcttgacctcatgatccgcccaccttggtctcccaaagtgctgggattacaggtgtgagtcactgcgcccagcccgttctgttttataattttaattttcatttttttggcatcctttagttcatttatatattttgttctggatacatatacgtcatataatttaggattgggcacgttgactaaattattcttataggagagtccaaagaataccttgtctcttgaattttttttttaaacataaattatctttgaataccctctcactaaaatggaaagattcttagttaagagatgaatgtttactaatgggacatttgtctttaaacaggattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggtatttatttaacatctgtttagatcagagtccatctatgataataattcacttctaggcccttgcaatagcttatttagataatgttcaactcaatttttatgtaagttaagcatcatcaaaatgactacaaagttaagcccaaaactgttcatgtaaattataattgttagtatatacatttgttttaactttcagtaacttggaagttccttaagactgacaagatgtatttgtcaaagaataaatggtaactaggtggtggtggttgtcattatgaactggagttaagaaaacttaaagaaatagcaacttgttagtgtaagatttccatttgctgcatagaaaggaaagcatgaataggacaggctagcttggaagcaatgaggattatcatgattgaagtaaaggagccaaattggagatcatctgagagatgatttgatgtgagacctggaggtacttggatccctaaatcttaggctgaggagtttgagcctatcttaataagcagtgggaatatagtgggaaggtagtttgtgtgtgtgggtgtgtgtttgttttgttttgttttttgtttttttttgagacagtctctctctgtcacccaggctggagtgcagtggcgcgatctcggctcactgcaagctccgcctcctgggttcacgccattctcctgcctcagcctcccgagtagctgggactacaggtgcccaccaccacacccggctaattttttgtatttttagtagagacagggtttcatcgtgttaaaccaggatggtctcgatctcctgacttcgtgatccgcctgcctctgcctcccaaagtgctgggatacaggcgtgagccactgcacccagcctgtgtgtttttttttaaaagcaaactgaataagtccgtgatgggtttaacagagggtaataggcaatttcagttacctgggcaagaggtgatggatggcagtagtaagaatgaaggggaccctcagatttcagcaggacttaattttatgggacatacaaaatggaaagaaaagctgaagcagctcaagtatggaataattattatcagatgaatttaatattatttatattgctctgataatcattctccttatttggctttcttacattaacctggtagcttataagatgcacatattttaccaacagctttgggtaggagatgtcttatcttataaagtatgaatctagattgggtcttagtttgggggggggaacacaactgtataaaggacactcttgacaagacatttgaagatggactagataatagaagatatgtaattttatgaaattaaatattgtttaattatcttggttgtgataatgatattgtaacaggattgtctttattcttagagatgaatgctaaaatatttaggtatgaagtttcttgatgttcacaactgtgttcaaatacatagtaaaaaaacatgtatctgtaaataatgttagcagttgtgttgaagtggagggtataaaaggtgtatttgaaattttctgtaaaattatcttaaagcttaggagaagatggagcatggaacagatatttggagtcattttgaacaaagaaaaaaattattttttaatgagtaaaagtgaagttttttttttctctgctgcttgaatcatcatggagtttttaaatagatgtaatctcttgccaaattgaactatttgactaaaaggagttttagagtagataatttttaggataaatgttggtacatgtgaaaagtctgctaatgggtcagatagtttagaatacgtccgtatttgtggtatttaatttagattatatggcatctgaaaggtattgcttctcattcttggttggttgtttgtctgtattacaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggtcagtaatctgtggctcaaatttaacaaattctcagttacctaaactgcacagtatctagcttcccacatcttcattgtcttctttttggctaccaatcagaagctgaggaacgaagtgtgatgagaataaaaacaaattggttttgccacaaatggtgctattctgaaagtattcaaggcttaagtgaagtctttggatttatagctttcatttatttgagcaattttgatgttcagcacctttaatatttaagttgtgaaacaacctatcattctgtttcaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaagggtcagtcgttttgggggtttttgtttgtttttgaaacagtctctctctgtcacccaggctggagtgcaatggcaaagtcatggctcactgtagcctccactttctgggctcaagtgatcctaccatctcaacctcctgagtagctgggattataggtgtgaatcactgcacccagctaattaaaaaaacttttttagagatgaggtcttgctctgttggccaggcaggccaacagtgagtcttagtagagtgacagcttaagaaacacctaccctgagctgccacgaaatgataggattctgaaacatctgggctgtctcatcaatgttgagagcacgggatggggttaagatttgatgagttttaaaaccaaatcttttgacgtatgcctttctgatcttgaaaaaaagtcttatttgatgtcttacataaaagctcaatgcttttaagtgcagtggtacaaattatccacgctgttttttgttttaaagtttcatagttcctctgttattcttctggaggaaatacaaataaaaagatttagtaatctgggaagtaaacttctgagaatgatgaacccctggcagtatcattcagttaacttgattctgtgtcataaatgggagtttggaaaatagttcagtattggaaaaagggagtgaacataatattctcttattttatttgcatctttatgtcagtgattaacattctgctatcgcttatctcttgagcattcaggtagctttttttctatttaactcactggacaaatgacatacccttaagtgtctttgttaactgagggcttactagtttggggagttgtttttttttaaacctttacagtcaataaattgtgaggttgacttcccacgctatgttgtgtttgtaatgaagtttcttctcctttatgctcttttgactgcttctatactaatgattcttcctttgttctctaccattagtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggtaagaattccatccatttgtaccataaacttgaaatcaaaataatgattataaacagccacaggtgatttctgaaagcacataaatcagactgtgaaagtttttagtgggtctgaaagaggtcatttacaaaaggacaggtacatgatttcacttatacgaggtacctgtaatgtgcaaattcatagagacacggtaggatagaggttatcagtggctgggggaatgggagaaatgagttatttaatggataaagttgctatttgggatgatgacaaagttctggaaagggatagtggtgacagttatacaacataatgtacttactgccactgaacttatacactgaaaaatggttaaaatgatgagttttattatgtatttttatcacaattttatttttttaaggaaaagttattttgtcatcttatttcctggccttatgacagagctgcacttaagtgtgtttccatatgctagactagtctcctggcctttttgtggttgtagtctcctggccttgttggtgtgtgtgtatgtgttttagagagacggggttttgctatgttgtctaggctgaagcactccctcctgggctaaagcaaccctacctccagcctccccagtagctgggattacaggtgtaggtcaccacattggctcttgtttctctttttatttaccaaaatggagtgtttatgattggttacttgttctgtctatacctttggcagtttcacattttcctgactcttggttgcaagctgtgttttgaaggctatgactaaaattttaggcctgatgctttatctttgaactcttccatccttgtcttccatactcaattaggattatggtaagaactcaacctttttttatctttttttattctattttattttgagacagagtctcactctgtcgcccaggctggagtgcagtggcgtgatctcagctcactgcaacctctgcctcccgggttcaagcgattctcctgcctcagcctcacgagtagctgggattgcaggattgccccacaacactcagctaatttttgtatttttagtagagatggtgtttcgccatgttggccaggctggtcttgaactcctgacctcaagtgatccatccgccttggcctcccaaagtgctgagattacaggcatgagccactgcatccggccctttttttctatctaaatataagtcagagaagttttgtttgtggaagggatttttagttttctacctgttttgttttgttttgttttgttttgttttgttttgttagggtcttactcttgcccaggctggagtgcagtgacagcatacattgcctactacagcctcaacctcctgggcttaaacgattccccaccacagccccgaaattagctgggactacaggcgcctgccaccatgcccagctaattaaaaaaaatttttttttttagagatggggttttaccgtgttgcctgggctggtctcaaacctctgggctcaagcaatcctcccgccttggccttccaaagtgctcggatcttccagagtgatcagattacaggcataagccaccacacccagcctaattttctgctttaaggaatgccttgtgtaactttgcatagcactttgttgatggagttcagagagtcgacagttccacagaaaaatgtttcttttaatagcacagtgttcttttttaagaaaattgtttttccttcttattggatttatgaactaagcagctgtaaattgcattcagcatcttatttaatccacatgaattcagttaacatatatttattcagtgctggtcactgtaggtgatagaaaagtgttatgaaccatttcctcaaactcttcacagaactataagaactggcattaaaaaggactagcaaatgtggtaggccttggtggacatagttcatttatcaggagagatctttgagggctaaggcattgggtaaggttttgtgtaggaagtaggactcatggacaagtaaaggctcttaggatggtgagcactggcacggtgacatctgtggtgtaggagaaaacattggaacagtggtttaggtgactaagtccacagaacaagaaccaagatcggaagccaggtgttattactccagttttatgctttgctttagctgactctgcctttcggttggtaaacatgcctttactgtttcttctgaaagtgtttaacttcatgttgaaaaattagtttttcatctgtagcttcttttcatttcaggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagtaagcgtttgcctgatacagtgttgcaggaaaaagtgtacatagttcccaggctggctgtgctaccaagaatgcagtcagtatggccttactaggagtgtaaattatgactatgttgaatatataattctcatagattaaagttatggcaacattgtacaattttttagaatagggaaaaattgcctgtaataccaatctcacattgaactgtttagtctttgtataatatctttgtaaaatatatttgtataaaattttatacaaattttattatttgtataaaattttatacaaattttattatttgtataaaaatatgaattatgtattttcattattgtaaatcatattatacatacttgtaatttcaattttctataaacattttttccatgtttcttttcgcatggaaaaatctcatgagtttgtcattttcacaattgtctttttttgttggtatactatagcttacaaaatcattttcttagccctgttaaatttaacaggatagtttattataataattaccgatatagatgcagtgaacatcataatgttatatacattttttgtttgtttcctctgggtaaattgctagatacaggattgttgagactaagaatacaaacatttgtaaggttttaaaataggatgtactggccgggtgccatggctcacgcctgtaatcccagcactttgggaaatcaaggcgggcggatcatgaggtcaggagatggagaccatcctggctaacacggtgaaaccccgtctctactaaaaatacaaaaaattagccaggtgtggtggcgggcgcctgtatacagtcccagctacttgggaggctgaggcaggagaatggcgtgaacccaggaggcggagcttgcagtgagccgagattgcgccactgcactccatcctgggcaacagagcaagactccgtctcaaaaaaaataaaaataaaataggatgtactttccaaagggaatgctgctatgagatattttatgttaactttgtcagtgtgaacacaatttttgactgtttttagaagctataataaatatttgattactttcaaacttttaagaaacttagggcccaaaataaaagcaacaagtttctgagcacctgccatgttctcagtgctgtatatgtgttatgtcttactctagcagcacccagacaggcatgtgtattattccctttttttttcagagagtcacaacctctccaagcctacaagaaatttgcccactttcttgtaggtgaaaggtgacaccgagccatgaatattaaaattcagatacagttgcctgcaaaacatgtgtacttcatactacatcaagctgccttttctttgttttggaaatttgtagcatagtaccattttagaatattgaacatttttagttggtttggagttttatgattaaatatttcttttgaacatatcacagactgagttttagattttaagatagtagtcctgtgttacaaaggattcttttttttttcttgtcattctttctcccccctcaaaaagaaagatgtactacaatgttgcctctggtaacagtgtcatgtggtatgtgacagtcttagtggattccatagcattttctatgtataaaatctgtatataatgatagtcggagtatccaatctggctgcctttttttcttgcctaattgtccttgattagagccatcagtataatgttgaatagaagtggcaagagcagacatccatgtcttattcctgatcttaggggcaaaacattcagcctttcacctttaagtttgatgttatctgtgggttttcatagatgccctttgtcaggttaaagaaaaaaccctttattagacttaggaaaacctcctctattcctggtttgtttggtttttgtaatgaaaaggtgttggattttgtcaaatgctttttctacatctgtttaggtggtcatgtagttcttttattaatttagcatattgattgattttcagatgttaaaccaatcttgcatttctggaataagccccatatctagttttgttttgttttatttttaattgcaagaccttctgatagatgattgttgctgtttattactattaaagacttcttttaaaattgatgttttagctgggcgcggtggctcacgcctgtaatcccagcactttgggaggctgaggtgggtggatcatgaggtcaggagatcgagaccgtcctggctaacacagtgaaaccccatctctactaaaaatacaaaaaaaattagccgggtgtggtggcgagcgcctgtagtcccagctactcgagaggctgaagcaggagaatgacatgaacccagtaggcagagcttggagtgagccaagatcaagccactgcactccagcctgggtgacagagcaagactctgtctaaataaataaattaattaaattaaaaaataaataaaattgatgttttaggctaggtgtggtggctcacgcctgtaatcccagcactttgggaggccaaagtaggtggatcacctgaggtcaggagttcgagaccagcctggccaacatggtgaaaccccatctctactaaaaatacaaaaattagccgggcatagtggcgcacacctgtaatcccagcaactcgggaggctgaggcaggagaatcgcttgaacccatgtggcaaaggttgctgtgagctgagatcacaccactgtactccagcctgggcgacagagcaagactgtgtctcaattaaaaaaaattgatatttttatcaggtattaactctgaaaatacaaaaattagccaggcgtgatggcccacacctgtaatcctagctactcgggaggctgaggcacgagaatcgcctgaacctaggaggtggaggttgcagtgagctgagattgtgacactgcactccagtctggtgacagagcgagaccctctcaaaaaaaaaaaagaaaagccgagggagagaaaccttcccatttagtctgtggcatgtgtcttcatgaattgcttaagctctcaaatgttctttcagtaatttaaactcttctgctggttttcctgggaagggtgctgtataatcacatattaatgagtctttatgtgataaccttgaacaggcacgtggaggagttcagccccagagctgtctacaccagtggtaaagcgtccagtgctgctggcttaacagcagctgttgtgagagatgaagaatctcatgagtttgtcattgaggctggagctttgatgttggctgataatgtaagaacattttacactcttcagtataaagaagtcagaatacccctaccctatcagtaaaggcctataagttaccattaaaaagatgtccttaaaaacagcattctcagctgggcacggtggctcacacctttgtcccagtactttgggaagccgaggtgggtggatcacctgaggtcaggagttcgagaccagcctggccaacatggcgaaaacccattttctctactaaaaatacaaaaattagccgggcatggtggcgggtgcttgtggtcccagctactcaagaggctgaggtgggaggatcactgagcccaggaggtggaggctgcattgagccaagattgtgccactgcactccagcctgggtgacagagcgagactctgtctcaaaaaaaccaaaacaaaaaaaaacccagcattctttagtaaataattcatagttttcttcatctagaatttaaaattgtgatagttgatcagcatgtcctgagcacgtgtgtttgctgttactagtttagatcggtagatgtgtatataagttataggtataaaatcaatcctgagttgacacaaggttttgatgttgagtacaagtacagtaagtgtatatttttagttatgctcttagttttaagtcaattgtgtggttctttctagctttaggatctgttgaattatcttccttagaaaagggagttaagaatcttcacttacctatcttctacttgtttggagaatagaagagtccctgtggtagcagactttgtgagtttacttgtaattttccatctgaaagactgttcttgtttttcgtgatgaagtcttgctctgtcgcccaggctggagtgcagtggtgcaaccttggctcactgcaacctctgcctcccgggttcaagcaattctcctgcctcagcctcccgagtatctgggattacaggtgcacaccaccacacctggctaatttttgtattttcagtagagacggggtttcaccatgttggccaggctggtctcgaactcttgacctcatgatcagcccacctcagccttccaaagtgctgggattacaggtgtgagcccccacactcggccgttgttgttttttaagagacagggtctcactctgtcacctaacctggagtacagtggcaatcatggctcactgtaacctcaaatgcccggccttagtgaagcgttcttcctgccttggcctcccaaagtgctgggattacaagtgtgagccatgcatccagcttgaaagacagcttcttaggcttgatttgtttggttacagggtgtgtgttgtattgatgaatttgataagatggacgtgcgggatcaagttgctattcatgaagctatggaacagcagaccatatccatcactaaagcaggagtgaaggtatgtgttatctacttctgttctgctgcatcgtccatagccttgttgattaatgtagtactagagaagttcacctggataaaattcattacttcagtgtgtaatgctgttcattaaaatggaaaatacagccctgagaattatttattgaaactataaatgttgtttagagtactgtgtaaatgtattgccatgataatagaggaaaatgtccatgaacaaagcttttattttctttgataaagcatgctccaattataacaaaaataaccaaagatcaacagattgattatatatgtatatatttatttatattaacagagtatttaaatgaaaataagtatgacagtataaccaacactagggagaatctaaactttaaaagctacagattcaagtagcttttaagcagtacacaattgtaaattgaaaagacaactctttccctgcaactcccagcaacagtagatacttagaggtatctaatggataaaaaggaattttaggaggaggaaaataaggcatctattgagtttgtgccccttttaggaatattttgtacataagcataatactgacaatttcattcctgctggtttaacttcataattttattttggcaatcttttaccagcacatattagatcaactttcgttttttattaatttcccatattcaattgtgtataccacagcttgattctttagactcctgttgagtgacatttggttcattttcagtgttttgtattacaaacaaaattgtagtaagcatccttgaacgcaacatccttttatatttggctataagagaaatttctaacaaattgatgtcttcaatggtgtgcacatcataccaccaaaatcacataggagttcctgtttatgtgaaaaagggtatgtcattattttggtttgtgtttagttaattatgggtgagattgaacatgttgttatatatttattggctgatgtctatttaaatctgttaagattctttcttttgtggtcaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggtaaccccatgagcttccttttttatttccagttggagtaattgagtgagacaaggctggaagatacactgctcaacagctggtgcatgtatgtgcaccagcctttgatttccctcagggtggcacaggatcggacaaagggtttagtaagcaactcaaaataaagtcatttgaattgcctcttccacttaattgtgttcaagaattaagttttcaggttttgttactatttatttctcaaaaggaaacaagttacagttaacttccaaccacactttttatttttttaaacagcctctcactggagactgggctggagtgcagtggcacagtcttggcctactgcaacctccacttccaaggttcaagcgattcttgagtctgagcctcccaagtagctgggattacaggcatgtaacaccatgcgtggctaatttttatatttttagtacagacagggtctcaccatgttggtcaggctggtcttgaactcctggcctccagtgatgcacacccatctcagcctcccaaaatgttgggactataggtgtgagccactgtacctggccccaaccacactcttaagatttttatacaattttttgttttgttgattgggcttttattttatttttcagtcaccttgaaaaaaactgggatgccaaagaaatttcttttcttcttcttttttttaatcatgagtcatttatctttgtattttttcctatcaagttgctgaatgtattttacctttttttctcacttttaagattgagtgaaaaaatgtagatttacttggattctgatatgttagtttaattattagagttatgtgtacttaaatatttaataatgcacttcagatgcccacagaactataaaatgacagtttgtaggaactaatattttaggctgtactttttaaatcattcagcattgaggttctacattttattgggtacagtgcacagctctttgttacagtggaactttaaatattatctaaataaaagtagccttccattttgtgagtgtttggagggcttggatttttatttatttattttttaaagacaaagtcttactctgtcacccaggcagtgccacagtcatagctcactgcagcctcaatctcctgggttccagtgatcctcctgcctcagcctcccaagtagctgagactacagctctgtaccaccatgcctggttaattttttcatccttttgtagcaacggcaacaagttcaagacccgtgttggtcttgaactcttggcctcaaaccaccttaccacctcagcctcctgaatagctaagattgtaggcctgcaccatcacacctggtttggtttggtttggtttggtttggttcactttttttcccttcacaagagagacatatttaattaccagataattgagttgtctgattttcatacatttatgtttgttcatgattcattaaagtagctttagtagcagatcaagttataaacctttaaaagatcaatttataaacctttaaaacattcaagatttttttaaaactgttttctttagttttgttttgttttgtgacggagtctcactctgttgcccagactggactgcagtggcacaatcttggctcactgcaacctccgcctcctaggttcaagtgattcttctgcctcagcctcctgagtagctgggattataggcgtgtgccaccacgcctggctaattttgtgtatttttactagagacagggtttcaccatgttggccaggctggtctcaaacacctgacctcagttgatccaccgacctcagcctcccaaagtgttgggattacaggtgtgagccaccgcgcccggcttgttttgtttttgagacagggtcccactctttcctgcagtggcgtgatcatggctcactgcagcctcagcctcctgggctaacacaatcctcccacctcagcctcccgagtagctgggaccacacatgtacaccattgtgtctggctgacttttgagttttttgtagaaacaggattttgccatgttgcccaggctggctgcaaactcctgagctcaaccagtctgcccacctcagcttcccaaagtgttgggattataggcatgtgccaccatacctggccaaaaagccttttctttttctttttctttttctttttctcttttttttttttttttttttttgagatggagtctcgctctgttacccaggctggagtgcagtgctgccgtctcacctcactgcaacctccgcctctcaggttcaagtaattctcctgcctcagcctcctgagtagctgggatcacaggcgtgtgccaccatgcccggctaatttttgtatttttagtagagacggggtttcactttattggccaggctggtctcaaactcctgacctcaggtgatcccgtcttggcctcccaacgtgctgaggttacaggcgtgagccaccgggcccagcctgttttattttagttatttattttgagacagggtctggctgtattgcccaggctggagtgcagtggcatgatctcagttcactgcaacctctgcctcctgggctcaagccagcctcccacctcagcctcctgagcagctggaactacaggtgcaggcccccatgcccagctaacttttgtattttttgtagagaccgagttttgccgtgttgcctggactggtcttgaactcctgagctcaagctatccaccagccttggcctctcaaagtgctaggattacaggcatgagccactgtgttccgcccagacaacttcttaattagaaataatttcaagcttacagaaaagttgcaagaaatggaatagtgcatagaacacccatataccctttacgtgattcacataataacattttaccctgtttgctttattgcttactgtctgtatatatctgcacacttttttcctgaaccatttgagagcaagttgcatattttggggtctttttttttttccagtattctgggatgaatatcttcaaaatttagtggctaagagcacagtctctgaagctagactattcaaatcctggctccactacttaactgtgaccttggataaattacttaaccttcctaggcctcaatttgcccatgtataaaatggggataatatcatttacctaataaaatttttgtgaggattgcataagttaattcttctaagacctgcctaagagaacagtgtctcatacactgagggccctataaatgttagttctgctatttttgttgttttgtttttgagataaggcttactctgttgcccaggctggagtgcagtggtgcaatcatggcttcactgccccttcaacctcctgggctcaagtgatcctcctgcctcagccacctgagtagctgggattacacatgtgcaccaccatgcccagctagtttttttgtagagacagggagggtctcagtttgtcgccctgactggtctcaaactcttgacctcaagctcttctctcacatcagtctcccaaagtgttgggattacaagtgtgagccactgcactttaccctactattgtttttaaagccaatcaattccttcaggtatagttttagagtggggcaatggtatacatttaaacgtttgattttaaatccacctgttcccaaactttcatcagaaacttggtacccattaatacttctttaagtggtatattagagcttgtttttggcgataaatcatttcttattgcctgggatagtctggagaagatattgctgtgactatcaaagtgatttttttgttttgaattaggttacagattatgccattgccaggcgcatagtagatttgcattcaagaattgaggaatcaattgatcgtgtctattccctcgatgatatcagaagatatcttctctttgcaagacagtttaaacccaaggtaacctacccttttgtactgggataaggtataatgggtatattaaagtggaatttaagtaagtgtgttatatggaaattaactgaacctgtcatctaccttagttcctaaattttacaactttttttttttttctggaacagcaatttgttttttcagagagggctgagaaagggaactgtaaaaaaaattctgaataattccattatttgtttggtggtaataaaaagatttgtatgggagaagagttttggataactggataatctagaacattcttttatttcaaacattactaagaacgttaaaattgtttatgcgcctaaatcaatagttgaatctttctttgaaggaaacattggattcatctaggccattatgataaatataaattactgttttacagtgattgatgcattgtattggactaactctgttctggacccaggattcttacctggacataaacccccaaatgcttggcattttcccaaaatagggtatgaaaaggaaaaaaaatactcattctggttgagattttcacactgttggctaacttgacttctggaaggtgttactaggtattgatcatttatcatcttcacttgattattcatgagattgcagttggctctcactgtcccaaagaaatttaatcatttaaaactaaggattatgggtgattcttgtgtaaaaaagagcatctgttctccattactgcatactgatatactgatccctctgtaaccttggcatgcttccttaatatggtgaattccttgctctgaaaagctgaggatcctttagatataaagtttattgaaacagcttttttttccctgcaaagagtgtgagttaattaattgagcctcaaatactgagcattaatttatttaatgagcactgacatcctgaggtgtaaaagacattacatcttgttccattgcttcagcttgttaagcagcttttagaaatggtcatttgcttaaatactaagccttttttcaggttcataaaattagtaacatggaattcacaagcctccttaatattagtttcttttgaaagacattacaatagtaatttattgtcactggcttctcaaagtttcaaccctctcaggttccctaaatgtttccacctggaaggctcttaaacttaggtttaccgtagctctcatcaaatagaaatgtttctctaacttgagtgatgatctgaaacagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtatcagagtcactttgatatgatgagagcagagataaacagatttgttgcatgtttttaatctttggtatgggacatactagaattcactgcaaatacatttttatgtaactgttgaatgctcatacgaccatggaattcttccctttaaagagcttggtaagcatttgagtgtagttgttagacggagacgatcacgtcatagtttatagagtgcataaagacgtaagttaccatttaatacctttcattcaggaaaaatgtacttagaccctacaatgtactagtaggcctctgcgctggcaatacagataagataatgtagcccctggcctcaaaggaactctcctccttaggttgcatttgtataatgtttgatttttagattgttctttgagccctgcattccacgaggataggtcagtgggtattaacgaggtaaaaggggagtagtacgaaagggcattcaagcgtcccatcttcgcttcaaccaaagcagccctgctttttcctagttttattaataggtttgatgtaaggtcgtctttgaaaagggggtttggcttttttttacagtgtgactgaggtataatttataaaaagggaaatgtatggcatggtgagttttttcacatacatccttgtgaatacccagctcaagatccaaaacatttccataatttcagaaagttccaaacccctgcctcttttcagtcttagccctcttcccctgaagtaactactgttccgacttcaatcactacttttatcccacaggttaattttttggcttttttccactaaattttcaaattctttgatatggtactttactattgacgaagtactttcacactaggttatttaatattctttgattcacccaatatttagggaacacctgtaggggacaaaaaatgaatgagagcccctgccttccattgctgctaatctggtgggaacgagacatgtatttaattaagcatgtaaaaaatgagaagagtgggtgatgaaataatctatatactaaatccccatgacacacagtttacctatgtaacaaacctgcatgtgtacccccgaacctaaaatataagttggaaattaaaaaaaaacgagagggagaatagagcatcacaaccagagtgctgagatgaattactttattaccaaagaaggaggaggactcagggaggtgccgacgtttaaacccagtcactgaagggtgtgcagaatttggataggcaagataccctgggacaaggtcattctaaaaccatgctaacatttgtactttttttttcattgtgatagttcctgaaatgagttgcataaaactggtacatgtcttagggcagtctctaattgatttttattttgttctatttttaaaaattagtcttcaaatagcagattcacatgatattaaaatatatgcacataaattatatacacaaatatattttctgaatgaaatttagtatctgcatatatttaagagctatttctgtctcatatgttcataatcttcatccattaaaaaaacttttgttaggcctttctcactctaagattataaaaaattctcccattatttacctagctagttttctagttgttccaaaaccatttattgaacaatccatctttttgacactggtttggcatgccttaattatatattcttgtgtgtgttaggatctccttttggactttccattctgttcattgagtcttatcagctcctcttacattggtaccatgatgttttaatctatggggctttgtagtttaaatgtagggctagttccagcgcattgttctctatcagctgttaggaacttagaaatcagcttgctctgttttaaagaaaaacctggtatttttttatcagtataacattctatttatattaacttgaagaattgaaaacatctatgatttttcctattcagtaacgtatcacttagaataggttaggttgtactactataaaatctcagctgcataaaacaatttttttttgcttgtgctacacatccattaggtcatcaagggactcaccttgtcaagttactcagagattcaggctgatataaaggtttgatcttgacatacgctttcatgatgacagaaagcagggaagagaaggtggtgagccatgtgctttctcccccttctatccagaaatgacacatactcacatttcattcgccagagaaattaacatggccactcctaagttcaaatggatagagaaatgccttcctaccaggtgcccagaattagaagagcaaacatttgtgaacagttctgagtaccacaaataccgttatctttccacttaagtcttctgtttcactcagtagtgctttaaacttttcttcatatgtttttcagtgtttcttgttgaatttcttgatattttatcatgtttgttcgtactgggagtagcctttttttccatttcattttctggctggtttcattgctggttgtttttttgttttgttttgtttttgagatggagtctcactctgtcgcccaggctggagtgcagtggcacaatctcggctcactgcaacctctgcctcccaggttcaagcgattcttctgtctcagcctcctgagtagctgggattacaggcatgtgccaccatgcccagctaattttttatatttttagtagagatggggtttctccatgttggtcaggctggtctcaaactcccaatctcaggtgatccgcctgcctctgccttccaaagtgctgggattatagacatgagccaccgtgcctggcctagttcttatgggatgtatatgtctttggattcatatgatatgtatatatgtttatatttctacaagtacatacctaggagtggaattgttgggtcataggttaatgcatgtttttctgccaaacagttgtgtcaatttctgttttcaccgctgtgaatgagagttgttctaccttcttgacaacacttgatattgtcagtcattttagccattctggtgaatttatagtgctatttctgtgtgtgtaagagagagaatgagagagggtgtttgtgagaaaaccaaagcaacactgtgagagtgtgtgtgtttgtgagaaaaccaaaatacatactactgtgatttcattgggagaaaatctgtttggtatatcaaaaaaagtagcttaattacttcatcattattggtttaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtgagatacttgttcatgtgactgttttggagttagggaccaaaacattttctgagatgtcatgtggtagaagtacacctgctgttggctaatagtctatggtagcaaaacggaaaaagcagatactgaattctattcactgtttacaagttaaaatgaaattaaatagttgatataaaatatatatacttggctgggcacggtggctctcgcctataattccagcactttgggaggctgagataggtggatcacaaggtcaggagtttgagaccaccctggccaatatggtgaaaccccttctctactaaaaatgcaaaaattagccaggcgtggtggcggctgcctgtagccccagctacctgggaggctgaggcaggagaatcacttgaacccgggaggcggaggttgcagtgagctgagattgtgccactgcactccagcctgggtgacagagcgagactctgtctcaaaaaatacatagatatttgaaagactaaaagaaaaggcagcaaaatggtgataatagacataaatcccctgggttttacccttatttgtattgttgttttgcttctgaattgaaaacattttttcaagcacattagaacagaaaaatactagaaattttatttattttgagatggggtctcattctgtcacccaggcttgaatgccttggtacactcatggcactgcagccttaacttcctgggctcaagcagtccttctccctatcctctctaatagctgggacatatgcccacgccaccactcctggctaattttttgagaattttttctagagacaggatctcgccatattgcccagactggtagaattttttattttgtatataatactgcaagtggactttcagattgtgaaatctttatatctctgatccctcacgttcctcccaagttagtttttgtctttactagtagagtttatacatttgcttctaatttatttgaaaattcttatatgctatgtataactgtatgcatgtttttttttgtttgttttttgtttttttttatttttgagatggagttttgcttttgttgcccaggctggagtacaatggtgcaatctcatctcactgcaacctttgcctcccgggttcaagcaattctcctgcctcaggcttccgagtagctgggattacaggcacccaccaccacacccagctaatttttgtatttttagtatagacaggatttcaccatgttggccaggctggtctcaaactcctgacctcaggtgatgtgcttcccttggccttgcaaagtgctgggattacaggtgtgagccactgcacctagccggtttattttgtttttcatttttattttttggcagaggagatcatgtgggaatgtatgcttgttttaaaattagtgttaaggctggatgtggtggcccacacctgtaatcccagcacttgggagaccaagacaggaggatcagttgagtccggtagttcgagaccagcctgggcagcatagcaagaccctgtctctaaaacaaataataataataatttttaaaagtgaaaaaaatcagtattaaatgtaagtagtgtatttgtaaatgcttgacaaggggatgttaagggcacaaaaataagattcaggtggtcaatttttcacttaggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaaggtgaggcttacctggtactgcttacatgctcggtcacttctgtaagctctgttcacataggccacttgtgattgccaaacttcgtgttgttctgtcggaagagaggataagttgttagataaactcactttagcaaagtaaatttgtggagtatcagcatacctgccagcctgaacatttcttcacaagcttattgtcaggcaaagctttgtaggtccttctttttaacattctgggcctattttaataattttgggacctgataacatatgaagcagcacatacaaatgtttttacaaatgcaaaattactattcccttacaatggttctgtttaaaacagctggacccctagggtatattttaacagtaattaattgagcctagaaatctatactatcaaaaggccattgcagactagaaatggagtaaaatcctcatgtagttattggtaaagtgtggcgtctggacactagtacgcttcctacccttaactgctttaccatgctattcaaagttttatcaccctatagttaactacaaagcagaaggaaaaatgatgaattcaagatgttgaacctaaacttctacttgatagttaagcatcagataattcttgattaaaagccccaaggatggcttgtgctggctttctggaatattttgtcatcacagtatttgctctgctatgaaagaagagaacaagagattgtagtttctgcccttgttcccctgggaactttagaccagtaggagagaaggcaacaaagtggccactaggacgcctcagcttttgtcctcattcgcgtctcacacaaaatgatttgggaactcaaggtgttcttgattcatgttatatgtcattattctctttctccctcatacaagtaagttttaaacacagcagaagttgagttttatgatagttatgttatccaggtccaaacatttcctatgtgttgagggttcttaccaggactttctaaaagtctggtagaccttggacttgttaaaagcagcaggcagttcacttagtaagatgaaccttgctaaaataaacaggtaattttttattttgagtgaatactcatgaattttacttcttagtaaactccagttccataaagccttcccctttctacagaggaaaagttgttatatttcagaatttttgcttgctgttgcttcattcctaatttatgcttttagtttctgttggcaagcattctcagaggtggtgaagcataagaagatgaagaaaagaccttcatactttgaaatcttaatagctttaagaaacatatttcttataatctattttattaggtttctctccttatggataaaataaggcatgctttaatacaagtgatatgacttgttatttcaggcttatgctagaacattgcggaccttacgtcaccagatgtactttcggacggcttgacatttatctaatctgtacattatctcgttgtatatgtggcagagatttacccaaggactgacagtacgagttgctaggataatttgaatgtgtttttttgttgcagaagaggacgagtcagcattaaagaggagcgagcttgttaactggtacttgaaggaaatcgaatcagagatagactctgaagaagaacttataaataaaaaaagaatcatagagaaagttattcatcgactcacacactatgtaggtgcagaagtgcgcgtgctctggtatcagggagggagggagttcatgccctgtatctgcaggttcactagtgaaattttttttgacctttgtttgttttgaatcattggagtgtagtcagaagtatgagttgtaaaataagagagaatgaacagcaggtaaatgacttatttcctctgctgaaacaagcagaatttaggttaaatctcagaaggtgggattgaagtcttactagttaggtgttttaagcttctgtttcccatcctcatatttgcccttggtcgtactgctgtcacctactttctatgtttcattttcctcacattcttagttcccaccttacccaacccaatagtcaatcttccatcttacttgcttggcgaaaccccaaacttggttaaatataacttttttttttttttgtatccttatctaagcagctgaaagtatctggagaaaagcatataattatgagcccagtcttatttaaatcgatgaccagaaatctcaagtggacagttcttactgtctcatcaacctcatgacagcactgcccagtgcaattccttttcccgggtcagttctttgcctcactctctcacaggcccatcacataccttctctccactcctgtcagctggccattctcagtactcagcctgtccacagctttgtcacagttgatcactcctacaaatagtgtcttcctcacttggttctgagtcactgtatcctcctggggcttctttctcactggttattccctcttagtctctttccctgaatggttttgttttttttttttttttttgagacagagtttcgctcttgttgcccatgctggagtgcagtggcatagctcactgcagcttccacctcctgggttcaagcgattctcctgtctcagcctcccaagtaggattacaggcgccggccaccacgcccggctaattttttaattttttttttttagtagagatggggttttgccatgttggccaggctgatctagaactcctaacctcaggcgatacgctcactttggcctcccaaactgctgggattacaggcgtgagccaccgtgcctggcctgaatctttctcttcttactttactctcagatagtttacattcattacctaagtgatctcatttggttttatgaatttatccatctactgatgacttccacatttatgtcaccagctctcaccactcctgtaaactccagatgtatagagctggttgcctactgatgagcgtttaacaggcatctcgtgcttaatgtgttcaaaaacagagttgttcttccctgtttgcagttgagttgttcttactcaattgctataggccaaatgccttggaattgtctttgactccttgattccactctcccctcacagctcctcttcagcagcaaatcctctgacccccagcttcagtgtgtgtatattttcttttctctttttaccgccttcaccagcccacccaagccaccaggcatggactgttgcagaagcctcataaaattgtcctttttttgtattggcttcttgctcagcagccagataagtctttttaaaatataaatcagattattttactaccctcccttccagtgcttctctcacattagaaggaaattcagcctccttgtcatggcctgcagaactattatacagtgtaacccctgtcccctcattcacctaatttcacagcagtcttccccatacccatttcaccccagtgacactggccttgatccctaggcacaccaaatatgagggcctttgcactcaccctttgtccatttccctagatatcctcctcctctccaatgtctgctcaaatgttacctcttcaaagaaacctttcttgctagcctgccaaaatagtagccttctgctcttgctgtcaccctgccttgtatttcttcgtaatgtttaacatggcccagcagtatattctttatttaagtggttagtttgtctctcttatggaatataagctctgtgagggtagagactttgccccggagctacagtggtacctggcacatagcaggatcaaatatatgttgaatggttaaattttcctattatgtggcagagatttaactgtcgtgccaattcacagggctcactatataaatattacagaggtcatgtattggggttgtgtcttctcaaaaaccgttttcctgtgaaggtagatcagtctgtgattattgaggggtagggaggtgtaagaacagctactcagatcagggtccagagttgcttttctagtggtgggacatgtctgtgtgctccttgggatcagtgtaaagtaaaacgacccaggcaaggaatctgcttcaggactttggaacacactgtgaagctaactgatctaaacttgaattacctatttatttatttatttatttatttatcttttgagagagtcttgctctgttgcccagactggagtgcagtagcatgatctcagctcgccgcaacttccgccttctgggtttaaatgattctcttatctcagcctccagagtagctgggattacaggtgcccgccaccactcccagctaatttttgtatttttagtagagatggtgtttcaccatgttggccaggctggtctcaaactcctgacctcaggtgatccacccacctcagcctcccaaagtgctgggattacaggcatgagctactgcgctcagcctggattaccttttaaaatttggcttaccacctgaactaatttgctacagaaaactagagagcttatactgtgctgatgagatatgatgcttcctatgaaggtatgttaacacatagagtgagtgcttgaaagtgtccaatctaacttcaggggtagatttgaaagggcaattttttaaaaagtgtccagtcccccttagtggcttcagtgtttatactgtggagccttgccagacttcttaggatcaaatcacagtttcctgagttcctttctatgggcttggctaggagctcttctcatttgtggacagttttgactaacctgtaattatatcgtgggcttaaaatctgtcatcaagattttaagccagatggcatgttctacctttttttttattagctcagagtgaaaaatttttcagatgaattttcatagattcttctcctaactctatgaaatggtggtatatgaaaaagttcagtggtcagtaattaaaaattgctgaatgatattaagtatgaaacagacttccaattaattagaagattttgcagagttgtttaaccttaaaattcaagcattacttccttttttgaagttgtatttacaagcatttgatgtaatatatttaagtatttcttaattttccacaaggggtttatggtatgaaaaggtcagcatcctactaggaacagggtttagcagagcactgatagtgatttttaaagtgtggtccttttcctaggagtttctagttgggaaatgaaagaaaatgttgatagcaaacactcggaagaagggtcaagtcttgtatatctggacattggtataatactgcttgaaacctgaggacaaatatttgtgtttcacaggatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaacaagagtgaatactcaagtagatttgtcatgggatttttataagaagactggtatcaggtaatgtatctttaaagactaggctgctctgctgacgtagtaaccattttttattcctttactttcctaatagccttgctttcacttaagaaaaaaaaaggctaggcacggtggctcacgcctgtaatcccagcactttgggaggccaaggtgagtagatcacctgaggtcaggagttcgagacaagcctggccaacgtggagaaaacctgtctctactaaaagtacaaaaattagccaggcatggtggtgggcacctgtaatcccagctactcaggaggttgaggcaggagaattgcttgaacccaagaggtggaagttgcagtgagctgagatcatgccactgccctccagcttgggcggcaacaacaacaacaaaaaaagattcccaggcttcaccctctacagtctatggaaagtcatgggagtctattaaaaaaaaacagacactataaaccaaattaaaagatgggaaaatttttctatcacgttttaatatgtgatatccaaactcccattaagaatttttatatcagtaataagataaaactcagaagaaaaatgcccaattaacaagaagagcttcacctcttaaataatcagaaaaagaaaagcacataatatttacgtcaaagtatcaaaaatgtaaaagttttataataggcattagcaaggcagacggatacaggcacacatctaactctatgtaggatttaacttggaagacaatttgcatttcaatcaatcaaaaaccatttttttttttttgagatgatctccctgtgttgcccagactggcctcaagctcctgggcttgagcagtcctacagtctgagcctccaaaagtactggcaaaacaggcgtgattgaccatgcccagcctgtatataaggatattcatttgcagcattgtttgcaacacaaaaatgtaaaaccaaccggtgtttaatatgcaagatgttaatttatggtacattcttgctgtggaaagctatgcatctgttagaggtgggtctatatgttctgatacaggcagaactctaagagctattaagtgaagaaaaggctgaaaatacatatggcataattccatatatgttaaattgttctatattttaaatgttatac

SEQ ID NO: 14211 - DNA, 11879 bp, Human
ctccacagctgcagagggagggctggaggagtggccaaactggaggtttgaggaacaagttcactaaggtgttggtgcacagcagggccctgcagggctcagtggctcacacctataatcccagcactttaggaggctgaggtaagcggatcacctgaggtcagaagttcgagaccagcctggccaacatggcgaaacctcgtctctactaaaaatacaaaaattagtcaggcgtggtggcgggcgcctgtaggcccagctaatcgggaggctgaggcaggagaattgcttgaacctgggaggcaaagtttgcagtgagctgagattgcaccattgcactccagcctgggcgacagtgagactccgtctcaaaaacaaacaaacaaacaaacaaaaaacaaggtggggcagaggaagggagaaggagcctcaccttgagggccctgagcctaggtcctaatcccagttgctaactggccttatgaccaaggagcctcaacatgtcacagcttttgtgggctgtgggcagtaggagagagggcactgccactggagacctgcgctgtggcctctttggccagtgccttgctgtgccatgtgggacaaatcctttcccctccttattgggccctaatttcccatctgtgaacagttcatagcaacttggggctgctgggaggagggcaagcaagcctggaacccagagcgtggccagaaatgatgtcgacgatgcccatgaccacctcctctgttctccaagacctttgcctctcctcaggcccctggtcacctttccctgggtcttcgttctttgatgtgagaagagggcagctttaatcccccacctgatagagaagaaaactaagctgtggagtagggtggagtgagggagtggaaggaaggttgtggtttcctggtgaggtgtgatgcttagacctggtctctaaaaataaaattaaagttaaaaaaaatgaattaaaaaaaaccgcctagtctctgaggtcagaaaagaccaacactcaaattttggctgggcgttcttaaaaggatgctttcttcatctggagatatctggtggagaggattaggtaaaataatgtattactattctcagggtaccataaatccgctggcccgctccctcaggccactggcccacggctccacccatgtcacgcccctttccccgcagccaatcagcgctacctccccagagcgcccgttccctccaccactcgccgcagatctcccggtgccacccgttccagggaggctgcttggtttgggaagatactccccaggggtctccccttcccttgggggcgcagctgaggactgcgaggtgcgtccgagggccagaaagctgagatcgattctgagttcaaggatcaagtctgccctcaaaccattttacagatcgggaaatccgagacccagagaagggatactcccgcccaagggccaccgagccgagagaagcccgggccagggctttcttcgcgtatgtgggaatgcaggcgcgagccctttggggggcacagtccatacgggagctgaggccgaagccggagcactaactgtgctgtctaggggatcgagacggcactagagggctggactccttactgcctcagtttccccagcactacctttgttgaggaaacggagatggggatactggccgaacgcgcgcctgctgagacacagtgcaactgtatttagacgccccgcacctccccaaatctgatcgaggctccttttttcaagcacccgctatctctcagccctttaaaatccggccctgccgttcgagtctctcggcgttccattggaaagactcggggctccagctcccttctctagaatgaactgctctgactgccgcccggctttaccggagctttaactgcgcaggcgcaagggcagccaacccggtaaacggaagagctgggtgctgacggcgctgggcgggtcaggggcggagagcgtgctaaccaatgacttgagggagtagggggccgggtttgggccctcagttgctaagggctacccgagtgggaagcggttcaagagatggggtgaagggtggttcaccggttcttcaagtcctcagccttctggcccgcggaagttaagcaaccaagaggcgggcctaagaccggaagcaggaaggagggcgcaggaagcagggcgccgcagcctgtcgtacggtccttctgtgggtctgtcggtgccgagggcaggatggagaagctgcggctcctgggcctccgctaccaggagtacgtgactcgtcacccggccgccacggcccagctggagacagcagtgcggggcttcagttacctgctggcaggtgccaccctgacctttgatcagttccttctgggccctgacctatgaccccagtggcccccttccctgcggagtcagggtagtgatcgctgtgcttgagaagacccgtccaggttcccaaagggcgtagggaggggatttccgggacccgaagacgaaatgtgaggcagatgctcactcacacctccttctgtaccctctccccaggtcgattcgccgattcgcacgagctgtcagagctgggtgagccgggctctgggggtgggggatgggggatcggctgcctggcccctggtgagttccccagagagggtgagcaccccagcccgaggacctgggctgcccgttagacaccttgtgctatgactgaatcggcacaaggtctgttgttcattgtcctgggccctccatgtccctaagtcaagagacacgtctggggaccttatctgagtattcactactggccaggcgctggactaagtgcctttcttacctttacttgttaatcctccctacagtcatattaagtggtacttattgtcatcactgtccatttaaggaagaagctcagtgaggttagagaacagtcactgatggtcccagaaccaagattcaagtctagatctcccagattccaggattcccagattgtaactacctcaagagtgtttgcccagtgactgctgtcacagtcctgaaagaatgcactgggttttgaaaagcagaggtgaggccaggtgcagtggctcacacttgtaatcccagcactttgggaggcagaggcaggtggatcacgtgaggtcaggagttcgagaccagcctggccaacatggtgaaaccccatctctactaaaaatacaaaaattagctgggcatggtagcaggtgcctgtagtcccagctacttgagaggctgaggcaggagaattgcttgaacctgggaggcagaggttgcagtgagccgagattgtgccattgcactccagcctgggcaacaagagtgaaactccgactcagaaaaaagaaaagtggaggtggaatagaccctcaggaacaggctgccaagagagaaagggccaggaggtgggaccgtgtatctgtggcagttcagagagcgatgggcagttgtgggcagctggatgaccagtgccatccagcagggcagtaactggcttgtcactgagattgacccatcctttcttggtccagccacccttgtgagatcatgttggggagaggggagtgctgaggaagtgggtggagaagaaggttggtttccacagtctgtgggtgtctgagcagagcatgtgacaggtgatccctgcagctctggggagaaggtgagagggatggaggctgcagagccagcctctcaaggccactctctacccctcagtgtactctgcctctaacctgcttgtgctgctcaatgacgggatcctacggaaggagcttcggaaaaagttgcctgtggtgagaattctgccaagaacagggtgggaagcatggggactcaggaatgaaatagtagcagctagcccatgcgtgcagcacatgtctcatggagtatgagacaggcctatgtccatctgagcctcaaaccatctcattaggtgacctgtaaagtgtgagtattcccatcttagatgaagagactgtctcaggtgaagagaggtagagtcagctgtttcaggtcccccagcctgttaatggtggagttggtgtttgaactcacacctgcacagttaggcttggaaaggggaaggtccacatctcttgtcagagaagctccctcctaggagaagggcctgggactccctgtagtcccaggccccctgacttcttggcctggggttcttgcagtcgctgtcccagcagaagctgctgacatggctgagcgtgctggagtgcgtggaggtgttcatggagatgggagctgccaaggtgtggggtgaagtgggccgctggcttgtcatcgccctcatccagctggccaagtaggttgggattgtggagagggtcctgggtgggggtgacgcaggctagctacacagatggtgctcagcagagcatccctggcctcccgccggctagccacctccccacaaccctgacatactccccgacccagggctgtactgcggatgctcctgctgctctggttcaaggctggcctccagacttcaccccctatcgttccactggacagagagacccaggcacagcccccgggtgagctacttccccaagccctggagcggaatgggccatgggactaacttgaggatttagatccaaccagcatgaatacagtagtatctgtttatggagcacgcctgtccctatcaactatgtgttctcattgccatgtattcgacagagaagacaatgatgcggctagggacaaaatcagaacacgaacccagtacttgtgatggccagagtcattcatttttgtagcctgcaggaagagggaacagatgggatgccgccaacctcgactctgagcctggttctgtgtccagaaccatagcctctagaggcaggaggcagggcacgcaccacatctgtcccttcagggctttgggcccatcccgtcagcttctgggcctcactctctggacattgagttggggccgttcattgcctctcatcatgattgttttgaaggcaaaggattgagaggagacggcccctctggtgctgtggtctccatagatgtggtcaggctgggccttccctgccttgcctgtccatgggttccgggaggctggctctggccacagctatgctgagctttccccaggctagggagggctgcagagtgctttcctctgtggacgggtcttgtgctgagccgccaccctgcttgtagttcccttgactcagctgttgccatagtacaagctcatctgttctccccttagctcctgagcattcactgcacacgttctttgcaggctccgctggaagcatgtccctctgactgtatggccttctgtctatccctgctagatggtgaccacagccctggcaaccatgagcagtcctacgtggggaagcggtcaaaccgggtggtgcgaaccctccagaacagtaagtggaggatgtggctggcctgggcacctaggtgctgtctgcctgggcttgagggactggctttggtcagcagccaccttcccctgccccagcctgggcctggctcgctcatctgctgcccttgtgttctagcgccgtccctgcactccaggcactggggagctccccagcagcgggagggacggcagcagcagcatcacgaggagctgagtgcgacccccacccccctggggctgcaggagaccatcgcagagtttttgtacattgcccggccgctgctgcactgtatccttagcgcggggcaggatagggctggcactgtgggctggggattgagtggggagtgtgctgagcaaggcccctgtgctggagacatccttgacgccttggccgtcagtgctcagcctgggcctgtggggtcagaggtcgtggaaaccctggctcttggctggtgttgtggacgtgaccaggtgagcctgggcctgcctggggcttcactctccactgggctttctgctataatcctggcctcacataggcggggtggcagcggcccctgctcctcctgttgctgcccctctggacacccagcccatggctcctccccttccgtgggcctagatcatgcccctggccctgaccatgtcctccctgcctcccagcctgagcctcctgagtgacagaaagggcctgacccggagggagcggcgggagctgcggcgccggaccatcctgctgctctactacctgctgcgctctcctttctatgaccgcttctccgagtaagcacccaggacaccctgagccagggagagggctggcaagcgggcactggtgctccggtccctgctggcgccttcccttccccacgcctcatccagggttcaccaagcactgtgtgttgtccgggtggcagtcaccagatgccagcccagtcccgcccgcagagctctctgggccatcaggccacttgagcaggaacttaaacattggttggcaggagaggcactgagggcagggctgagggcattgccaggtggcccacagggatggcgacagggcgggcgcccatggcctctagctcatttccacttcttcctgccaaatagtttggcttatcctcacttctcagaggaggacctggaggttcaaggaggttgggcaacttaaagacacccagctagccagtggtagagctagatcccaaacccaggatctcccctggccttccctgcctggcccagcccccactcagtcacctgcgagggtccagagctcccagcctgagagaggcctgctgggttgagcagggggcagcttgggactagttcttccacaggcctgccactatgactgcttgaggttagaccacagtctgacagggggaaaccctgtgcagtggctgggactgtgaggcagacaaggctcccgggaccccctttgtctaggacctactaatagcttaaaaactggcataggctgggcagcagtggctcacacctataatcctagcactttaggaggccaaggcaggaggttggcttgaggccaggagttcgagaccagcctgggcaacccaattctacaaaaaaaaataataataataataattagccagacatggtggtgtgcgcctgtaagtcctagctactcaggaagctgaggcatgaggatcaggccaggaggctgaggctgcagtgagttatgatcactccatcccactctagcctgggtgacagagtaagtccctgtctcaaaaaaacaaaacagaaaaaaaaaaacaaaactggcatagtttagccaggcacgatgcctcacacctgtaatcccaacactttgggaggccgaggcgggcggatcacaaggtcgggaggtagagaccatcctggctaacatggtgaaaccctgtctttactaaaaatacaaaaattagccaggtgtgatggcacacgcctgtagtcccagctattcaggaggctgaggcaggagaatcgcttgaacccaggaggcagaggttgcagtgagtcgagatcacgcgactgcactccagtctgggtgacagagcgagacactgtctttttttgtttgtttgtttttgagatggagtctggctctgttgcctgcctaggctggagtgtagtggtgcaatcttggctcactgcaagctctgcctcccgggttcatgccattctcctgtctcaactcctgagtagctgggactataggcgcccattaccatgcctggctaattttttttgattttttagtagagatggggtttcaccgtgttaaccaggatggtctcgatctcctgacctcgtgatccgcctgcctcggcctcccaaagttctgggattacaggcgtgagccaccgcgcctggcctgacccatcttttttttaaaacagaaaaaagagtaaggctgctccttctggaccacaccctggcacctctctggaccctgctccctgtcctttagggaaacaaaggcccgccttggcctcctaaagtgctgggattataggtggagccactgcacccagccagccttcttcttttcttttcttttgttttttgggacggagtttcactcacgttgcccaggctggagtgcaatggcgtgatctcggctcaccgcaacctctgcctcccgggttcaagcaattctcctgcctcagcttcccaagtagctgggattacaggtgcgcgccaccacgcccggctaattttgtattttttagtagagatggggtttctccatgttggtcaggctcgtctcgaactcctgaccacaattgatctgcccgccttggcctcccaaagcgctgggattataggcatgagccaccacacccggcccccaggcttcctcttttcttgctgctcagacagacatataaggagtcaggccgccttccagatgtgtagccttgggcaagttatttgatgcgcctgtgcctcatttcctcacctgtaagatggggatgatgacagtacccactttgtaggggttcagtgactaacgcgtacagcagtgcgtggggtgtagtaagcacgtagcgctatgtattgtcatcagcatcctcatctcacccgagttcccctgtggaaaaccctcctgtcttaaaaatcagggccttgggccttgccccttcccctgaaccaaaatgtgccctcttcagtactgtgtcccctaccaaggtcctgactactctcattggtggcttgtgaggtttccatgcagcccagcacttctgccagactggggggcttcccgagggcagggtggggttgtcctccctggaccctccaccatactgccagggcgctgctccacatgcgaccctctagaggccttcagtgttggatgtcggtggaaggggaaagaggaatgggaggaggtgttgtgggtcagcggccaccccgaagctgagctggtggagggtggaggccagagccaaccccagaggtcttgcccttgtgtaccgggctttgtcctagctcccaagaaagtcacctttgttttctggaatgcgctgcattcggcacggtggtcagtgaaggcctctgggcctcctggtttgcagggacccacccccaccccactcagcttgctccccatttattgcctcccccagggccaggatcctcttcctgctccagttgctggccgaccacgtccctggcgttggcctggtcacaagtaagcagggatggggacgcgatgactgtagtgctggaaggcgcatgcatgcaagcacctccctgactcctctgtctccttgcaatttgattcttggcacagtcaggagaggaagtcgggaagtcaggattgggtgggactgcccctgggcataggccagggtggcctgaggagccagggatggctggaaggagggtgtccactggtggggggaccacatcagctgccagcttttttctggtcacagtatcctggagcgatacgggaccatctcatcttggggggattcaatggcagagaaggggtccaccgggctgctgagatcctccctcagcagaggcccactgggcttgggttgggtgactggacctgactcaggcccctcagtgtctaccctggctgagcttctctgggcctgagggtctttgtaaatggtgccagagtcccctgcagtgctgcctcctgggggcagggcaagacagccagctgggctggctcctgggccgcaggggtgaggtgctgtatgtggcgccacagtgcagattggggtctggcctgccctgatgtgtccctctcccactgcagggccgctcatggattacttgcccacctggcagaaaatctacttctacagttggggctgacagacctcccggaaggagggtgtggggaggggtggggcagggagcccctcttccctaataaaactgactccggcagcgtcccagcgtgcggcctctccgtgcctaccggccaggccccacacacagccctggtcgccaccagcgttcctcccaggacacccttgactgcgctctcctgtgacgatgccactgcagcccgcaccttgtcactgctgggccaagaagccttcactaggagtgggatccaggctcctctcccacagaaagcggtgacttcacctcatggagcccgggaagctgcttgcctcggcagccataggagcgaacactgctgctctctcgctggcccctggtgaggacaggaagcctgaacccgggtgatggctgaacgctgcccagcgtgtcttctggctggggccctccgtctgccccttctccgcagggccctgtggctctggcagccccaggccatggcgttgccagcctccctgtgacagagcctggtgaacagtgagcctggctcccacgcaagtggcactttaagccctgcatcctcggttgagagtaaaaggcttttctcccttagaaaaaggacatcaggcactggccagcactggggagggagtgggagctggacaggctcggggaggaagccggggccagttcagggggtatgagctggggtttccccatgcttgccctgcaggctccagaggccgggtccacctggagccatgcaagctgctatgggggagggcctggacagggtgggccgcaggctggtcttcttctccctgaacttagcctgtcctcagccactggccctgtgaagagccagcctctcatgctagagtttcaaacccacagagagggctccatctacaccttggtcctccatgcctcagctcctccaagacacactgctttccccagggccctctgaggagcgccccccaggtcctcacccacaggcaggggaaggggctgcctgggctcccatggcctccagcttagtggaacaggcgtttctgggcacatgcctggccatcagaaaccagcagtgaagcacagtcccctgccctccgcctctcaccaacggaggaaacaggcatgtggatgcaggcaccacactggggacttggcaggaggtggcatgtccagagcggggtctagcttgggggtgccccggtaatggcaactgcctacctgcagtggtgacagaggtgaagggtttcatcgggctccattggccaagccttgactcaggcaggcttgaaaccggtagaactgtccagtttttcggtagacagcctgcaaggggccgctgtgtgcccagggtcacagctctgtggagccatgggaggtgggagctggacgctggaggggaaggtcggggccaaactgaacatagcatcacatatccaggggagaaacttggacctggtctatggtaggcggggaggggtctgtgtttgtaaatattccagcagcctggtggaggatgctttggtgggcagaggtggaagaatgggggccgtgacattggaggcagtggtctgtagcagtgggaggggcaatggcagtggcagcagacatagggagattaagggtaaccccagctagtcttggggactggcgtggaggaagagggtggtgtctaggagacgaggagcaagaaggacgaggggctttggggttagacagagtggacagaactccaggttcctggcagggcaagccttggtgggcacaggatgctgaggcaggctcgtggagacgtgttgtctccaggacttataaagggaggtggccactgggaagtgagtgcgggaacaacatgcagggggtgacggggctgaaggaaccgccagaacttgtcagcctccggtactcaggaccaggagcatgaatgaggccactggaggagccagggttggaaacaagggacttccctccctgggcccctcagctgtcagaggagagcggctgggccagctggcaggttggccatctcaagcaactggattaccaaagctccagagccctgggctcggccctcaggttctgatactacagatct

SEQ ID NO: 14212 - DNA, 23790 bp, Human
  misc_feature (1)...(23790): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctgggattgtattctgcccctgccacctgctgtgtgtgactttaggtatgtgattcattcttcctacatttcttttcttttcttttttttttttgagacgatgtctcgctctgttgcccaggctggagtgcaaaggcataatctcagctcactgcaacctccacctcccgggtgcaagcagttctcctgcctcagcctcctgagtagctgggattacattcatgtacccccacgcttggctaatttttgtatttttagtagagagagggtttcaccatgttggccagcctgctctcaagctcctggactctagtgatacacctgcctcagccttccaaagtgctgggattataggtgtgagccactgagcctggccctcaatgtccctaagtttcaatttcctcattggaaatgggaataataatgtctatattaacgttaacaaacattcattgactgttaatgtatgacaggcgctagtctaagcgtttacatttttttttctttttttttgagacggagtctcgctctgtcgcccaggctggagtgcagtggcatgatctcagctcactgcaagctccgcctcccgagatcacgccattctcctgcctcagcctccagagtagctgtgactacaggcgcccgccaccacgcctggagaattttttgtatttttagtggagacggggtttcaccgtgttagccaggatactctcaatctcccgacctcgtgatccgcccgcctcggcctcccaaagtgctgggattacaagcgtgagccactgcgcccggccagcatttacattttaaaacccatttgttcctcacaccaaccccatgacctaggtgatagtatcctaattaacaggtgaggacattaacgcatagggtgactaagtaaactgttccaagtcgcagggctggtaagccagtacttgagtctgggagaagtattcacctccccatgaaggagtatttctcacatagcattaagtgctattattatcattaggattaatattaaaatataaatagtttaggagaaagctaatatcctacccaagggtccagcccagttgaaactctcccttctcaaaaaagcacttcatgagcactaagcttgaaagagcagcacctttcttctgagcgctgcagcatctaatacaaaaaacacccatatcccacctatcctgggaccagatggggtaccttttcttgtgtgtatgcataagtctgcatgtacatacatatatgcttatacgtttacatatatacacacatttatatatctaatcttctcagcaagtttcagagattccttagggctctggtaacatcatattactttataaccactacaatatcttaacagagtaccttggagaagtagaaattcaataaatataaaatatttcattagaatagccttcactaactaacaattcttttccttacaagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactgtaagtttacatatcatgctttcttcagcgttaataacctttagtcagtaaaacactcaaaagactaaaaaattctcacctttcagaaaaggcgctatttctcatatatttcatatgaaatatctaccaattaaaatgaaggaagaagagaaggggaaatatatgttatactaattattatgaagcaaacaccccaagcatacttttgattcatggcagtaaagagcctacttttagttagttccatcattaattagaaggatgagactgggcaaattactaaaccacagccgatattcatttatttaggttttacatgggaaaaataatatcagacccatgggatggccattaagattaaatgagataatacaatggcacttaagagatgctagttcccttatcttgccaggttcttaagcacattttgccttccttattattgtttcactttgcagcgtctcttatatattggagggaagggccaggtgtggtggatcacgcctctaattgcagcactttgggaggctgaggcaggcagatcacttgaggacaggagttggagaccagcgtggccaacatggtgaaatcctgtctctactaaaaatacaaaaattagctgggcttggtggtgggcacctgaaatcccagctgcttgggaggctgaggtaggagaatcacttaaacctgggaggaggaggatgcggtaagctgagatgtgtcactgcaccccactatgtcctcagtgggataatggcctgaaggggcaggcaatggggtcatgatacagataacagtgtttagggacattctttttaaattcttccatactaagtttaccctattctgctcaagatgaaagatcttcaaaagtaataatttaatttatgtgattgtgaagtactttcattacatgtaattgatcatcagcaaaggaagtttggattatttgaagtattttaattacatggaattaatgaccaaaaagtaagtattaatcttttgagaattaagaagaaaacaggctgaaaggaaactttctagaaaggttaaaaaagtggtacagccttttgcttacttaagaattccaaagtaataaaactcaccaaatgattggctcttgaaataacaagtctttgtcttttcatgaactccgtttaaatgccttactattttttaaaagcagctaaggaccccactgttgctaaagaagaacaaatcagcttcagagactgtgctgaagtattcaaatcaggacacaccacgaatggcatctacacgttaacattccctaattctacagaagagatcaaggtgaggtattcgtctccccttactaactccctggctctaggcaggccactttagtgagtgaggaaccagagagcagaagtctctccccaaagatcttccccagcctcacacagtacaaagccatagttactgggcagctacctcgcctagagtgcttgccaagggctctaagtgccgctgctgtgcagaaaatacaaaagctgcatatgaatgatgtagaaatgtctatcttatcttcggcaagaaatacattctccttgcattttgcttgaataatgcatactgtcagttgtttttcctgaggtgtcagactcatttccttaaagaaagtatcttccaaaaactgaaggttgaacaaccatagtgcatcagccatagaggtgtcatgaaattaataatttctactgctgtgtcaaagtcatttttcagtgatattattgttcctttcttttttgtgtgtgactgcatagtgacttgtacagttagctaccgctgccctgcctcacacggggatggtggcagttttacccaccatggtttttgctctatctgagcaaacgctaacacagtgccacagaccggtggtgtcttagcatcgtgaaaacagtttcaacctgtggacttggtgacatggtctgagggacacgcaggattctgaggtccacaccatgagaaccgctggggaaggcgattctaacctcatctaacgcagtctggaagactcgaaacacaccataaagacagtgttcattttcttctccagcagcggagttcacttcaaggcatatgtccaattactgcatgtaacgtgagtggacagtcagtactcacagcaggcaaagccacaacacagcttacctcagtcattcctagttctgcagcctcactcagagagcctgactcctgaaggtgctttgggagacactgaactttagataaggaaaaaaaaaaacccttccggagaatatttcaatgtggcttctcttaaacatttgatagggaagaatgatattacaggagaatcagtgtggtgaagtgttatgtaactactggataactgtatatattaaatgtctataaatatgtttgcatataaatgtaaaagcagctacatattgaaccaacacaaataactacagagaatacagtggatactgtaccaaagtggaaattttcgaggctcttggaagtattatctctttaaattgagtattatcctaagtatttaaaacagtatcaaagaaaaacactttaaaaatacaagcattagggttttaaagacctggaacttgaaacagtaacatgtatcttgattatgaacggaaaagataaatattgtgctattcaacataatgctttccaaagaaacctttctaattcattaatgctgtgttaaatcaaccctgaaaattagttaatgtccctaacgccctagaagccatacaacagggaaggaagggaacaaacccacaaacaacacagtctgctgcagatgaaaaggcaacgaacagactctaggctaagcctttcaatctcttttgctatctggttttcatgacaattctgtgcatgccattgtctgtcaccagatgttggcgtgttcttggcctggggacaggagtgtcaagaggggggacagaggatgcatgtgaaatggggatgccatggacaccgatgcagagggacagccgctaaccatgcagccccatcacattgtttcatctatgtttctcagtctaagtgcaagcttcccaccccagtgcactgtcccaccccatggcccccagaataactgaaatattctgcagaaagatgaaaatatatagtactctgggattatatgagcctcaggtcatggttggaaacattaggatttatattccctttaaacatttgcagtaaaagaaactcatttacacagcagggaacaataagctttcacaaacctcaattttctcatcttgaaaaataagtggtgtcaattgttacttctaaattcccttccagacttaagactctgtaagtcacaatctgatccagggagagatagacagacttggatgtaaattctagctctgccatttgtggctctgggcgagtcatttaacctttctgagagctcagtttccccatctgtaacagaacaatgataccctcagccttgggggttgtgacaacacagggacagcccctggggtagaacttgggacagtaaatggtagtggtcaccattttcactgccttcaaagactaccagacaacttctctgcctggcaggagacccaattctgcactcatttatctaattcaagaaaagaatgttcaattggtctttgagcagatcttttcctgaaaggccaaaatactgcagctttagttttgaaaaattcatttggttcttctacgagagagagactgcaagatggcatttatcaaaagcatgtatggtcatttccttccctaaatttcacaggacacctgactcctaacggttgtctctatggtttgctatttaacccgtcacttaatcattgcctcagagttgaagcaagtcaagtattatttgctgaaaaacatcaagctttatagaaagatatcaggttcctgcaccgtgcaccagtggacagattaaagatattaactgcccttaggtttgttgtaattggagtggtaaggtcttgggaagtatctgaggacttctgctttgctgatcctgatataatcaatttcagcacttttactcagtatcttctggctgggtagataactctatttgaacactatctttctctgcaagttttatagtccaattaaccataatactccagtttttacaaatcctctgttcttttttctaaaaacctggatgaagtactaagaaaatgttctaataaccttatcatcatcactaatggaatcaaagcgaatactcatatggctcaaatcatttatgtgctggcagtgactctcagacatttaagagttttgcctctgacttccataacaagataaacttgttctctgaacaagacagaacatgtatttaagtactggtaacttcatagcagtaattttgacactgaagaatcaaacattcttggaacaaggataggctcaccaagagccacatcaatgctttcaacccaagagcataccatttaggatacagaattaacttcaatatatgtacatgaatcctcaaaccaaagtagcttattcagctggtttatgaaatagatttttaaaaagaaatattgatagaagtgagcagcactgaccattttgttgactgcaggcaaataagaggcagtattattcatgaactgatttaaacttggaactgtgttgagggacttttggcctatttaccaaagggtcaggtttctctgtttttggcagcatgatgtcagtggaaaaaaaacataacaggaatcaaagagaccttattcaaatcctatatatcacttagaaggtgagtaactgatcaaaatcgaactttgctaaatcttttctcctttcaaaaatgcagaattatgatactacagcagagttgctgtgagattatagataatatacacaaagtatctggcagagtacttggatgagagtggtgtgtagcaatgataataaaaatcatagcaatacagagcggtaacaaggggttagcttgtgcagactgattttctacatcagattaatttaaaatgaggaaataattttcttcttaataaatgtaactttcattaatggcacctatgtttccaaacatgagtgccactggggaaggcaatacgagctgggtgaccttcctggagagagaccagaaccatgctggggagaagtcccctgcagaccaggctgttccagggacagttctctggttgcactggcaatgaggcatcaggcagccactgcacttcctctgcacccctctttcctcatgtaggaaatgaaagaacaggaatagcactctcttggttctcttttcgctctcctctttaggattctaactcgtaaacagagaacagtgtgcgttgaagcttaccctgccaaatcgcctccattattctcaaaaacaccatgggacacaacacaagaagaatatttacaattggttttgaaccttaacttcaatatttcctaccttgtatgtggcagaaaatttatcttactttctggaaaacatgtttcgttctactgtaatctttattatttaaaactatttatgtaatcttattttcaggggtttttaatttcataataaaactccagctgagttgaaattgagcatgcatgcgcttagcttaagaaagaattctgtgttctggacaaagtttaaacccacagagccagtttaagagcagaaataaaaagagttgcttagagaaaaactgtgggcagtgagctatgtacagagaagcgtgaagtcatgcccttgaggccaaggtgctaagccaagcccaggtcacacaccttgcaccaggacactggagcctcaaggcccttgtgctcagatgtgaaccaaaaaatctgattagtattgcacataaaggaagccaaacagccccacagtacgagaacgtaacaggagtcctccaaaccctatgatcaaagagtatccccttcacatagctctctgtggaggtggcaggggctggcatttagtgaaaggtttcaaggctgtgaacacaagtcaatggttttctacaggatggagatgtggggttcggggccaatctgccaaaatgtgccattcataatgaatctcaaaaaaaacagcaatctctgggccagccatcagggtggggtccttagcctggaacagatgatgacaagtgagtcatattctcatcaacactttatattatattactgtttatgtttcaccatcattttaatccaccactttcaatttatttgaaaccatctgtttcttagacaaccccgatggtctactccgtgccttatatcccagagaaccctctcggctgagtcctgcactcagggtctacattcctcctgcttctgctacgtaaggggggagtgggggggctctgtcacttataccctgcattcctgtttgcaggcctactgtgacatggaagctggaggaggcgggtggacaattattcagcgacgtgaggatggcagcgttgattttcagaggacttggaaagaatataaagtggtaaggacattctttaaggcatcaggaaagaatttcccttgtgaaaaatagctttcaagatctgcggaaccttaaccaccaatcccaaactaaccaatgacttttgacatggtttttaaaattggtgcttcagtctcccctttaaagaatggccaatataaggtcaactgtaccaaaacaaaagctgcagccagacgtgctggctcacgcctgtaatcccagcactttgggaggccgaggcagatggattacctgaggtcaggagtttgacaccagttggccaacataacaaaactctgtatctactaaaaatacaaatattagccaggtgtggtggtgcacacctgtaatcccagctactcaggaggctgaggcaggagaatcgcttgaacctgggaggcagagggtacagtcagccaagatcacaccactgcgctccagcctgggcaacagagtaagactctcaaataaacaaggctgccactacttagcttatttttaaaggtggactcagcatttttttggtaagccgactgtttaatggtgcttcacattcccatgaactgagctgtttatgccaaggcttctgctggtggctccccaagtagttctcattatcctaatacaagttttcttccagcagcagcttagtgtctaataactgacctatttaaaatccattttcctttgggaaggaccctaaattgtcacagcaccagaaggaatttctgctatttgatagttattctatgttaagttgacggactatccacttcaaatatacaaagaaaaaattacatgaaataattgaatttaacaacttgcattacagggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggtaagtgagttcatggtaattgaaagaaaaaattaaaagatttgtggccgggcacggtggctcacgcctgtaatcccagcactttgggaggccgaggtgggcggatcacgaggtcaggagatcgagaccatcctggcaaacaaagtgaaaccctgtctctactagaagtacaaaaaaattagccaggtgtggtggtgggcgcctgtagtcccagctactcgggaggctgaggcagaagaatggcgtgaacccgggaggcggagcttgcagtgagccgagatcgtgccacggcactgcaacctgggcgacagagcaagactccgtctcaaaaaaaaaagaaaagaaaaagaaaaagaaaaaaaaaattaaaaggtttgctgggtgactattccagaaaatgagaaacacaatgatttaaccaagatctaaactattacttctttaagtttctctgggtttaaaattctaactttggttataacaatataaaagaaacttcatacaaacagtattttgtccattgtgtttactgtgtatcttcaaagcctagaagaactctgcctggtagataattggctttcataggtatttgtaaaatcagtgaatagtaagtgttcccatgataatatgtcacatgaatagcataaatgatggatacttgtgactgtgctgttttattccaaaaggtttcaaaagttagtctgtctttatgaagtttaaacacattcaattgtcttcaatctcaaagtcaagattagttgtcaagtttagagatggcagagttaggtgggatggttagtcaactctgctctcctctacaggaaatacatcagattcacagcattccctgggtgtttaccttgtcctcacccatttggtagcaataatcataagtaatagcatgggcaaccttgactgggaatttactttctgcctctaaaatgccatgagagtagagagagagaacagcaatgggacttgacaacctagtgtgcaagataagtacggtgaagccacatgcacagtaatgctggtacacaaggcacatagaggcactccgaaatgtgtgtgcaacggtaggggcaaagacgtgagactgtgtgcccactggcaccaacgccagcctaaaggagtctaaagagcacagactgctggcgcctcgtgatcatggagcacacattatgaaatacccactttgaggtcagaaattagcaaatgaaggtcaacacgaacatcacaaaaacagtcatcatctgacctacagtctcatcttcatctcattaatgcccaagtcagacactccgctccacgacctgaacagtctgaaaggagacacaatgttaaagtccttgagcaggctgcccaggggaggattgtggtgggcagcacggagaagcggctaaatgtcaagttgcctgaacaaccaactgaaaactctacaatgcccagtatgtcctgctgtacaaacagtggatgaaaattcagaagcatgtttgagaaacagatatacatggatgtgactctttaaacatcagtgaagcatattcactattctcattatggaaagatcaggctctcctggagaggcaacaaccgagatgaatgagaagataggtgtttgggcctcacagcagttccaacttgactccaaagagatcaaaacttcaatgaattttgagacacaagtggttggtcagtgttttacctccaagttaaatattttttcaactggcaacagttaggaatctacaacagaagaattaaaaaaaaaaaaaaaagaagcacaaaaattaaggattaggctgtttgtataaaaagatttttacaaaatgggtcattacccttgtacgctgacattataaaaatattttaaactgagatggttcttaacagatatttcctttagaaatgcaatcaatttttggataggccatttagaaaaacacacacattggtttaaagcttaatttgcttggcaagataaaatagatattacatcgaaaattattatcctaataaaacatgatgctagcatgataagagaactgtgaagggactgaaacttctcataactgcaaatgctttgagacgccagttgtatgcagcatgtaagggatttttttttcccagaagaaatgttccccaagtgttggaaaactggaatatacatgttataagaaatgcataaatgcatcaatagaatttcattctttctagtaaaactaaaagctatgcgtacattaaatcttaaaaattcatcacttttcacacacattctggcagttttatataacactgaggtttaattgttaatgttgatgttacctctttactccactgttatataaaatcatccctggcaaagctgcagagattgaaaaaaaaaatcaacccataccaatgtaaagcaacttcaagaacatggccattcttaataaccaaattttaaagaaagcactttaaaccagtgggccacaaaaggacctaaaattacacaaaacctttctaacagagactcataaaaaatagtattctcccttatttttcttgcctctggggataatttaacaagttccatgagaactaaacatgttcaaaggagacaagagagagttaaaagataagcaagggaagtggttcatctcaatcctgtctatgattaatgggaagacaatggaaagaaagtacagtgtttcaaaatcccaacagagatgagtatttatgacattagcattttgcagcaggcatttagagactgagctacggccagtctcacttttgaaacgtgtgggaaaatactgagactcacatgtccagttcatgccttaggatgaagtttctagggctgccttaatactgaagtcacttaggagcaacacttacagaactccacatcacatggccctaccctcatcttttcacaacttcttcaacaaacaaacatctctgtttaggtgtgcaccagtgttgaaacatggcagaggcatttgctgcatctggtgcaaatcctacctccatgacttaagagtctgacctcggacaagtttatatctctgaacctcagtgactttcagtgccaaaacaaagatggcggccaccactgcaggtggttataagcatccagtgtgcatgcaggtgtaagcacctggcctggcccgaccagcaggtaaaactaaaagaacattttctctcttctttgtattcttccaatacaaactgttagaaattatattattccaatgtggcagcttgcaaacattagcaggttttacaaagaagggcatcatcttggtgcttcaagtacacttctcctgccaccattgcaggatttgctttgtaggctcctcgcctgggtcttcgtgtgcctgtttctccatcaggacgtgaggacccaacgtgccaacatggcataccccattacgtgaatgcctgctctgatctgtcctgaaccatctgccaagaagcttctttgcagcagaaactcttgagcatagttatggaaaataaaaaaaaaaaaaagaaaaaacaacctcaaaaatattgtcttctcccttcccttatatgctccttgctggtacacagatgaccgatgtaagccgtatttttgcaattcagcttacaatggttcaacttaagatttttcgactttacgatggtgtgaaggtgatacgcattcagcagaaactacactttgggatttaaatttggatctttccctggctagtgatatgtggcacgatgctccctcatgatgccaggcagcggcagcgagccacaggtcccagtcagtcctgtgatccccagggtgaacaacagacactgcgtgcaccgtgttgccaaatggctctgtctgactgtgggctaatgtgagtgttccgagcacatttaaggaaggctagagctaagctatgatgctccaaaggtcaggtgtattccatgcattttcaatatacaacattttcaacagaaaatgggcttatcagaacatagccccatgggaagtcagggatcgtctgtattgtaaatagtgtctaacttactccgacatttgttcctttctcaatgtctaaaagtttaattacattaccctactatacagacatgaggaaatgtagccacaaggatttattttcagcaccgttctgtagatttcttccccaaactcagtggccattccttgtctgctgcattctccatcccccccggggccccctgcggaaaataatgtttgaggttgtccagttgtctcaggactccgtctctatggaagatgactggagacctgggaggaggagcctggtgctgcatttctttctcttctgtttatctgaaagcagcaggaaaataaattacagggctctacagtcgcttctgatagttgtgcaagtgatatgtgttgaaggtttcatgaaaacatccctctttgctgaaggatttgatgataagttggttcctgtttataccagtgcaaaatattttgtccagagtatgcattagtccattaacgagtacagaacacgcttctgtagaatggaattcttcatcacaaaaaatttgccactacggtaaatcaatgaccctagccaatgtgttttttttctttgcacgcttacaggattcaccttaaaggacttacagggacagccggcaaaataagcagcatcagccaaccaggaaatgattttagcacaaaggatggagacaacgacaaatgtatttgcaaatgttcacaaatgctaacaggaggtagggatgactttctgtcttcctatttgtattggcaaggaatgatttcatagagggaaaggctggcaatttggactacaaattgtgatttgtaacgatgtccacaatttcatacgtagacacactagcttgatataggtaaatgtgtttttcactttttttagactaagttttaagtgagaatatgatatggagctagacttgtcagcaagccaactgtgtctcctcaggacctagccctggcaaggagaggggatatttgattcttagcaagctctcctgcgtttgtgcttgctggatactagagagatggtttaattacattttgctttatgtaaaaagttaaaaattccaagtagcaaccacaacagtaatatagattatagaaatatttccaactaataatttaatgttcaaagaaggaatttccagctgtcatttattatttatttatttacagacacagtctccagttgtttatttatttattttgagacagagtcttactttgttgtccagaagggagtgtgatcgcagctcactgcaacccctgcctcccaggctcaagcgattctcctgcctcagcctccccagtgctgggattataggcgcccaccagtgcacccggctaattttgtatttttagtagagggagggtttcaccatgtttgccaggctggtctcgaactgctgacctcaagtgatctgcccgccgcagcctccagaagtgttgagattacaggtgtgagccaccacacccggccccagctgtctttttaaaaaagattccattaatatatagcaacacctataaacacaaatgagttaatccaccttttttagtaaatcaaattaaaatgagtcatcttctactttgagacctttcttgtattgtaggtttggtattacactgccataaaacagacaatgaaaaccacactcataagccaaaaaccattgtagtagtcacttaaaacagatgggttggtattcagaaacatttgagagttcaaacataggaataaagttttagaaaatgttatttttctggccgggcccggtggctcacgcctgtaatgccagcactttggaggccaaggagggcggatcacctgaagttaggagttcaagaccagcctggccaacatgttgaaaccccatctcttactaaaaatacaaaaattacctgggcatggtggctggcacctgtaatccccagctactcctactcaggaggctcaggcaggagaatggcttgaacctgggaggcagaggttgcagtaacccaagatcgtgccactgcactccagcctgggggacagagcaagaattcactcaaaaaaaaaaaaaaaaaaaaaaagaaaagaaagtgttatttttctgatttgttaaaagtttagaaattcactgacaggaacaaacgctacttagtgactgagacaagaaaaaagtgtgacaaatgctgtcaagttagttcttgaaaaacactgaaagatttaaagtagcaacaaaaactctgccaatagtgcaaaatgaatgtaaagaataacaggaaaattggcagggtttaatttctagagaacataaatcatatctgcaaaaattaatatgttacccacccaggaaaaccaaaggtaacagctatggtcaacatgttttataaatgaaagttactacattaaacaaatggatgacccaagttatgatgcatttacactataggaatcattaatagggctgggcatggtggcccccgcttgtaatcccagcactttgggaggccaaggtggatggatcacctgaggtcaggagtttgagaccagcctggccaacatggcaaaaccccatctctactaaaaatacaaaaattagccaggcgtggtggcatacgcctgtaatcccagctactcaggaggctgaggcaggaaaatctcttgaaccggggagacagagtttgcaatgagccgagatcgcaccagtacaatccagcctggacgacaagagtgagactccgtctcaaaaaaaaaaagcatcattaacagtcaaaaggaggatttagtaatgaaaataatatgaaattcagtaattttcatgtctttaaatttcatgccttttatgctgaaagaatcaggcctcattaaaaaaaaaaaaaaagcaatcctctggttcctgagataatatgactactatttggtaccacaggtcctccctatgttacaccattattacaccaatgagcaaagccctcctattgattttgcaaaagcttcctgtttccttcatcctggcacaatcatcctttttaaagctgaacagcagggaaagggtcaggtggaggagccacagacacctaggactttgtttcctgtctaccatttccccacatgctggacccagctctctccttgagaagggtgtgcttattagaccacccgtatgtgctgagcttctcaggagagtaggagaatttcattaataaccaaggaaacaatatatttacttacgcaaatcaagatttagggactgagaatgtaattggaaaagagactggggagaggaaaaacagcccaagagagaaagtggagtggtcttgcctgtgaagaggtcaaattccagccagtggtctggaccatgaatgaaccagcctaatgagcagctccattttgcatggacagcaacttctctagttggacaagctccagaaggcactgacctatgaatctgtcaaagtcctgaatatgtgaaggattctgaatagaacacgcaaacttccgtccaatctgcattcacctgaatcaaatgaagtcactgagctgttaccaccaagaaacaatgtaggaacctggatgaaataacaaaccaatgtataaacacaacatatatatatataaagaatatatatatgtttttatatatatacatatataaagaatatgtatatgtttttatatatacatatataaagaatatgtatgtttttatatatacatatataaagaatatgtatgtttttatatatacatatataaagaatatgtatgtttttatatatacatatataaagaatatgcatgtttttatatatacatatataaagaatatgcatgtttttatatatacatatataaagaatatatatattctatatatacgtatatataaagaatatatatagaatatatatacgtatatataaagaatatatatagaatatatatagaatatatatacgtaataaagaatacatatattctatatatgtaaagtatatatattctatatataaatagatataaagaatatatacattcacatataaatatataaagaatatatatattccatatatacataaagaatatacattctatatatacatatataaagtatatatattctttctatatgtatataacatatatatgttatatatatgtatataacatatatatgttatatacatatatatgtatataacatatatatgttatatacatatatatgtatataacatatatatgtatacatatatataaaacatatataaagaatatatatattctatatatacataagaatatatatatatattctatatatacataagaatatatatatatattctatatatacataagaatatatatatatattctatatatacataagaatatatatatatatattctttggcatagagtttttattaagaaataatgcattacgggtaaggctaaagaggacctgccagtgccattccctacctgacgcttgggtcgaggttaattcactttatttattaattttcctacannnnnnnnnnnnnnnnnnnnaataatggtgtaacataggaggacctgtggtaccaaatagtagtcatattatctcaggaaccagaggattgctttttttttttttttaatgaggcctgattctttcagcataaaaggcatgaaatttaaagacatgaaaattactgaatttcatattattttcattactaaatcctccttttgactgttaatgatgctttttttttttgagacggagtctcactcttgtcgtccaggctggattgtactggtgcgatctcggctcattgcaaactctgcctccccggttcaagagattttcctgcctcagccttcctgagtagctgggataacaggcgtcccgcccaccacgcccggttaaattttttgtatttttagtaagagccggggtttcaccgtgttagcccaggatgttctcggtctcctgacctcgtgatccacccacctcggcctccccaagtgctgggattacaggcgtgagccactgcgcccggcccctgcttatagaatatttctagatttttccatttaatatttttggcccagctgacttcaggtatctgaaagtgcagcaagcaaaaatagcagataaggggggactactgtgtttctttctctcacaaaccccagcatgctcctgtttttggccaagcccagaaattaaggtgcagatggggcttcactcccacagcccctgtgctggacacctctcctgccctggctttagctgagtgagcacacactctcactttaaatttcctttttgtctctgaaacatagagacttcctttttatgtagctccactgagtacttaatattttaggnnnnnnnnnnnnnnnnnnnntaataaaactgaataatatacaacatattgcttccaatttcatggatataagatttgttcttctatagatcttagcatccttagtgtacgatttttttctctccttattaagtcaggaactttcaccttttcacttaaaggaagcactttacagcttctctttgacatatctgaattgccagcatcatcactcttgcacttttggggccattattaagtcaaataagcgttacttgaacataagcactgcgatactgtgacaatcgatctaataaccaagacagctactaagtgatcaggagaccggatgtagacagcgtggatccactggatagaggagattattcatgttctgggagggatgaagtgggcatcaggagattttatcccgttactcagaacggcatgcaatttaaggtttatacattcttttttttttttttttttttgagctggagtctcactctgtcgcccaggctggagtgcagtggcgcgatctcggctcactgcaagctccgcctcccgggttcacgccattctcctgcctcagcctcccgagtagctgggaatacaggcgtccgccaccacgcccggctaattttttgtatttttagtagagacggggtttcaccgtgttagccaggatggtctcggtctcctgatctcgtgatccacccacctcggcctcccaaagtgctgggattacaggcgtgagccactgcgcccggcccctgcttatagaatatttctagatttttccatttaatatttttggcccagctgacttcaggtatctgaaagtgcagaaagcaaaaatagcagataaggggggactactgtgtttctttctctcacaaaccccagcatgctcctgtttttggccaagcccagaaattaaggtgcagatggggcttcactcccacagcccctgtgctggacacctctcctgccctggctttagctgagcgagcacacactctcactttaaatttcctttttgtctctgaaacatagagacttcctttttatgtagctccactgagtacttaatattttagtttaaacttcaaccgaaaaaatcatttaatagagcaaggggagcctgagcgagtccagcccaccatgttgctgggactgcaaagtaatcctggttgaaggagagttttccaactgtgcctcagatgtttgcttactcctgctgtaagtgtgtacacactgtgggcttaccaaataggactgtggagaattcaggcctctccacacagcacaagggaaaaggtggaagaaggcttgtaaaagcatttgccgtaatggaactgtgatgtcatgggtgtatggctggaaaacaatccctctgccagtgcacatcctatactcaccatcatctgcatgtgcctactccacacgcctgcagtgtgcctcctgccttagctgagtattgctgtcttcgtggtgggagctggcatcacctagttcctaattccttctgtgttttactttcacaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattctaaaacagaggtctgttttctttcctagtaagatatatttttatagaactagactacaatttaatttctggttgagaaaagccttctatttaagaaatttacaaagctatatgtctcaagattcacccttaaatttacttaaggaaaaaaataattgacactagtaagtttttttatgtcaatcagcaaactgaaaaaaaaaaagggtttcaaagtgcaaaaacaaaatctgatgttcataatatatttaaatatttaccaaaaatttgagaacacagggctgggcgcagtggctcacacctataatcccagtacattggtaggcaaggtgggcagatcacctgaggtcaggagttcaagaccagcctggacaacatggtgaaaccctgtctctactaaataatacaaaaattagccaggcgtgctggcgggcacctgtaatcccagctactcgggaggctgaggcagggagaattgcttgcaccagggaggtagaggttgcagtgagccaagatcgcaccactgcactccagccggggcaacagagcaagactccatctcaaaaaaaaaaaaaaaaaaagaaagaaaagaaaatttgagaacacagctttatactcgggactacaaaaccataaactcctggagttttaactccttttgaaattttcatagtacaattaatactaatgaacatttgtgtaaagctttataatttaaaggcaatttctcatatattcttttctgaatcatttgcaaggaagttcagagtccagtctgtaactagcatctactatatgtctgtcttcaccttacagtgttctaccattattttttctttattccatttcaaaatctaatttattttaccccaacttctccccaccacttgacgtagttttagaacacacaggtgttgctacatatttggagtcaatgatggactctggcaaagtcaaggctctgttttatttccaccaaggtgcacttttccaacaactatttaactagttaagaacctccctatcttagaactgtatctactttatatttaagaaggttttatgaattcaacaacggtatcatggccttgtatcaagttgaaaaacaactgaaaataagaaaatttcacagcctcgaaagacaacaacaagtttctaggatatctcaatgacaagagtgatggatacttaggtagggaaacgctaatgcaggaaaaactggcaacaacacaatttatatcaattctctttgtaggcaggtgataaaaaattcaaggacaaatctcattatgtcattgtgcatcatatataatctcttatgagcgagaatggggggaatttgtgtttttactttacacttcaattccttacacggtatttcaaacaaacagttttgctgagaggagcttttgtctctccttaagaaaatgtttataaagctgaaaggaaatcaaacagtaatcttaaaaatgaaaacaaaacaacccaacaacctagataactacagtgatcagggagcacagttcaactccttgttatgttttagtcatatggcctactcaaacagctaaataacaacaccagtggcagataaaaatcaccatttatctttcagctattaatcttttgaatgaataaactgtgacaaacaaattaacatttttgaataggaaaggcaacttctgcacaatcctgtatccaagcaaactttaaattatccacttaattattacttaatcttaaaaaaaattagaacccagaacttttcaatgaagcatttgaaagttgaagtggaatttaggaaagccataaaaatataaatactgttatcacagcaccagcaagccataatctttatacctatcagttctatttctattaaaagtaaaaacattaagcaagatataagactacctgcccaagaattcagtcttttttcatttttgtttttctcagttctgaggatgttaatcgtcaaattttctttggactgcattcc

SEQ ID NO: 14213 - DNA, 30456 bp, Human
  misc_feature (1)...(30456): n = A,T,C or G
acacacatatggggcacctggtacattttgcacatccactcaggggtgagcacgtagcccagacaggattcagagctcagtctagaagccacgggcacagcagcttttttaacataccctcttcaagaaaaaaaagaagagaagcaagtcagagagggaggaagggaagctggcctagtgtgaggaacagggccaagggctttgtctttgtcagctcaggcagttataacaaaacaccatagactgggtagcttcagtaatagacatttattgtttacagtctggaggctagatgtccaagatcaagatgctggcagattaaatgtctggtgagcgctctctagctagcttgcagacagccaccttcttgctgtgtcctcacattggaagaggataaccaagttctggcctcttctcataagggccttaatcccatcatggtgggtcaaccctcatgacctcacccaaacctcatcatcttccaaaggccccatcaccaattaccatcacatggagatgagggcttcaacacatgaattggagagggggcaaaagcaagcattcagttcattataggcttatattccagaagacctgggctcaaaccctgtgctgtgtgacctggggaaagtcatcccacctctctgagcctcctgctgtggggaggaagcaggagaatgaagctgggctcagtgggggctgtctgcccaccctgggagcaggaacaagatcagtgtcaaaccatctaaggcaaaagtcagatccaagccaggtgtggcgactcacgcctgcaatcccagcaatttgggaggccgaggcgggcagatcacttgaggtcaggagtttgagacctgcctggccaatattgcaaaaccctgtctctactgaaaatacaaaaattagtcagtcgtggtggtgtgcacctgtagtaccagctaccggggaggttgaggcaggagaatcacttgaacccaggaggcggaggttgcagtgagctgagatcgtgccactgcactccagccttggtgacagagcgagactctcaaaaaaaaaagtcagatccaggcatgagctggatatgatcaccctaatccagagttgggggcccagggagggagtttcagcctggaggtgacagaaaagtcttcttgagccaactctagaccggtgtggtggggggtgacaaagagaggtgatggggtctgtggtttgtaatccataggcctgagcttctcaaactaggagtgatgggaggataggactcttgggataaacagaggactgaaaatttagggaaagtaggggacatttttattaaaatgaacatggcctatatgcaaaaattttaaagatttaacccgagccttcaaagaaagtgatcctgtaggggcgagtctcttctagccaagctccccaaagcccagaaatgagggactaggtctgagcccttcagcccttcagagtattttggtaagacagtctaagaaccactgccttgggccatagggagccatagcaggttctaggcagaaagagggcaggcgtatttgttagaaagtttctctgaccccgtgttggggtcagaaccagagggagaaaggctggggacagggatgggcggagggatccacgcgcagagaatgagattgcttaactccagatcatggtgaggctgcacctctgaaactggaatgtgtgtatttctggaaaacatttggagtcttcagtttcccaaaagctgccactgatctccctagagtactggggaccccaataagcccaaaacagctggtcctcaggacgagggaaagatgtgaaaatcccactatcaggtagcatggatggcgtggtgcatgctatcgcaacccctgttctacagataaggaaactgatgcccagagagagacggaggactcttatgaatattgggggggaccgcccctgcacctcggggacgtgaccccccccccaggctgacccgttcctcgctctgtcgtccccaggtggaggaggagctgacgcacctccagaagaaactaaaagggacagaggacgagctggataaatattccgaggacctgaaggacgcgcaggagaagctggagctcacggagaagaaggcctccgacgtacgtgtgcagggatgcgggagcccgcggcggggccaggccggagccccggggccgggaaggcggggagagccgcagggggaggaggaagaggaggaggagaaggcggcgcctcccagcgctttctccaaataagtcccgaaaaggggcactttccagcagctgtggccagcggtgccgacgtcaggccctcccccagcggtgctgacgtcggcggtccggccgggtgacctcatcgccccgacggcagccggcccggggggcggggagaggcgggggcggcccccgcgcaggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagtgagcgccccggcctcgggccccgcacccgcagcctcctcccccgcgcgccctcctttcttcccggcttcccgcgctgcccgcccgcgcgcagtcctcgggccgcctttttacgccctcggacgccgatcgccgacccacatccctgcgcccgcagccaggaccccctacttcctccgccgtcctccttcctgggcctgggacaggggagggggcgccgcctccgggtcgggcggggccggccaagcgggaaatggggggatggggcggagggggtgagcgatctccgggtggagaagtggagcggcgggagggggcgtatcgtgcaggctccgactccggggctggcgccggggtcccgggccgaggggaacccgcgaccggacttgtgggggagaatgaggatgaaaacgtggagcttccattgtctagggtttgaccggccgacagggatttcgacgggggaccggggatctggggagggggtcgcactttctcgcctctttcgcggcttcccggcttctgcttgcttccctgaccgttcccaggggcgcggcggcgacgtgtctgctccaggcggcgggggggatggggggggggggtgggaattggcgggctggaggaagttcagccccaagccgcccgcctttctccagctgattcctgcgggaaccggggcggcgggaccctgcctctctccagaaggccccgggaacgctggcgcggggccctgaacccacgatcgtttgagcgcctgctgtgcgcctccgccgcgagtcgcagggcccgagataaacaatgggtctgaaaaaggagggagtttcaccatcctctctgcatcatcctcctggctgtccctcgggacagatggtggcaccgccagggtctggggacagatttggattctggtcccatatcatgccacccacaggcttcatgacttggtatttgctctctaggagcttttttcccatctgcgagtaggactgataagaatcccgaccccccagagtagcagggagggtcccaggagtaaatctcaggcgtggagcctggcgctttgtaaataatcaattgtgttgttgttttttgttgttttgtttttgaggcagtctcactctgtcgcccaggctggagtgcagtggtgcgatctcggctcgctgcaacctccaccccccgagttcaagagattctcctgcttcagcctcccgagtagctgggattacaggtgcccgccaccacgcccagctaatttttttttttttattttggatttttagtagagacagtgtctcaccatgctggccaggctggtctcgaactcctgacctcgtgatctgcccaccttggcctcccaaagttctgggattacaagcgtgagccacggcgcccagcctcaattgtgttttctctgccctgggaagagctcatagacaaatggaggcaggggagctgactcactgatggagcgaggtctgcattccacgggttttctgtgcagttatgggagcatgacaggggaggctccaaaatggaggttgagctgggtcttatagaataaataagtttgctgggaccagagacatgggtgtgcacagactcagaggcaagaaagttgtatgatgagggtgggggggtgtgcggatagaggttgaagcccaaaagccctgaaagttcagtgttgaggctcagggtggggaccctagagaggcaaaagatgcccagccagatggaattggtggtgtgaattgccaggactggaaagagcccagatgggggctgcagcatgggccttggttgaagcctctaatcctgtaagggctgctttggcccaagaggccttagaaacccggtgtaagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttccgtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctcccaactccagacagctgaaaatctgccaaaagcgttgtttgccaggattcagaatttcccacataagggctactcacttcttaaaagacaactcatgaatcaagcacctctgtttgatctttaaaatcaattcctcgactgctaatgggtacacagttttttgtttgtttgtttgtctttggcgggttatgaaaatgtcctggaattcgataatggtgttggttgcagagtgtttttgcaacatcagttcctggcccagttactgaaggtggtaggaggagttaagatctaggcaattaaaaagaatgaaaggcacccattcatgggaaggcctcagtgacgtttcttaagacagtttcatcagtggttttcacaattctctgcatttggtgtttcagaggacactgcaatacgaaacacctgtgggagtgccctctttctgcttctaggaatctgaggctgagaaaccttcctgactctatttgtgtagtttttcggccacgttagcctcattctatttttttttcccccagtatgaactcagggcaggagagggagtggtttcctaataattttttttttttgagacggaatcttgctctgttacccaggctggagtgcagtggcgcgatctcggctcattgcaaccttcacctcccgggttcaagcgattctcctgcctcagcctcccaagtagctgggattacaggcgcctgcccccacacccaactgatttttttgtatttttagtagagatgcggtttcaccatgttggccaggctggtctcgaactcctgacctcatgtgatccacccacctccgcctcccaaagtgttaggattacggatgtgagccaccgcgcccggccttcctaataattttgatagccttccccagttcagggattcttcatttgttctgataggaaaaagctagcgtggcttcccttttcctctcggttgaggcccgtttgacccgttctcaatattccttccaaagagcaggcatcgctggaaaactcgccttgcctcgtagccctggcaggacctaggggacaggttctgacaaggaagagccctgggtgggtcttaagaggccattcatttcttaccaattctgagtcactgaataaaaccacttcccccagtggggcccctcggtttcttcacctgtaaaatgggtgcgatgtgtgaggatgaaattgcagtaaaataaaaccgtggcagtaagagatgcctttctctggcacatcccacctgctgggcataagcggcgccaccctctggagttacagcctcaaggcagtccggtaactaatcaggctttgggatggagagggccaggatgaggaagcaaccttcccaacaccacgtggctgtgaaaatgacaaagcacggtcgggcgcagtggctcacgcctgtaatcccagtactttgggagaccaaggcgggtggatcacgtgaggccaggagtttgagaccagcctgaccaacaagacgaaaccctgtctctactaaaaatacaaaaaaatagcaaggcgtggtggtgtccgtctgtaatcccagctactcaggaggctgaggcagaattgcttgaacccgggaggtagaagttgcagcaagccgagatcatgccattgcactccagccttggtgacggcgcaagactccatctcaaaaaaaaaattaaaaagaaaatgacaaagcggggattccagcccagcactttttggccctggagttcctggtttaatgcttcccattgtacttcctttcttgtaggtaaaaacaccttgaaaagccaataacactattggggtatgtcttccatgcctgcaaccaagttttctttccctttccatatctttttgtcctgccatctctcagccaggcggattgaaggatggaattccaacgaggctcccccgcctcgtcccaccttggtaattgcatggccaacatttaactgagggctccatagtcttgcatttatcttgccattcaggtgaatgggagcggaactcacaggacacaatgagccgggtcactgatggccttgctttctaagaatctcacagtgagccctagaactctctacgtggtaacactgtgtgcctttttcagagaagagcctatcttagatcttagcctaacgttgggtctattgtgttgctggagagaccagcactgacattcatctcaaagcacatggtatgtttgactcctatgttgactcaactacccatcttgtactgggacactcgctttttttttttttttttgagacggagtcttgctctgtcaccaggctggagtgcagtggcacgatctcagctcacggcaacctccgcctcccgggttcaagtgattcttctgcctcagcctcctgagcatgtggaactacaggcacgtgccaccacactcagctaatttttctatttttagtagagacagggtttcaccacgttggccaggatggtctcgatctcttgaccttgtgatacacccacctcagcctcccaaagtgctgggattacaggcatgagccaccacgcttggcgatgctcatcttttgctatggagtggtagatgtttttcccagacattttccgggaagatcatactgaaattttggtatgagtgtaaattccctatggcctggactcctgggtgggctttgacggggaagatcaggttaacagagggcaggacatgggggaggctcccactggtggctggcctgatacttcttaacatggctgcacctccgacctccccaggctgaaggtgatgtggccgccctcaaccgacgcatccagctcgttgaggaggagttggacagggctcaggaacgactggccacggccctgcagaagctggaggaggcagaaaaagctgcagatgagagtgagaggtaaggacgctttgaatctggtggcatccgtgtttgcttttagaaaatggggatcatgctgccgacctcgcagagctggtgtgaaagtaaacaaggtcacaaggacatgcatgtgtccacaaaaaagtgcatgacagcactttgtaaaccatcactccatgggtagagatgtttatccgtggccaggcacggtggctcatgcctgtaatcccagcactttgggaggccaaggcggacggatcacctgaggttgggagtttgagaccagcctggccaacatggtgaaaccccgtctttcctaaaagtacaaaaaaattagcctgccatggtggcgggcacctgtaatcccagctactcaggaggctgaggcaagagaatctcttgaacccaggaggcagaggctgcagtgagccgagatcgtgccattgcactccagcctgggcaacaagagcaaaactccatctcaaaataaagtgaggggtgtttatccttacggtaaccatgaaaagaaacttccgacagacagaaaggcaaacagaacgggcagatgtgagactgcaagtatgactgtccatggtggtcagtttgcaaagcactgcttctcgtattttctctgaaagccacagtgcctcttagtgttctctagacaccaaatttcaggtaggccggatgcagtgattcctgcctgtgctcccagcactttgggaggcagaggcgggcaaatcgcctgagctcaggagttcaagaccaactggggcaatgtggtgagaccctgtctctacaaaaaatacaaaaattagccgggtgtggtggtgcacgcctgtactcctggctactcaagaggctgaggtgggaggatcacttgaccccaagagtttgaagctgcagtgaggcaagattgtgccactgcactccagcctcagtgacagatgagattctgtctcaaaaaaaaaaaaaaaaaaaaaaaagcagagtactgtggagaggaggaaaggaaacttgggatgcacaggtgattgttagcagagctgtcaggctttaggcttttggacggtgacagctatttcagggacagttgcaaaccagcatggttaatgtacttgcaactgaccatgcaccaggtgccgtggctcacgcctataatcccagcactttgcgatgacgaggcgggtggatcaactgaggtcaggtgtttgagaccagactggccaacatggtgaaaccccgtctctattaaaaatacacaaattagctgggcgtggtggcgggcacctgtaatcccacctactcaggaggctaaggcaagatcccccagcttgaacccaggaggcagagggtgcagtgagccaagatcgcaccactgcactccagcctgggcaacagagtgagactctgtctcaaaaagaaactgaccacgttcctcacccgcccatggtatctgtgctgcaacccagccaccagtagggtgccttctcctcggtagccagatcattctctggcacgccttggcacaggctctctggaagactgagggtagattgtgtaattcacagaagcagcagtctgtgtgtggtggaaaaggagttccttgtgtggcaatggtgtgggcccgaccagtgatcatcgcgtctgcccctcattcacaccggagttctcacttgagccagccaccatgcttttgcagtataaacacctcccaaagattcatttctttttttttttttttttttgagacagggtcttactctatcacccaggctggaatgtagtggtgcgatcacagctcactgcagcctcgacctcctgggctcaagcgatcctcccgccacggcctccagagttccagagtaaagctgggactacaggcgcatgccatcatgcccagctaatttttttttgagacagagtctcgctctgtcgcccaggctggagtgcactggcgtgatctcagctcactacaagcttcacctcctgggttcacgacattctcctgcctcagcctcccaagtagctgggactacaggcacccgccaccacacccggctaatttttttgtatttttagtagagacagggtttcaccgtgttagccacgatgttctcaagctcctgaccttgtaatccacctgccttggcctcccaaagtgctggcacgcctagctaatttaagatgcatttctggttgtgctgctgtgaccactaaccagagattagaaaccagctaaggaatcttggagattgcatgtcacccaagctggaaatttcttcccaagtagtggaacagccagggcagagggaacagacgctactgcagactctgcttcagccactgaatcaagggagagagtggcagctccggcagccacggggcagtggaaggacccagtcacgagagttcctggctgtgcctgtggcctgggttagctgctgttcacagtcagaccagcctggctggatgctgacgttgagggctcccatattggcaaaccaagggaggctgcgaaggccagtctcttgtttgcaccatgtccccagaggcctttggtgacacccctgttaaagactgctgtgtctcagtagaaagaattatatacttgaagcttggggatctagagtcagcttctaccactggcactttctatggagccttaggcaagtcactttgatctcttgggtactacaaggggttttggggcaataaataacccagagagcttgctcacatgctgagggtgagacctcgtacaggtgggggagggtgttttgagacttagctgagaacgggtgacaccccacgtgaacatatttattggacagcaagaagcatatggtctctgtgctgggtgggaatgatacatatcaatgacacattatcccaggctggcctcttcttttcttttcttttcttgttttaaatacacaaggtcttggcagggtgcggtggctcacacctgtaatcccagccctttgggaggcgggcggatcgcttgagcccaggagtttgagaccagcctgcgcaacatagtgagaccccatctctacaaaaaaatattaaaaattagccaggcatggtagtgcatgctggtagtcccagccactcaagggactgaggtgggagaatcacctgatcccaggaaggcaaggttgcagtgagctatgattacaccactacactccagcctgggcaacagagtgagaacctgtctcaagaaaaaaaataaataaatacacaacgtcttgctctgtcacccaggctggagagcagtggtgcaatcacgactcaccgcagccttgaactcctgggctcaagcgatcctcctacctcagcaacattgcaaaacccccacctccacaaaaaatttttttttagtttagctgggtgcagtggtgcacacctatagtcccagctactcaggaggccgaggcaacaggattgcttgagcctgagaggacaaggctgccgtgagctctcagggcaccactgcactccaacctgggcaacagagtgagacaccatctctcaaaataaaagaaaaagaaagggggcacagactctggagtcagactgccaagggctgagcctcagctctaccacttaccagctctgtaaccttaagttacttaccctctctctatgccttagtttcttcatttgtaaaatgtggataatttacctgctccatagggcagttgtgaaagtgaaggcacttagaaaagtgcctggtagtaaagatgaagggaggctgggcgcggtggctcacacctgtaatcccagcactctgggaggtcaaggcgggcagatcacttgaggtcaggagttccagaccagcctggccaacatggcgaaaccccctctctactaaaaatataaaagttagccggtcacggtggtgcatgcctatagtcccggctatgctggaggctgagacaggagaattgcttgaacccaggagatggaggctgcagtgagctgagatcacactactgcactccagcctgggtgacagagcgagactccatctcaaaaaaaaaaaaaaaaaccaagatgaaggaaatgtgtgcacagagttccatctttgcagtgtgttacagtgctcagtagattcagagactcatttagatgagagatgggactaggggtggtgtctcacgcaattagccagacatggtgacgggtgcctgtaattccagctactcaggaggctgaggcaggagaatcgcttgaacccgggaggtggaggttgcagtgagctgagatcgtgccactgcactccagcctggatgacagagcgagactccatctgaaagaaaagatagatgagaggtgggtggaggggtgtgagtgaacggccgtcctgatgagattgctccttgcagaggaatgaaggtgatagaaaaccgggccatgaaggatgaggagaagatggagattcaggagatgcagctcaaagaggccaagcacattgcggaagaggctgaccgcaaatacgaggaggtgagtggggctggcagatggcgcagcagcaggaagtgggaggaaatgcatctgctgagatagggaggacaccggggccaacgaaaggaagctctcggttaggtcagctgtcctcctgcgtgaacatatgtttgtccagagacaaccacttggctaggaaactatctcccacgatgccagaaagtgctgcggacgcttgtctaacgtaatgggaaaaccgaatgatcagctcacttgtgtcgttagctgggagttttggcacagttgggcaaaaatggaggattgtggtcccaagccatggagtttcagaccatgcaagctcaggccctcctttgcctccctcgatggctcggctcttccctcccgcctcttgtctgcctcgctcctcaggcttgaggaagagaatcaggatttcctccaggccccaggatggctctttcagttgaagcgccagcaaaaggccaggcgcggtggctcgtacctgtaaccccagcacttcgaccgaggcgggaggatcacctgaggccaggagtttgagaccagcctgggcaacatagtgagaccccatttctaaaaataataataataataattagctgggtgtggtggcatgcacctgtagtcccagctacttgggaggctgaggcaggaggatcgcttgaacctgggaagtcaaggctgcagtgagctctgaccacgccactgcactccagccttggagacagagcaagaccctctgtcaaaaacataaaagggctgggcatggtggctcacgccggtaatcccagcactttgggaggccaaggcaggcagatcacctgaggtcaggagttcatgaccagcctggccaacgtggtgaaaccctgtctctacaaaaaatacaaaaattagccgggcatggtcgtgcatgcctgtaagcccagctatttggaaggctgagacaggagattcacttgaacccaggaggcagaggttgcagtgagtcaaggttgagccactgcatttcagcctgggtgatggagcgagactctgtctcaaaagaataaaaaaataaaaaagaggccaggtgtggtggctcatgcctataatcccagcactctgggaggccgaggtaggtggatcaggaggtcaggaattcgagaccagcctggccactacggtgaaaccccatctcgactgaaaatacaaaaattagctgggcgtggtggcacgcgcctgtagtcccagctacttggaaggctgaggcaggagaatcgcttgaacccaggaggtggaggttgcagtgagccgagactgtgccactgcactccagcctgggcaacagagggagactccgtccccctgcaaaaaaaagaaacaccagaaaaacccatgttgcagctggtctaggggtctgggtggggcatcattgggggctgtctgcagtggatgggagaggacacggctggtggggatcgggctcagctgggcctttctgtctctgcaggtagctcgtaagctggtcatcctggagggtgagctggagagggcagaggagcgtgcggaggtgtctgaactgtgagtggcagaacaggactgagcgaggctggctcgattcctggggcggagtgggaaggagctggctgtgttgggaattggctctgaccggggtctctgctcaagtggacgggcgtcaggggctcatggctcatcttttctcttggcttctgtgacaaagaggtggtgacttgttcttactgccatgggaagcactgcccacgtgttgaccctttctgcaaagatatgaggaaataggagtgagacaggaggcagcagggaagcccagaagtcccattttcccagagaggatatctcagggggctgtgccatcttaacagaacactgacctgctccagaaggcaggctcccccggtcagtatgtaaatgcttttgctcctgtcagtgtttggccgtgacacattcctggcgggaaggtgagaagcttaaccagaatcccacaagcaagcaccgaaaaacaaaacacctgtcctcttggccccgggtgaggaattcagccccacagagcatccgggagtgctgagagagatctggtttcacaaatccactccgggcttccttcccggagtgtcccctgcaaactcccattgctctctgcccgccttctgccctcagtcccattcttacaccttccggagtcggcctcatcaatcatagatttcacaagtccttgcagccttacccttggcaaaagaccaggagtgttttccaagccctccaaatactcttcgggcgcacctcgcctctgcctggtatgataagcctttgataagcccatagtatcacactgcagaaaaatccattaacattttctccccacattccttctgccccccaccgggggagctgtgtaggtttctcctttggaaaatttattgttggggcgattgctattattgccggctgtaagggaagataagacacaaaaatcctttgtctttgtgcagaaaatgtggtgacctggaagaagaactcaagaatgttactaacaatctgaaatctctggaggctgcatctgaaaaggtaggtggttggcttgagctggagggtggcttgctggactttgttcttttcttctcccgagggatgcaggagcctgtcaggttatggggaatctgccctttatttaacagtagcgttggtgcctggcagccagggtttttcccctacagaaagagctggatttctcctgcacactcttgagtcctcttccatggggtctgagcaccatctttgatctccatctcaggaggatagagatagaacatgaggctcttcttagcgagatctgagcatagttgtataaataaatacagagcctgcctctcacctgattcccctggttcctccagaaataccatctcaaaggtatagcaatgatcagaggtggaattgggctttttagtttgaaacagcacccaaagcagttgctacgtggcagctacgtcgggaacaaaggacacacttccatggccgaaccccactgaatttcccagcctcttcctcattcttgctcctgcttttgcagtttcacagacattctttgttctcccatcacctccaccccccacttttttttttttttttttgagacagagcttcgctctgttgcccaggctggaattcagtggcatgatcatagttcattgcagccttgaactcccaggctcaagcgatcctcccacctcagccaccacctgctattcactcaactgggtgtggctttccttttgcttgataaacccctattcagcctttttttttcttttctttttttttgagacagggtctcactctgtcacccaggctggagtgaagtggcgtgatctcagcttactgcagccttcgactcccaagttcaagcaattctcccacctcagcctcccgattacacgctaatttttataatttttggtagagatgaggtttcaccacattggccaggctggtctcgaactcctgatctcaagtgatctgcccgcctcgccctcccaaagtgctgggattacaggcatgacccactgcacctggcctagagatgagatcttgctctgttgcttaggctggaagtgtagtggcgtgatcatagctcactgcaggccccaaactcctgggcttaaataatcctatcacctcagcttcctgagtagctaggacttgcaggcatgtgccactactccaaaactgtatttttttttttttttttatagagcacagtctatgttgcctaggctggtcttaaactcctggcctcaagtgatcctcccaccttagcctcccaaagtgctgggattacaggcgtgggccaccgtgcctggctaatttttctagtttttggtagagacaaggtttcatcatgttggccaggctggtcttgaactcctggcctcaagtgatcctcccaccttggcctcccaaagtgctgggattactttgggaggccgccgagcctggcctcctgttcatcctttgagcttctgcttaaacatcacttctgagagtccttctctgatttctcatctaggttaggtatttctctgctgtgtagccctgtctatacttttgctggcattatgatttcttacatttattatagttactccattaattgcatgccttccttgctagattgtaagttgtaaggacaggaaccatgtcatcttgttcagagttgtgtccctagtactagcattgtgcctggcatatatctgtagtgtgtgtgtgtaattttttttttttttttttttttagtagagatggtgtttcaccatgttgcccaggctgatctcaaactcctggcctcgagtgatccacctgcctctgtctcccatatgtgccagccctggcatatatctgatactaggatgtgtaaggaatgaatccagttggtgtgtgtatgccagacactgccccgggccagggggatagatgtaacaccactaatacctcagctgctttgttttgttttgttttgagatggagccttgctctgtcgcccaggctggagtgcagaggcacgatctcagctcactgcaacctccacctcctaggctcaagcaattctcctgcctcagcctcctgagtaactgggaatacaggcgcacacaccacgcccagctaatttttgtatttttagtagagacggagtttcaccatgttggccaggctcgtctcaaactcctgacctcaagtgatccacccacctcggcctcccaaagggctgggattacaggtgtgagccactgtgcccagcctggcatctgctcttgaagagctcagagtcgagtctagtggaagggattgacaaagtcacagagtgctttgggaatacaatagagggaccttggtaggttgtgaacggtgtcaccaaggaggcgacatttaaaacagctgtaggtccagcacggtggctcatgcctgtaattccagcactttaggaagccgaggcgggaggatcgcttgagctcagaagttcgagaccagcctgggcaacatggagagatcccgtctctaccaaaaatacaaaaactagctgggcatggtggtgcatgcttgtgatcctagctacttgggaggctgaggtgagaggatcacttgagcctggagggcggaggttgcattgagccaagattgccccactgcactccagagtcaggcttcagtcatgacttgatcacttaatagccatgtgaccctaggcaaaataataacttcacctttctgtgaccctttcctcccctataaaatgggattacagataccaggctgtgatgccattaactatgtctggcccatggtaagcagctaataagtgttagttattattgggaggccgaggcaggcggatcacctgaggtcaggagttcgagagcagcctggctggccatcgtagcgaaaccccatctctgctaaaaataacaaaaattagctgggcatggtggtgggcgcctgtaggcccagctacttgggaggctgagtcaggggaattgcttcagcctgggaggcagaagttgcaagtcacagtgagccgagatcgtaccactgcactccagcctgggtgacagagcaagattctgtctgaaaaaaaaaaaaagaaaagaaaagtataatttctgatgggtcatcatggggaggggaacattccatgctaaggggtgcattcatggacagggactgggactcaggagtccacagattatgatcagggagtgcctgtcaccctggggaaggtggtggagaatggggttggaaatacagagggggccttgagtaacagattcccagttatctccctttcttcgccatactttttatctcaagttctcagtttaggccttctgatcaataccatcctacaggactctccccaacatcctccacatttcacacatatttcttctgctggggaaaggtgcctgcctctactctgcctacttttttttttttttctttttgagatggagtctcactccatcgccccaggctggagtgcggtggcgccatctggcctcactacagcctccacctcctgggtttaagcaattctcatgccttagcctcctgagtagctgagattacaggcacccaccaccacacctggctaatttttgtatttttagtaaagacagcgtttcgccatgttggccaggctggtctcgaactcctgacctcaagcgatccacccgccttggcctcccagagtactgggattacaggcgtgagccaccgtgcctggcctgcttacttctttttatgcttcttcctccttttttttgagatggggtcctgccctgttgcccaggctagagtgtagtggtccaatcagagctctctgcagccttgaattccagggttcaagccatcttccctcctcagcgtccccattagctgggactacaggtgctcaccaccatgactggctaatttttaaattctttgtagagacggggtctcactatgtgacccaggttggtctcaaattcctgggctcaagtaattctcccaccatggtcccccaaaacactggaatcacaggtgagagccaccacacccagccctccttttctttctttctgttttttttttgtttttgttgttgttgttgtttgtttttttgagatggagtcttactctgtcacccaggctggagtgcagtggcgtgatctcggctcactgcaacctccacctcccaggttcgagtgagtcttctgcctcatcctccccagtagctgggactacagctgcatgccaccaagcctggctaatttttgtatttttagtagagacggggtttcaccatgttggccaggctggtctcgaactcctgaccttgtgatccaccagcctcaggctcccaaagtgccaggattccaggcatgagccaccatgcctggctgggcctccttttcttaaagcagtgttttggtttctcccacagtattctgaaaaggaggacaaatatgaagaagaaattaaacttctgtctgacaaactgaaagaggtgagtgtggtggcacccagcgagctctggtttctcctggggctggtcttgaagccatgatagtaactcctttcttcttatctaggctgagacccgtgctgaatttgcagagagaacggttgcaaaactggaaaagacaattgatgacctggaaggtatgaggttaccatctaaatgtttgccttgccctgccttcccctctgggacacatccacggacagttggggaatgtttgtggaggggctgggttgggctttgtttgccttaggaaagtaaagcgcatagtgatgtcatatctggatgtcctggaacactggaataggataatgcaaagcattcaggcttgaatggcccttttttttttttttttttttttctatgagacggagtctggctctgtctcccaggctggatggagtgcagtggcgccatctcggctcactgcaacctgcgcctcccgggttcaagtgattctcctgcctcagcctcccaggtagctgggactacaggcgtgtgccgccacacctggctaattgaattgccactttcaggaggtaaaatatctctgcttagttagtcccatgagcaagtatagagaaaagagtatggctctctctgattaaaaaaatattaataataaattaaaaatctcaggccaggcgcagtggctcaagcctgtaatcctagcactttgggaggccgaggcgggcggatcacttgaaatcaggagtttgagactaacctggccaacatggtgaaaccccgtctctaccaaaaatagaaaaaattagccaggcgtggtggtgcacgcctgtaatcctagctactggggaggctgaggcagggagaatcccttgaacctgggaggcggaggttgcagtaagccaagatcacgccacagctctccagcctgggtgacagagccagactccgtctcaaaaaaaaaaaaacttcacaatttccttctgtttgctcatttctgatagatgccttgcattttttttttacatgccttgcatttttgcagaagctctgtcccagggagctcaaagcttatcatagtatttaaaaaaaaaaacagaaatacagaaagtgtagggactgcaataaagactagtctgcaagtctggggcccacttctcccagaattttttcaagagttccagtgtttaacattcggcctcagaaattccagaatcttggggttcaaatggaatcttccaaactgcccatcccacccagaaaggacacattcttcagaccatatcttccaatgtttttttggggaagtgaggttcccatataagggaaaatgccccattccaaaatacgacctttggacagggtgacgtcattggaaatccgaaataaactgaggggtggggaccagtggggggaagctctgtcacttctggttaccactgttttgaagcttcattgtggctaatccccctgcagaacctcaaaccacttagagatcaactccatagatctttggttttcttcatctgtttcacatggaacacagctttctcctagtctgtgctttgtttgctcacgtgtttttttcttcctcttgtggttcatctgtggcactccattccgacccttgccttctgtcccctgtacttctgaactgtctccctggggacctccgccctctagatgagttatacgctcagaagctcaagtacaaagctatcagcgaggaactggaccacgctctcaacgacatgacctctctctgagaggcagccaggtcgctgccctctgtccttctcacatggtgcctcctacgcccctgtgggcttctaggagctccggtggcctgccttctggtttgaacgtcagagccttcttctgatgtgtctgtgactctacaaccgaaataaagacgggcagtcctcctcttcatgccccctcattctcattttctccacttgctgcctttgagctgtagctgtgtgcccttaaccatagcctgaaacacaaagtgggtggttagcctctctcactcacaaatgaaaagcttattacaaaaagaaaattatgcctacaggatgcttttctgaagacgtgaaaacaaaagcaaactgggcatgtgctctcagataccgctgttagctaacggcatctgcatgccaataatttttttttgtttttttgttttgagacagggtcttgctttgtcacccaggctggagtgcagtgacaccatcatagttcactgcaacctccacctacaaggctcaagctatcctcccacctcgacctcccaagtagctggaactacaggtgtgcaccaccacacaaggctaatttttgtactttttttttttttttttgaggcggagtctcactatgtcgcccaggctggagtgcagtggtgcaatctcggctcactgcaacctccgcctcccgggttcaagcaattctcctgcctcagcctcccaagtagctgagattacaggcatacaccaccacacctggctaatttttcttttggatttttagtagagacagggtttcaccatgttggtcaggctggtctcaaactcctgaccttgtgatccgcctgccttggcctcccaaagtgcagggattacaggcttgagccatcacgcctggccatttttgtactttttgtagaagcgggagggtttcactatgttgcccaggctggtcttgaactgctgggctcaggcagtctgcccacctcaccctcccagggtgctgcaattacaggcatgagccaccgcgcccatccccaatggtttttccttaaatagaaattgttgtgaatggaggctcatccttgtaaaccgcttaggcagcttaagagtcaacagggatttggaaaaaccagcaagcctgtgtcaaaaatgaggctccccttgaatggggcttgagctacagattcaaacagcggcagtgacattttgatctccatttcctccttttcttgtgtcttttctctgtgttacactgtgagtgtggtgactggggcttcccgtggctttactcttcactgttcatccagctcccagtcctgggaggaagttcacctccacgccctgcccttagaaaactgactgtacaaggagtgaacgggcctccatgaacagggaaagtgctgtgacgtcagaagacgtgaatttagaattcttttcccgaattccagaattgcctgagactgctaacatcaatctccattcatatttcagttagttataacaggaaccttgctttagtttagaatagctcttaaggttgacctgtgggtaataaaaggtcatgctttttcctacatgaggaatatggagaaaacaaggtcactcttttttttttttttttttttcaagacagggtctcactctgttgcccgggctggagtgcagtggcgccatcttggctcactgcaacctccgcctcctgggttcaagtgattctcatgcctcagcctcccgagtagctgggattacagtcgcggaccaccacactcagctaatttttgtactttcagtagagatggggtttcaccatgttagctaggctggtctgaaactcctggcctcaactgatccgcccacctcagcttccaaaaatgctgggattacaggcgtgagccactttgcccggcccaggctatgctttgcttttttttttcttctttctttttgagacggagtttcgctcttgttgcccacgctggagtgcagtggcgccatctctgctcactgcaacctctgcctcacgggttcaagcaattctcctgcctcagcctcccaagtagctgggactacaggcatgcgccaccatgcctggctaattttgtatttttagtagagacagggtttcaccatgttggccaggctggttttgaacccctgacctcaggtgatccacccgcctcggcctcccaaagtgctgggattacaggtgtgagccactgcacctggcccaagctatgcttttctaatgatcaaaaacataccaatttgtcccaaaatttcaaatagtgcatctggttctcccctgcatcctaccaccactaccacctcaaattatcacagataattgacatttagatgttcaagccacatcttccagactaccccttgaacctggaaatggcatgaaaatctccaactagatcctgaattttcggtatccattgttattcctcatcctatttttttgtccaggtgggaagctctgtccccattactctctctattcatccattcctccaaaatgcacctcccctaaaccacctccacctttccaccctcagcctctccctgctcctaactgccgtccatcctgaacttctgcaaaaaccattcccctcacacattgccatatatatgcccttggaaagattacagactgtgtagggggctggtttttgtttggagtctgtgtgtttgtccctggaatttctccaggcatttctggactccaccctttgaagtaactatgcagcctgtctatccagttattctacctaactaagcacataagtggaatttcagagattagtgctatggccgggcacggtggctcacgcctgtaatcccaacactttgggaggccaaggcaggcaggtcacttgaggtcagaagttcaggaccaacctggtcaacatggtgaaactctgtctctactaaaaatgcaaaaattagccgggcatggtcatgggggcctgtaatcccagctactggggaggctgaggtgggaaaatcaatcacttgaacctgggaggcggagcttgctgtgagccaaggtcgaacctttgtactccagcctgggcgacagagtgagactccgcctcaaaaaaaaagaaaagaaaagaaaagagattagcactatggaggtctacactatctgttgatagtctgtgagccttgtcgtgattctcaagggcagttaacactttcagggaaagtcattttatctcagacctaataacaaaatagatgctaaagcatctgagtgacaagatgaagcgaagtcaggatttgtagtcaagagaccagggtttaaggcctggcgcagtggctcacacttgtaatcccagcactttgggaggccaaggcaggcggatcacttgagctcaggagtttgagaccaatctgggcaatatggcaagaccccatctctaaaattattcataataatattttatttttaaaaaattttttaataaaataataaataaagagaccaggatttaaaatcctagctctactactttaaccatgccaacgtgaacaagctgcttaggttttctgcaaaataaaggtgatatctctgttatgaggattaaatgagataatggagaaactggctcgtccaacatagtcagcattcagttaacatctattcacccagactggataggcccaggtcactgatctgtctgatagaatcctcccaggtcatagtcacttgactctgtgtgtgtgtgtgtgtgtgtgtgtgtgtgatggagtcccactctgtcacccaggctggagggcagtgacgcaatctcggctcactgcagtgtccgcctcccgggttcaagtgattctcctgcctcagcctcctgtgtagctgggattacaggtgtgcgccaccacacccggctaattttttgtatttttaagtagagatggggtttcgccatgttagccaggctggtctcgagctcttgacctcaagggatccacccaccttggcctcctaaagtgctgggattacaggtgtgagccaccatgcccagcacccccccaaagatttctaaacctgaaactgccagggtgaaagtcacaagagagaaagtactttttttttgagacagggtctcactctgttgtccaggctgaagtgcagtggcgtaatcacgaatcaccgtagccttgacctccctgggctcaggtgatcctcccacctcagcctcccgcatagctgggactgcaggtgcatgccaccacctggccaatttttgcattttttctagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacaattatgtgtataatttaaacagccttcccagaagctccgaagaaagagggttacaggattttagatttaactatcaaaggctcaggggctaattaactagcacttgggtggaaatttatattaagtcacacatatctaggactgaaatcttcatgtagcagcacgtcataggttctgaagtatttctcctttattcctcatcataacccccacaccacgcattgatatcgttacccccatttgacagacggggaaaacagacctaggaaggttagatgcttacttaagtgatacaactggagcttaagttcaggtattctgactcaagggttaccagagttcacaaggaaaaatacaggacaccaacttaaatctgagtttcagataagcaatgaataattttttaatcataagtatatctcttgcataagtacatctcatgcaacatttgggatatacttacactaaaatattatttgtggtttatctgaaattcaatttaactgggcgccctgcattttatcttacaactgtgactcccaaatttggtgcttgttccttagtattctgtgatgttctgctgtaattaaaaatacaaagtactggacaggcatggtggctataacccacctgtattcccagcactttgggaggctgagcagatgggttccttgagcccaggagctcaagaccagcctgggtaacatggtgagaccctgtctctagaaaaaatgcaaaaattggccaggtggtggcatgcacctgcagtcccagctatgcgggaggctgaggtgggaggatcacctgagcccagggaggtcaaggctacggtgattcgtgattacgccactgcacttcagcctggacaacagagtgagaccctgtctcaaaaaaaaagtactttctctcttgtgactttcaccctggcagtttcaggtttagaaatctttgggggggtgctgggcatggtggctcacacctgtaatcccagcactttaggaggccaaggtgggtggatcacttgaggtcaagagctcgagaccagcctggctaacatggtgaaaccccatctctactaaaaatacaaaaattagccgggtggtggtggcacgcgtctgtaatcccagctactcgggaggctgaggcaggagaattgcttgagcctggcaggtgaaggttgcagtgagccaagatcgcgccactgcactccagcctgggtgacagaatgagaccctgtctcaagaagaagaaaaaaaaacaaatctttttttttctttcatttaacaaagacgcttattaatttatctttccccatactcttaatcctcaccagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggattttccatccagagccaataaaaggactggtgggggccgggggtggctattgtgggaagtcataacccacagatagatcaacctaagaatcctggcccttctccactctccaccatgcaggacaaacatcttctcaagcagtcaacgtagaatgcttgggaaatagtcataattacccacatatagtaattaatagatggtaattaattgatccttgatgtgatgttcttttgcatatttccttcattctaaagttgttccctggccgggagcgttggctttcgcctgtaatcccaacactttgggaggccaggacagatcacttgaggtcaggagttcgagaccagcccagccaacatggcgaaaccatgtctctactaaaaatacaaaaattatggtgacgcctgcctgtagtcccagctactcgggaggctgaggcaggaggatcgcttgaacccaggaagtggagactgcagtgagccgatatcgcaccacagcgctccagcctggtcgacagagtgagactccatctcaagaaaaaataaaaataaagttgttctctgaagagcaaatgtctcattccagtaatgacccactcagcaggaatatggtggagttcagtccaattcaggtcagccatatccaaaagaccacaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggnnnnnnnnnnnnnnnnnnnnnnnnnnnnnnnnnnnnnnnnnnnnnnnnnnnnnnnnnnnnnnnnnnnnnnnnnnnnnnnnnnnnnnntacccaccccaccccaccaccctactcctatttattcagcaccacactacccaggaaatacactagcaaattgtgcaatggaataaaatccacactttagattcttgcaactgtatcatatgtaatagtatcactttttctacattttggtcaaataaatttttacataaactacaatttgcgtgaattttagaatgtgtgggggtacacagagcattttggttcaacaaatgttaaagggatggaaagggaaaataaccagagccaagaatgtagacaaggttatctatttgctttatactgtgacttcatgatacaaggatattacagtctcattgcaggcgagagcactcagcctcggtcactcgaaaactcctggccttccttatcccctacgctgcctaagccaggctgtgaagaatgagtaggattttaagagataaaagcagggaaaatcatctctgttgcctgagttaggaagatctgcctagctaaggctgagttacacatacaaaggaaagcagaccagcatgggcaccatagtgagaccccgtctacaaacaataacaaaaatttggccaggtacagtggccaaattacacctgtaatcccagcactttgggaggccgaggctggcggaccgcttagggccaggagttcaggaccagcctggccaacattgtgaaaccccatctctactaaaaacacaaaaatgagctgggcatggtggtgcacacctataatcccagctacccgggaggcggaggttgcagtgagccgagatcacgccactgcactccagccccggtgacagagcgggactctgtctcaaacacacacacacaaactagtggggtgtggtggcacatgcctataagtcccagctactcgagaggctgaggaagaaggatcgcttgagcccaggaggcagaggatgcagtgagctatgattggcctgtgcactccagcctgggggaccgtctctgagcaagaccctgtctcaaaataagtaaataaataaagcaaagcagaagcagaaaagctggaaggtaggctgagcccacactgatgacagcctgaacttaatttagtcaggagtggagagccactaaagactagaggaggccaggtgcggtggctcacacctgtaatcccagcactttgggaggctgaggcaggtggatcatttgagctcaggagttcaagactggcctgggcaacatggtgaaaccccgtttctactaaaaatacaaaaattagctgggtgcacacctgtaatccccagcactttgggaggctgaggcaggtggatcatttgagctcaggagttcaagactggcctgggcaacatggtgaaaccccgtctctactaaaaatacaaaaattagcgggtgcacacctgtaatcccagctactcaggaggctgaggcaggagaatcacttgaacccaggaggtagaggttgcagtgagctgagatcatgccactgcccttcagcctaggcaacagagcaagactcttgtctccaaaaataaaaaataaagactaaaaagactggaagaggccaggtgcagtggctcccacctgtaatcccagcactttgagaggccgagatgggcagatcacgaggtcaggagattgagaccatcctggctaacagggtgaaaccccatctctactaaaaa

SEQ ID NO: 14214 - DNA, 26711 bp, Human
ataactgagagtgggagcctggcttcagtctcagcccctgaccacactataccagtgtatcccaagtacaaattgtccgccttaagtagaaatgctttcagttatgattcagggtgtggaggccacagcagagatcacttttactaagcttttctaggtatgtctctttcaggttccaaaagtatatattggattatgattgcttatgtgtttttaatgaagaaaataggatccagacattgatttgaaagtccttcaaaaaagtaaaaaccaggttgggagcagtggctcatacctgtaagcccagcactttgggaggctgaggtgggaggattgctgaagcccaggagtttgagaccaacctgggcaatgtagggagaccctgtctctactaaataaataaataaataaataaataaataaataagtcgggcatggtggcatgtgccctgtagtcccagcttcttgggaggctgaggtgggaggattgcttgggcccaggaatcaaggccgcagtgagctgtgattgtgccactgtactacagcctgggtgacaatgcaagactgtctcaaaagaaaaacaaaagtaaggaccagaaaacctgatattgtttgttacacccttttttctcttcgattgcctacttcaagtgaatattaattgtattttagggaagactgacttccacagagacctatctggaactcctggttccttacctctgcttctgtcagagcagctctgggttttggtttgttactattgtacacattaggcttctatacaagaagaactggtcccattggtttaaaaataagtttgaaaatcctagaaacagtgagagtcagaaaaaaaaactgtttttatatacatattctctcccccaccccctttctctccagttgaaatatgttgcagagctctaaatttagggatgcttttggcgtatttcttatacactccagaggcactcgagataaattatcttcaatgttagatctctcttagctttgctagttgtatttgttaatccattttgagttctctagcctgtgtccattttatgtgtgtatagaatgaggccatggagatgttgtacaactgtgtcgtttggcagcagagtcctaaggaattggtggtgactatgggatggtggtagccactggggctgcctcaaatggaaaggaaagggttctaagtatttataaaagaaaattctagtgtataactgagcatcttctatttaccagcacttgatactactaaatcgtcacagcaccccggtgttattattatctctgtttacaaatgaggaagctgaagctcaggtcacacaggtagacaggaagtgatggggtcagattcccagctaggtctgccttggagctttccttcttgtgagggtgatgttcagttcactctggaactggtgtagccatcgccacatttagagtgcattttagagtttgagccagttttgatgattttacttcaacttactgatggaactccttgttcatccctggaactctctaacacttctgctgggagtttagagggatggccacaccaagctgcttgggtacattttctaaaacaaaatttattgtaagaaatggaaattatgaacaaaatataccactatctctttttgctgtgaagttaagtttattggctactgttaacaatttatttacttacttacttactattcttttgtagagacagggtcttgccatgttccccaggctggtgtcaaactcctggattcaagcaatcctggtgcctcagcctcccaaagtgctgggattacatgtgtgagccactgtacctggcctcaactcttgttaaaattaaagcaccttaatacgtttagcaaactcatcagaccaataaatattttcaagatgtatgcagaattaccagtggcacatcccctttttctgtggctccaccccttcaactttttgtccaagaaaacttttcgtgtttgcctgtagctgatgtgcagttgtttctgctcccaaatcaacagggtttaatgaaaaccctagaaagtagaaacccgtgggagagaaaagaaaaaagacaagttcacaaggtatgtttagtgtataaaaaaggagaaggactagaaagcctgagatacaaaggaaatgaagaaactaatcagtgagatagagataaagcttttttctgaatttttagcattattacctgatttagttaaccagctgcattaattttatgctcctgatttgtgcacaaattgaaatttttgctattggatttaggttccctctctaggagtttctcagttgtttgcactaagtaggatatagttgctaacttacttagatgaccttttatgaaatttgtaggtgatatatttatttcatttctggagcagatacagctgagcagcttaggtagactatgaagaaagtgtgtgtgtatatatacaccaactaaaatgttaaaggtaaatagcctaaaagtagcaatttttttttgaaaagcaacctgagttttcagtagagtgttattataaaccaagctttacccagagagaaattgactgaaaaacacgttttctgagatgttttagagtttgagctgtttctcagttgatggcatgagctatttcaggaacagaactatatagatctttagacttttattacttcttatttattttcttcagaatacttttacatttggtttgaggagagtcagaattcttatctggattcaccatgttcacatctgtgtgcacatgacagatttcagttctgctgtggttaacttatctgacttgtccaacaggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacaggtaagtgagacccatgttttggtggaattcaggaaacaggtgggttacagggctcattcactctaggaaaaatctgtttgcttaaatcttcacttagcaaaatatgcctcctgatatattgtagtataatatatattgcacagatatatattgtgtttatatgagacagctaattgacaggtgcttcagtgcccactgtttttccccagattgtcatttttcttacccagattatattgtttctagcagtttatcagtttaaaattcagtggcataaatgctaatttatagaattaatctgactttcccccattttcctttgtgtccctgtgttacagatcacagactgttcttgaattagttacctctgtatatatgtgtcttcccttctagatgttgacgttgcaaagggcaggggccatgtttaatttttattaccttcacagtaatggtgctggcacgtagtagacactcagtaaatgtttgattcataggaactgcaggttgcttcacgttatagcaatatttgcacagttggaagcaccaaccaaggtctgtaaagatagttttgaagtctcctctgctttctcaggggatgttttgtttcagacctcatttttctatatttgagctgaagaaactaattacatggattaaggactgcttatggtgaaagagtaagaatacaacgagatatgtgtgtggaatgaaaccaggtcattattttttagtataaacttttctgtttttttttttttttttcagaagggctagatattaaatgacatttaagaaattcttgtttcagtgacagctacactgttagcattatggggcactggatgaccttctgggtggttgttaactgatgttaaccatttagaaaatgcaaatgcacgggaagcagattaaggaaatgtaaacagtgactatttttaggaatgcagtatggatatgtttcttcttaacatttttgtattttgtaaaaattgtgtatattgcacatattattacttatcagaagaagtgaaaaaaaggagaaatgagttaaatcatgtccaacttcctgagtggcttatgatccactaatgttgccaaggcagcgggggactggtttgttggctctgtggcacactgtgcacccccgccacccccgtgtcatccctgacttgtccctgtgcttcttagagcctgggatggctcttgtcataagcggaaccagagcagatggctctcttctgaacagcttgcccttgattccagtagctacagcattagtctgtctttccgaatgaagatttatatttatattatggaacttgctgatgggtttctcaagttttctgcttgttatggcctgtcaacaaggctttcactctgcgttcaggtgtgtgggccttgatcattgataccatggtgtccatgagcctgttgttcacatggtgctgtcaatgagcagagaacagtcacctgcttacctgtctgttcatcttacttcatttatggtgcagttttacgtgtgactgaatatgccttcaccctcctatgatcatgtttaagtttaggttgccatgaggaggcatggcaaatgcttttgaacactttcgtacccctcatcttatgtctctccaggccctagattagtggtcatctttcagagaatggctagaactcgagtcttctgggatagcctactaacacgctttaccattgaggagtgtcttcaaaactcacatcatctgaattgccatgcgtctctatatgtgaaaagtaattggaaagtgtttcttgtagggggaaatgttttagggttgttgggtatcagtcctagagctgatttatgtatattttcaacttaaaaattattccatagaaatatttgtgttgccgcaggggttgttagctgggaaccccagtgtgttctgctttgcctttcaccctgtcacaggggttttcaccttgacggcacactagattcacccagaagcttttaaaaatggcagcacatggactgcatctcaagaacttctcattttggttgacaggggcagggtagagacgtcacaatattttaaaagctccccagccgattctaatatgtgccatgggtgaagctctaatgcattccaaattgttaggaggagtaaacagtttagagaagaggttggtaccagtgtgaagaagcatatagaagcagagcaatgcttccataggattcttgactttgtcaccctgactgccttgacctggtcacggctatgtaaggctgacccttaacttgatgtgtagctgtgaacccaacagttatgagcacaaagatagtaaactgaggccagtaggagtgcccagttcgggttgactcctgtgctagttcaagacaaaaatttcctaaatatatatgacgttggtttgatacagaaccagcttttctgttttcctgtccccatttaaaaatctcctatgtcaattatactagtctaaaagactcctaggcctaatctgtctgataaatttctgacgatcttatttctgagtcagtctcaccaacgtctctatacattaattaacattatatacatactcttgataactttaatagttaatatctattcttttcagcaagttaagccccaaatattttttatttctattttagattttgggggagggtttgtgtatgtagtgaaggatccccagtgactttcagtttttatacaagaaatcattaataaagctaagaaattaacttagcacattctgttcatctcttgtatcaagtgcagtttgtgatcatgttgtttttgtctaaaaacttatttgtaaatttttacagttctaagaatgtattttgtgcaatcataaaggttttatattaatatataagttatataattcactctgaaatatctcaaagcaaatatttctgaaataagtaaaatagtggttctcaaagtttttggtcattacatacctttacattcttaaaaatcattagggaccccaaaaaacttgtttgtgggtttatatattttgatatttactatattagaaattaaaactgagaaaatatatattcattcaaaaataatacattttaacataagtagcattttttagtgaaaatacctattttctataaaccctccaagttaataagaatagtggcattgttttacacatttacaaatctctaataccaagcttaatagaagacagctggttctcatctgtgtttgcattctaactgttgtgctatcacacatcatgtagccttcggaaaattccactatacacatgggagaatgagaatgaaaaaggcaaataaatcctactagtattgagaaaggaactgtaacctcaaagaccctctgaaagcgtctttgagaactaccttatgcactttgagaactactggtgaattatttaatgatgagggaactttgagaaaaagaactctgaagttcctgaatttgaagattattttacctttagtggacaaaagagtaaatataagagaatgtgacagtttgtgtctgtagatagtatttcctttgcaaatttatcattttgaaggatttcattactactgaaaaagtgcagaacattttgggagtaagaatgctcaatttcatttagccttttaatatcacataaatttttcttgtatagggttatgatatattctctgatttgctttttcaaagccatactgctgtaacttttaattttctaatttctagtagagactaagtcatttgacaaagtgagaattaaaactaatagctgaattccttctcttctagcccttcgccacaagaagatgggcagatcatgtttgatgtggaaatgcacaccagcagggaccatagctctcaggtgtgtcggggggattctgatttacagtaaacaattaagaaagatgtaaattctctaagtatattttgctaaaataaatgtgaagacttttaggaatagtttgaagctattattgagtttctgattttggaatttatttaggatgatatagttcttgtcgcactcctttacaactaaggattttgggccctgtcactctaaacgaattggaaaattcttgtccataataaatcatgccaatactccaggctagtttcttgagtgtataagtagaaaaagactgagatagatgctttaagaccacagaatagggaggagccaagatggctgaataggaacagctccggtctacagctcccagcatgagcgacgcagaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgtgcttttcagaccggcttaaaaaacggcgcaccacgagactatatcccacacctggctcggagggtcctatgcccacggaatctcgctgattgctagcacagcagtctgagatcaaactgcaaggcggcagcgaggctgggggaggggcgcccgccattgcccaggcttgcttaggtaaacagagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacacagagcgcctctcctcctccaaaggaacgcagttcctcaccagcaacggaacaaagctggatggagaatgattttgacgagctgagagaagaaggcttcagacgatcaaattagagtgagctacgggaggacattcaaaccaaaggcaaagaagttgaaaactgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaagtggactaaattctgcaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaatattagacagatcaacaagacagaaagtcaacaaggatacccaggaattgaactcagctctgcaccaagcagacctaatagacgtctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctagcatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacaaaaaatgatactacaaacacctctacgcaaataaactagaaaatctggaagaaatggatacattcctcgacacatacactctcccaagactaaaccaggaagaagttgaatctctgaatagaccaataacaggagctgaaattgtggcaataatcaatagtttaccaaccaagaagagtccaggaccagatggattcacagccgaattctaccagaggtacaaggaggaactggtaccattccttctgaaactattccaatcaatagaaaaagagggaatcctctgtaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccattttctcagcccaaaatctccttaagctgataagcaacttcagcaaagtctcaggatacaaaatcaatgtacaaaaatcacaagcattcctatacaccaacaagagacaaacagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaagataatttacagattcagtgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactataccacaaggctacagtaaccaaaacagcatggtactggtaccaaaacatagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctacacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacagttatgcagccaaaaaacacatgaaaaaatgctcatcatcactggccatcagagaaatgcaaatcaaaaccactatgagatgtcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcaggtatctagaactagaaataccatttgacccagccatcccattactgggtatatacccaaatgactataaatcatgctgctataaagacacatgcacacgtatgtttattgcggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggagcggggaggggggaaggatagcattgggagatatacctaatgctagatgacgagttagtgggtgcagcacaccagcatggcacatgtatacatatgtaactaacctgcacaatgtgcacatgtaccctaaaacttaaattaaaaaaaaaaaacaaaaaaaaaaacctaccagtggaggtacaaaataaaaaaaaaaaaaaagaccacagaataaatgaagatgaaggttgtattagaactagacatgaagacttttttttgcatctgaaatcaaagcagtggcttttgagataaattttaaatttatctaaattatgcaggattccttcaagataaatattgtttactaggagttgacaatgttggaaacatagatggatatagtattaaaatcttacaaatgtttgtgttataagacttaaaatatggtaagtatataactgtggctaatgatttagaatactcatagccagcctttaactttattgatatgtaagatcacctaaaagtgtcattagagtacaaattcttgaggacgggaaccattatctttttctcctgtatttagggtgcttgaaaaatgtttaatgaacctttgaatgagtcgcaacaaaaaccttgttttgtcgggttctcactattctgtgtcctgggcactagaaatattttgtgtgtcttagatccacccagtattctttctgtttccaaaggccacagaattcctctatactttactatgctctatttttgcttttctctgaaatgtcgaaaatctttggattcaacacaaatttattttatgatgatgagctttatactgtagagaagctcacaatagcaggctgtcgtatataagatgatctgactggagcatttgaattgctggcttatgtatgtcagtttggccacatgcagtaagctatagctgatgtagaagaaagcttacaaagtctccatagcagaaagtgtaccacggaatccaggagagaaatcgaattctttgccgtggtctttcctgaggaggatttcttcaatctatatcaccttttatacagaaagctttaagtttagattagcattttccaaaatgtgttttcaagaacatttgttcaaaggtcaaataaatggaaggtaatgcagccccaggttcccccacactctcaccttagtagtcgcatgagtaattctgaccagttcctgcagtaaagaaattatagtttaagctggacatggtggcacttgcctgtagtctcagctacttgggaggtggaggtgggaggatcccttgagccccacaagtttttgagtccagcctgggcaacatagcaagactctctgtctctaaaaaaaagaaaaaaagaaatgggtttaattaaaccaaatgtttcccaagcttatttgaccttagactttcttcctcttctctgcatacgtttttcccttaagaacttaataactccgtggagcactgtggtaagtgctttcctggctcatggagttgcagatgtgcaatcaggcttaactcaatattgaatgtacatggaattctagagttgaatgcatctaccctggaattccaaaggaatttttgaaattcaggaaagaaaatgtcaggtttttggcctttggtaggtttgccagtgttgatcccttctcaggaccaaatccctaaaagagcataggctatcatcaagaggaggtacttactttatgttgacaatcagatcggtcagtttcaacaaagggaagagtttggaaagacagcctaacccctgtgagagataacagttgagtaggacttaataagggagctgtcagcaggtatagtttaaactttcaaaaacctttgacattgcctttttttaatggaagaaacaataatttaaaaattaatttctttaggatttgggaaaattgattttcttcctgaataagaagaaagtttagggttaggaaacttaaaaaagcagttaaaggactgttattgtacttgatcttatagaatgtttttatatgtgtttataaggactatatataattttcaagcttttctaagatgaggaagtaaagtcactaacattaactagatatgttctaggtactcagtttcttttttttttttttggagacagcgtctcagggtcttgctttgtcacccaggctggagtgtagtggtgcagttgtagctcaccacagacttcgattcccggctcaagcaatctttctgcctcagtctccctagtagctgggactacaggctcacactgccacgcctggctacttttttattttttttttgtatagacagagtctcgctatattgcccaggccgttttcaaactcctggcctcaaatgatcctcccatgtcggcctcccaaagtgctggaattacagacatgagttactactcccacctctcttttaatgttctcaatccagtgaaagcaatgatattatccccatggaccagtggaaaaagtgaggctttgtactaattacttatctaagatcacaaagcaagtcactgttagagccaggattcaaagcaggtctgagtctgtggcccttgttctttctactgaactaagtaaatgaattcgattgataacaggagagctcacaaagccatgagaatgaactgaaaaatgtctgctgagttatggtatggggaatctgcctaaggcagtgtgcacttaggaaaaagaccatgaaactgcttttcggatgatcatcctcaagagtctcagttttgtatcagaaaacagactgtagattgtttcttcacttgatcttagccaaaagtccgagaagcgatatagattatttattgaagacatttttgcattgtgtttctgggaccaaaaatgccagcacaatgttgagtgttactgaaaaatgatccaaacagaaaatatcctccatttcctgtcttgtaaaactgtgatttttatctgtacatgaatcatggtatacagcttaatatccatatttagaggacagagtgaccttgaggtaaaccagagaaggaaaacttaagtgatcagaaaacaaagaactccatgtgagagaacaggctagaacgatcagaatcttctttgtttttgttttttgtttttgagatggacctcactctgtcaccaggctggagtgcagtggcatcggctcactgcaacctctgtttccaggtggttctgctgcctcagctgcccaagaagctgggattacaggtgtgcaccacaacgcctggctaatttttgtatttttagtagagacagggtttcgccgtgctggccaggctggtctcaaactcctaacctcaagtgatccgtccacctcggcctccctaagtgctgggattacaggcatgagccatggtgcccagccagaatcttctttgaatagatgtaggtatagagagaggattattgattttaaaagcacaaatcttacgtaattagattaagtacatttttaccatattctggaattctaagaattggaaggcagtttaaaacctgaaagtggcaaatttaagattaataaaaggaagcacagagtggtagtgaatgaggaaagcttaccactcttattcttaaagtattgtaagttgagaaacttatggagttcttttttgttttgttttctttttaaaacacttgtccagagataactttgcttcattcaactgagaaaattccatcctcatgaaaaaaaaaattagagcgtgaaatcttactgcgtttcattctgtcagaaattatgaaatattaacttgttaaatctttgagcaggtttaaagaaagatctgtgaggccaaagcaggaaactaaacagaagcgacctgcagtgtgttgagtatagtcagatattgtgtgtacaggaactgatgtgcaagtaaattgtaacagtttattgtttttgatttgggatgatttcagtgttactccaaagagccaactcatgattctgagtaatctcaatagccaatggaaggagcttaatcctaaatgctacattgtgtcattcagtggaatttgccaagttcagcagaactagataagattggtactaacaagagcagcagaacgcacaggggttttactttgccctgtctgaagctccttcctggggtagctgtttcacagagaactagacctgtcaagagtcatgtgaatatgtcagactctgcatttcttagctacctactgaaaagaatgacagctttggtcattcttttgagtgaatcctagtcaaacaaaataaaatgtcaaaatgcttcttagttttgagacccctgggtttgggatcatagcatgacatcccttaaaactgactatgaccaggcacggtggctcacgcctgtaatctcaacactttgggaggctgaggcgtgtagatcacttgaggtcaggagttcgagaccagcctggccaacatggtgaaaccccgtctctacgaaaaatataaaaatttgccaggtgtagtgccaggcgcctgtaatcccagctactctggaagctgaggcaggagaattgctagaacccaggaggcagaggttgcagtgagccaaggtcgcgccactgcactccagcctgggtgacagagcgagactccgtctcaaaaagaaaactgaataaataatactgaataaataaatatcatttttaggactttttcattccttttggttctattaaaaggggagctattggaaatgttaattgttcttggcctgaaactttaggttataataagcaatttttaaaagtcacattttttattttatttgatatgacacatgttaaattctgactcaacttattatagattattcccaaaaacttttggctaacatagtttcgaaaccttggaaaatgtttgtatagcaatttgtcctaaaaatataatctccttccagagagtaaaccctggtgcttaacagtagggcctctctatacagtattcctgggtttgaatactggccctgctatgtactggttgtggaaccttaggcaagttatttaatctatgtctcagtctcctcatctgtaaaatgggattttaataattatttttatagggttatttgttgcaaggtgaaagttaatgcatgtggctgggtgcagtgtctcacacctgtaatcccagcactttgggaggctgaggcagggaagatcccttgagcccgggagttcaagaccaggctgggcaacatagtgaaacactgtctctttaaagaaatacaaaaattagctgggcgtggtggcacacacctgtagtcccagctacttgggaggttgaggtgggagaattaattgagcccaggagttcgaggctgcagtaagctgtgattgcactctggcctgggtgacacaggagaccctgtctccagaaaaaaaaaaaaaatgcatgtaacatgcttggaataatatttgcccctttaagtgctcaataaatactattatttatttcctcatcacatctctcacttatttttgttttacttctcatcattttatttttagcatatccttttatttccttttatttttttaattatgaaatttttttttttcttttttttgttgagatggaatctcactctatcacccaggctggagtgtagtggctggatctcggctccacctcccaggctcaagcaacctccacctcccaggctcaagcgattcttctgcctcagcctctcaagtagctgggattacaggtgcccgccaccatgcccggctaatttttttttgttttgttttgttttgttttttgaggcggagtctcgctctttcccccaggcaggagtgtagtggcgcgatctctgctcactgcaagctccgcctcctgggttcacgccattctcctgcctcagcctcccgagtagctgggactacaggtgcccgccatcacgcccagctaatttttttgtatttttagtagacacagggtttcactgtgttagccaggatggtctcgatctcctgaccttgtgatccgctcacctcggcctcccaaagtgctgggattacaggcgtgagccaccgcacccagcgtgtaagttttgtgtttttttttagtaaagacggggttttaccatgttggccaggctggtctccagcttctgacctcaagtgatccgcctgcctcagcctcccaaagtgctgggattataggcatgagccactgcacccggcctaattacgaaaattttaagtgcatacaagagagaataatataatggacctccatgtaagtattgcccagatttaactcttatcgaggtttttcatacttcccttagcattacatcccaaagtacagtcttatgcagttcctgtgctgtgcttagatatcccaacagtgaagctcactcaggttgttctgaagatattacatactctgatcttacattatttttcagcattttttagaaaagcaacatgtttgttatctaaaatttctgagacacaaccttatgagtttggtatcttttctgtctagatttttctttgtattaggaggaattggtcttcctttttttcttaaagtttgaattcttctttacagtcagaagaagaagttgtagaaggagagaaggaagtcgaggctttgaagaaaagtgcggactgggtatcagactggtccagtagacccgaaaacattccacccaagtgagttctcacatgtttcttgtcagtggacacagttgatctgcgcacgcttacaggcaatgggcctggtaatccccacgatattttcagcaaatgacatctgcctctgaatttctttctcagggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctagggtaagtaccggtcaactcctgaagttttttccattcattttatcctcttattttcagattgaagaaatgtatgtgaaagcagtttttattgctttactttcaatgttttagtgcaaataaggtgaacttaaaaaagtgggtgcacaattgttctacaaataagcatttttaataatagtagagtgtgttttcttatttgaaaataagatgtttggcctggtgtggtggctcatgccagtaatcccagcactttgggaggccaagatgggtggatgacctgaggccaggagttcaagaccagcctggccaacatggtgaaacccggtctctactaaaaatacaaaaattagctggccatggtggtacatgcctgtggtcccagctacttgggaggctgaggcaggagaatcgcttgaacatgggaggcggaaattgcagtgagccgagatcatgccactgcactccagcctgggggatagagtgagactccatctcggaaaaaaaaaaaaaaaaaagaagatgttcataataatcccctaaatgatcaaatgtaagcggactcctctgtgattgatttttctttttgggttttgttgtgtaatatttaatcttgagtaatttatgaactaaactaatctttagcatgtacattttgtggtcagtgcaaatacctttttttcatatgggaaaatacatgattacattgaatagttttttttaatgaaactggtaggttgattggtgctaattttttccttttttaactttgtagtattttcatttattttgctaaaatcaacctcatatttacgtgtaattcattagtttcttagccacatcttttaaataaattgctttttttccttgatttaaacaattgaggaattacacttctgaaagattttaggagttaaacagtagctgttaatttttttcaagacgtatgttgtgctctaagcatgcccagtgggtcattttcagtataagatatgcagaagatggggtcatcctttttcttccctttaaggagctcagcatattggagagagattcttagtcacgacctcagaaacttgcatacagctttccacacacccgtcttgtctctcttgggtgcttgatctgcttttgtgagggcaaggacagtaatcaacaaacagcaacctagaaggggtttgtgcagaaggggactgtgtgactgttgcgtgggggttgatgtggggcaggtgtaggagtttaatacattgctgcctatacagcagttcattgcccttaagcgattggtgtctataccttgccgtctctctttcagtcatcttcagattgtttgtcttggctgtaagtataactattgctatagatgaatgtaaaaagagtgtttaaaaagttcgttgctttaattgcactggaggtgaagctagttacatactttccttaacttcccttctgcttttgctgttgaagaggccaaatactttcttggcatgaaaaagtattataaggcccctaatccttaggagttattagtaagagctgtctttaaagcactggcagcttttaaggttttttttttcttttgtcctacatagagcaccagaataatttcacatattactatatttttgtgtctgaaatgtcagtagaaccttctgtccaccaaagaggaacatcttgaaggagttgggctgctttatttactctgtggagggatctgttctctctggctttactttgtctaatcactacccctttgctgtcgagccccgatatttaatgagtaaacaaactcatataaaaccagtttggccgggctggtgactggttttaagaaagtcagtgatgatttcacggtgtttggggagcggtacccacaaacctttagagccttttacaaagactgaagagttttaagtagagttcaacctgtggacaagctggtatagaactgttgaaacaggtgaaacatgatgcttctgcttcctttcagcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaacttttcctgtcagtatatcatttttctgtcgcacctgttgcctgggagtttcaggcgatgaggcctcctcgcctacacacagccttccagtcatctggcttccccagcagtggagttcctaacagtgctcagggtgtgaacggtgttctgtggggacagtcaccgcagtgtgagcattcgtgagtgcctcgggactgtggcattcagagcatttgcctccaggtagtggcaggagggcgctcacgggaggagtgctcaggaagtacaggagagaagaagagtgtgccctgatggaaatgacagtgggacaccagtgaaagtggatccagaaggaactggaagttccacgtgcctggaaaacaggatggatacagaggaaactgaaaaatgtaggttagtactgaacctaattgaaatgtgtgtgccctcccaggggtcacacttcatcatatagttagctgggtttacttcttttaaaccaggaggtgatttaagatgtaaattttagacagtcaagccatctggtgagagagtaccagaggagatcaatcagttctctaggcgaggagctagggcctgtcctgggctgtcaccctgaggttggcagtggtgggccaggatacgtatgagaaacaaagcggaagtaaactggtcagaaagtgacttagagacgaaggcgtgtgtattcctttgtgtgtgtggcccgaaaacatgggttgatcccattagttaaaggaggacaggagaagaaatggggtggtaggagcaaagagggaggatttcagttttgagtgcgttgaacatgaaatgtctgagggccttctgattggacacttattaaatagaactataacccaggagaagggtctggagtggaagtaaaacacaatcagacccatgcattatatatttatatgatgtttaaagattggacaatgggcaaggaagaaagttactcaaacaacagggaagcccaaaatttgaaggctaagcagaagagaagttctaggtgaaattgttggtatcacagaaaccccaaaagtaggaggtgaccaagcctgacatgtttcgtggttaagtaagatgaatcgagaagctttggaatatggcagtcagatctgtgctgatctttgcaagagcattttctgtaggagtgaaagagggatcctggataagattgtgttgggtcaatgaatgaatagcaagaagtgttggcttttttgaataaacttcatgattaagaaaacaaggggggagtttctgaagaggagacaggatagtaggattgttggcttaggttgggaatatagaggggccaatgtgtaggctaaggagagagagcaaagggagatattagcgttacggagggagcagatcagtaatggaagagtgggacgtactccctcccggagaggaaggaaatgtaattaagcactcagggagggtgagcgttagaaaggtggagtttacaaaacccagacattgatgacaggaaatgaagacatgagaaggggtgagttagaaatggaaagtgatgaaacccctgtctggtggctccactttctccatgtttgaggaggaggcggtggtcgatgctgaaggaagacagagctgtttcccatcagtatctcctctggaaggagacgggaactaatgctgaaatcctcaaagccttacaatggctcctgccttcattccccagtgcagccagaagcaccaggcaggtggactgggctctgctgcttcacagcctgggcgacatgatgctttgagcttcagctgtctcctgtgtcaagccaaggggctgcccgaggtgctctctgtggaccttttaattctgcagttgctgttagtaaattatggttcagggtaaaaagcaggattaggaatgggtgaatgatcgcttgagcccaggaatttgagaccaacctgggcaatataggaagactccttctctactaaaaaatattaaccaggcatggtagcacacgcctgtagttgca

SEQ ID NO: 14215 - DNA, 8391 bp, Human
aatcaaccacgtgaaccctcctctcttttatttaatcctttggaaattgcataaagaactgagactattggataagtgacatatttcttaattaatctttttatattgtaaagaaaataatgttcaaactctgcttctcattccaaaaagacttgtacatgttactatagtccaatagtgtctgatatattttattattaaaattgtgaaagtattttgaatgagctacttattaatccttatgcttccttatgccatttaattcttatttttgttaaatatatttctgggttctgaaagaagcattcaaatacctaatcctcctgtctcttctgaaatatactttttttttttttttttgctaaagaagtggagataagatgatgttgaggattattttttcctaggaaatatacaataagtagataaaatgatttttgcattttggatattattttttttccagagaatattactgaagcaaaattgatcaagtaaagcagaactgtggatggcaggctagaaaaatctgtggtcgccattgtcacaccacaacctgcagcagctgtattctcaagtccctccctcccacgcccttcttagcctgccagcctagcaggaatgaatgggttccgcagagcactgtgtgagtagtgctgcagaccctgaaaatttgtctctgaaaaccaaaaggaaaaattatttgtaaaaaataaattttcaactttagtggccaaacttatttacctctgaaatttcatcaccaacatccagtggtacgaagtccagtgacttactccggatcgttgctgagaatggaggcttcctaaatatcaagataattttactccaatttatttcctaggggtgaaagcaaagcctttttgtcccaagggacaactgagcaaccaccagagtctctagctgaacagcaagggtgtgaggccggctaaaattcccacagttagaagcccactcgcaggaggatatttaccaaattgacataagaactacataaaaaggaaatgcgtttattgagctgatgtttcacagttgtctgtggatggaggcgacattgcaaaattctttttacattatattattctcttcttctttttaatttggtgtattggttattactattattttgcttgttactttccagacaaaagtccaattcagatatgtaactgcacacatgtagtactaacttctgagctcaattatttctccttgtattttcccaattttctatcaggaaagatgattcattccaaaggacaatgtaccatacaaaatgtgttacatagacttctcataaaagaatacctctagtaaaccattataactactctacgttcacttgctcttgattattgccatgttagaactatttgttcgcttctttatttaatatggttattctttccatcttccagttttgtttagctattcgggtgtgcgtgtgcctgcagaagaagctctgaaaataagttagttgaacctgagaaaccatttggaatgaccgtatggctaaatctttttttaaattaaaaaaatcacatatacccaggccatttcgagcatcatgccgattttccctcccactttacgtttaaagcaattagagatgttgaaccctaacaaaatgtagtcgagtttaatatactacgagggaggggctggcagtcattttcctttaaatatttaatctaaacataaattgttattaagggtagggggaaaaaacctcacatagataattttaactgcagtttgaggtttaagcaacagaaagtcttctaaccccagtcccctttcttctccttccgcccctccccaaccccgccccataatggatgctcggccgactgcttctgcacggtctctttgtctaaaggatgcaaacagtctacggatgctagagaaaaaggggtgggggagagattacctcatcccacgtcgcttgcaccaatcaccagtctcctgtcatggcttctctgggcagattgggggtctggaccaacaggaaaaggccccggcccatccccatggtgaccgagttgtatatagggagccgcatccgcctatgtgccgcaggttctcttacatcgaccgcctaagagtcgcgctgtaagaagcaacaacctctcctcttcgtctccgccatcagctcggcagtcgcgaagcagcaaccatggtgagaatcggcttcggctctttgtggccgttgggtggagtcagcgcccccaggctctacttggaaaacctttaagctcttttctttcgtaagctctctgggcgagggtggtggtatgttttgtgaggtttagcttagccccaaatcctcaagccccgccgccgccgcagtgcgggtgcaggaaccgggccagtactgcgcccagggcgcagcagagcgctggggaggaacaaaggcggcgcctaggcgcctgtgttatccgagagactttcgggggccgcgggcagcccgtctgccgcgaccgaggggtctggggcgtcccggctgggccccgtgtctgtgcgcacggtttcgctgatgctgaggggccactttctgtctcgcgttgttctctggggaccgggagaggaggaggcacccaaaaagagcgggggcgttgggcgagctgggggacgtgggagggggaacgggaacaaagcgcagcctagggttagcgtgggaagaccctccgcggtctttggcgttttggaaagatacccacacattcccgggaaaacatggtgagtttctgccggagcccccggcagcgggtgtcagggcggcgcaggggcggggttgtttgtttctggcttctatggcgttggagccactgggcggggttcgccctcactgaacctcttctgtcaggagctgactgaaaaaaaaacaaaaaaacctttcatcattgcggaactgtaggctccaaaagggttttcttcactattataagttagatgacttttttttttcttgagcaaaatcataattcacttcacaagctctttaatgtctggtctggggacgccctgccctgaccgactgaagtgtgtgtgtgtgtgtgtgtgtgtgtgtgtgtgtgtgtctgtgggacgccctgccctgaccgactgaagtgtgtgtgtgtgtgtgtgtgtgtctgtctgtctgtctggactgcacgttcagcgagggagaaagcccactttgtgagccccagggtaccctgatggtcaggacccagggaaacgcccttccccgccgcccccccgccccgcccccaccacatcagcgaatagacaatgaaagtggtagccctaaagaccacagagaagaaaacctctattggatgcaaagaatatgaatattatgtgatgggtagagaatctcaggatgaaaatactattttgttgttttaaataaatatttcattatccttccactgggcttttattctttgtttggtaccttttcatgtgatgcttgtttctaacttaggaacttttgtgtgtgtgtgtgttaagatacggataatttttcagcttttacagtggagaagatctggaaaaacctttttttttaaaaaaaaaagtaatgaaattgctacagacaaagaagaattatactccgcatcccgttgtcttttgttccagtgcatcttaattaattcatttcaattcaggcacatggtcccgggcggggtcagaggaggaaaactggcaaaacagcacaatgagatcatgtaggcagctgctggaaatagagcttgctctgttaaataatgtagcagacagtacaggctagcaccaggcacagcaaatacagcaatgcagcaatgcagaaggcagaccttgtctaaactcctagtattgatggattctgcagacagactgcagaagggtgtggcttcttgcctcagctgcagtacagatgtccggattataatatcaagtcctattcagaggaaactttcatctttatttaaaagggaagaaagcagtaaaattaatcccaattaagtcataattggatttacttcattttacaaaatttgtgctttgaatactgaatactttttaaatatgaaaaatcttctattcaagcatggtagtaggcacaatgggctggtaccacgtgctgaacagggccaaggcgacatcattattcagaccacacccatatgcagcatttgtagcaggtgattttccttaatcttttatcgtgctggggatatgacctcaaataatttagaaaaatatctgtatattattagaaatatttttgaaatttcctataagtttgaaatgctaatacaccttaattttacgattttttcacttttcctccccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattggtgagttgacctcagtaacccaagtgagatcccagggtgctgggacaggaggtctgtcctggggggctccgctggtcactcacccactctccctccccgctcctcgtccctcctcctcctcccccctgctcctcccccatcatgttctccagatgaagttcgcactggcacctaccgccagctcttccaccctgagcaacttatcacaggcaaggaagatgctgccaataactatgcccgagggcactacaccattggcaaggagatcattgacctcgtgttggaccgaattcgcaagctggtatgtttcttttcaagaataaagtaaattaatgagcctaaagaacacatttgaaataatgctttttttttcaaacacagaattgaactgttattttaataaagagtggaatgagtcattcttttggggtttttaaaattcagttaaaatgaactatttgatgtcattttgtaaatgttaatgagaattttttaaaaagcatttgtcaaaataagatctaagtcctggaagatgtatgaaaagtgaaaatatatttactatgattgtactacaaagaataaaaacttaacctttcctctgttcctctcttttgttataggccgaccagtgcacgggtctccagggcttcttggttttccacagctttggtgggggaactggttctgggttcacctccctgctcatggaacgtctctcagttgattatggcaagaagtccaagctggagttctctatttacccggcgccccaggtttccacagctgtagttgagccctacaactccatcctcaccacccacaccaccctggagcactctgattgtgccttcatggtagacaatgaggccatctatgacatctgtcgtagaaacctcgatattgagcgtccaacctatactaacctgaataggttaataggtcaaattgtgtcctccatcactgcttccctgagatttgatggagccctgaatgttgacctgacagaattccagaccaacctggtgccctatccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaagaccaagcgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaagttaaaacgtcacaaaggtgctgcttttacagggaagcttattctgttttaaacattgaaaagttgtggtctgatcagttaatttgtatgtagcagtgtatgctctcatatacaattactgacctatgctctaaaacatgaatgctttgttacagacccaagctgtccatttctgtgatgggttttgaataaagtattccctgtcttaaatgaattcagtcctgtgttttctatctgggtgtctgaagtttttcatgtatttagtgcattgagaataaaaaataagtgttgcctgtggtttatacatatcctaggaagtgacgtttgtatttaaagtatcttagtaatttaaaacttttatttatgaaacacaaaatgtatatctaaagattaccattacagagcatcatgtactttttttttttttttttttttttgtgagatggagtcttgttctgttgcccaggctggagtgcagtggtacgatctgggctcactgcaacctcaacctcctgggttcaagagcttctcctgcctcagcctcccaagtagctaggattacaggcatccaccaccacacctgactaatttttgtatttttagtggagactgggtttcaccatgatggtcaggctggtctcagactcctgacctccagtgatccgcttgcctcggcctccctaagtgctgggattacaggcgtgaaccactgtgcccggctcatactattaagtttttacctcattattataataaagttatttaaactgccagtactttttagagttgaaagttggtaacacatagccaaaatctggttggctgctgaatcttatgtaactaacataaaatggtgaatattccaaatgcatcagtttttcatgtgccctccgctccttggtatgtgtctagtgccattatgcctcttctgcccagggttcccaaaacaaatctcctctcaaagcaagcagccctatgctagacttagttctttaccttctttccaaacctattttaagctgaatgtcatgttggaaaagcctgatacatttattcactctaatgtgttaattagatatctgaaagttaattctccaagttaatgtgggccaataacttcaaataataaagccctaatagtgcaattgcatgcattagcaccaatacaaaaaatgttttggacttacgatttgtccaacaatagagctctgctccagaccaactgaccaaaagtgtctattcccaagttcagtaaattgtcttcctactctcacattttctggttctgggatacatattagttcattttcacgctgctatgaagaaatacctgagactgggcggggcacagtggctcatgcctataatcccagcactttgggaggccggggcgggcagatcacaaggtcaggagatcgagaccatcctggttaacacggtgaaaccctgtctctactaaaaatgcaaaaattagccaggcgtggtgacacacgcctgtaatcccagctactcagagagaattacttgaacccaggaggtggaggttgcagtgaaccgagatcgcaccattgcagtccagcttgagcaaaactccatctcaaaaaaagaaatacatcaagatgggctgggtgcggtgcctcacgcctgtagtcccagcactttgggaggctgaggtgggaggatcatttgaggtcaggagttcgagactagcctctccaacatggtgaaacaccatctctactaaaaaatacaaaaattagctgggtgtggtggcggacacctgtaatcccagctgctcgggaggctgaggtgacagaatcgcttgaacccgggtggtggaggttgcaatgagccaagatcacgccactgcactccagcctgggtgacagagcaagactccatctcaaaaaaaaaaactatgttataatgggaaatgttattttatatatatatatatacacatatatatatatatttttttgagacaggtcaacactctgtcacccaggttggagtgcagtggtgcgatctcagctcactgcaacgtcaggctcaagcgatccacctcagcctcccaagtagctgggaccacgccaccatgcccagctaatgtttttctgtattttgtagaggcagggtctcactatgttgcccaggctcgtctccaactcctggactcaagcgatcctcctgcctcaacctccaaagtgctaggatg

SEQ ID NO: 14216 - DNA, 7626 bp, Human
agaacctaaaaaaacaagccctcaaatacttccccattcacaacaggggaatacacagacagataaaagctaatagttttaggaaggtatctggggagacatataggcccacgggagcaaatccctgcagtggcggctctgataatctgcagagagctagaagggaggttctcccctcccccagaaaaatctatcccaaaaccataaactacatcgccaatccttggaaatacataaggtggttagggttaaagggtggcttcaaaatggttctagcagaaacctattgcggttactgaactattcaaaatatttgtccagagatagcttttctggataaaatagctttattcagagccgacagcaaaatggagttcagcagggtggttccctaacattcattcttcccgttaaagcaagctaattattttcagattcgttttaggaataagagtgggggtggtccaatggtagtgggttatcagaacttattaacattagtatcactaaaattgatatgcaacccccactgctaaaattgacaggcttaatttttttttaaagaataagaagagggacaaaataagtgagaacaatattcaaatatattcctgcctcctctatccagttggaaaaatgtatgcaaatttggattttgaatcaaatgcctttaacaagactaccaaaactatcggaaataaacaagaacctcttggtttgcaggtcaggttcagatgggtggagacacacatatatagatatatataactccttacaaaatacacttataaaccatatagatttgttatttgtctaaaatgaaggatgaaggctgtaccaaatcttcataggctaataactgaatatgaactatgaatttttagtgttttaggtttaacctttttcttcctcgtatactgggcagatattctgaatagtaacatcaatacgtttctgttaggaccattttaaagccacattttaaacctaaccaccttctgcatttccaaggattagcaatgtggtttatggtcttgaaatagattttccaggggcggggcggagggagaactagtctactcctataatgtgggcctccaagcactaagctataaccaattgatgtatcttgacacaaggccaagccgtcttatttacaaaactcttaagttgcacaaggaatccctacttcctaacatccttcagtgtcaaactatttcctccctatccaagtctttcctcacttcttcaactcagctaccacctctgaaatgtgtttttaaatctccttttcaaaaagcccttaggactgttccataaagttgatggcttagatctaaaattggggcctactttgcccttttaacagcttcaatgttaaatgcttgggcactactcttcgaatgactgaaatactatttgcttccagcgtttggtactcttactttggagaacaagtcattacagtaaaccatgtacacctattcggttttctaaagctcgcgtttttcacattatcaggtaagtaccgaatgcactgcctttaaaggaactgagaaaataaaaaggcaaaactcactgacaaactgtggcaacatgaaattaatcagctgagctatccgaaccacaactttctgcatttcacggtgcttcgtctttcaaattgtatggctctctcaagtcctgggtttcctccgaattaaggcaagcctcgtcgcccattccctggtcggtgtctttccgactcgcgcccgcccctcggcaggccctcgcagccatgcgccgcacactgcagtactggcgcgcgttgcccgcaggcgcggcagaccccaccccgcggccgcgcgaggggagggggctcggggctcggagcccgcctctgcggcggccaggccgggcgcggagtgggcgcgcggggccggaggaggggccagcgaccgcggcaccgcctgtgcccgcccgcccctccgcagccgctacttaagaggctccagcgccggccccgccctagtgcgttacttacctcgactcttagcttgtcggggacggtaaccgggacccggtgtctgctcctgtcgccttcgcctcctaatccctagccactatggtgagtaagccgtgcggctcccggctgctttcagggaagcagggaaaagcgagccgggcggggcgctggggccctgtatacagccgggaagggctggcctcagagccgtccgtttggagggcggaaaacgaggcgagaggccagggcgggagtggtgagacctcggtgtgtgtaaatagcgggggcccggaaaggtcgaggggcgccaggatttcttctcggactctggaagggatggggggctcgggctgccctccgccgtatccggagctctcttttgtcgcgtaactgtgtcctgggtgcggtccctcgagtccccgcagtcctttccagcgcatgcccttactccgccttgggtggacgcgcgcgcggactcttccagccctcacttcctcttgagcgcgaaaagcgggggtgggaagcagctggagacaaaagcgcgcacgcgcgaccgttaccttcccgccgctcctgggcgggaaaccgccactgcgctttgcgcatgcgctctgggtcgcgacgcgactagggctacagggcgtgtctcctgttaacctgagtgttctttttttgatgaaagcaataagaggactgcggaagagctccctgtcaatgtaccgctctacaccagtgtattacgacagttcgtacacaacagtctgtagaggccacctgtctctccctgctgcgttaggaattcaggggagcaggtggtggcagtaagggattttgagggaacggaaatcggatcttgacccagatctgggccgccgataatctcctactgcgctcagactgctgtggaggtgttaggctgagcccgatgccggcaggcaagggaggatgggcggcttgggcagcgcctttgcagacgtggccatttcgtgcctctgcagcaccgccggggggcgcaagagcgcgcgcccggaattgctcattcatcctgtgccgcagagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaaggtaacattcattaaaagcaacgtagactatagtgtagctgttctcaaaagtagtacatcttagaaaaggatctttagaaaagatcgctttagaaaaggaaattcgttttcagattacgtgagtagcctaggtaacacagccagacctcatctccacaaaaaaaatgaaaaaattagccagcttggtggtctgtgcctgtggtcccagctgctccagaggctgaggtggggggatgactggagcctaggctgcagtgagcctagatggcatcactgcactcaagcctgggcgacagaccttatctctaaaaaaataaagattgcatgagtattttgttccacttgacagtcatcaatagattggtttaaattgtgatatcttttttccttcccgcagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattggtgagttgacctcagtaacctgagatcccaggatgctgggacaggaggtctgtccaggggcttctcttgtcactcactcactccctccgtccttctctccctcctccagatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggtaagcaccacatataaatatgcatttaatgtggtgtgatagttccagtgcaagttgggtggagtgactgacatcattcattctttggcacctaccaaaatgtggaataggctgcttgctatattaattggacttctaaatcagatagtccctaggttatggacagtttgtggatatgtctgttttgccaattccttgtgcttacatcagtgagatatggttcgtaatctaaaaagttgaaatagaaattctaagataatgtgtcctggcattaaaatattacatttttttattcccctacaggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaagctttgtttcctgcgtttttttctaaaagtgccttggtttttagattcatctatacttggagtatagagagtctggtgtcaaggatcccacttactgtgcaggcacctctagggaaaagggagctcaacagactagaaaggcaggagccctagattctcagactagtttaccacctcaacgcttgcatagggggtggggaaagtcattctgctaatctaaagctcatttagctcttcagagtaagactgggtagttactaatgagtaatgtataggaagtgtaagttttgaatatccactgagatgctgctgtttaaagtggcctgctaacttgttagtgtaattaagaaatttccaagtgatctttggctggtcatggtggctcacacctctgatcccaggcattcaagaccagcctgggagacatgatgaaactccatctacaaaaaaaaatttgggtgtggtggtgtgagcctataagcccagctacttgagaggctgacaagattgaggctgtggtgagctgtgattgtaccactgcactccagccttggtgacagatcctgtcaaaacagtgacctgggaaaaacatctgactaggaatatttgagggtggtgaggtaaaggctgtttccagccctattgtgataggaaaaaggaccagaactcatggtggtcaataaaagtcatgctaggtaagaaggctaaacaataagccatatgcattggtgggagaggactgcattacatgaggataaagcggcaactttggaaagtttaggataaaagtttataatttatagcatttggcatggtttacatcctttcaagtattttggctacatgtaacagacttgtaggcacagagaatgtaaatagaggatttaacctaggagaaaacgtagatttcaaatccggaaagcacaggaaaattatggctgctgaagaccttgatgtcttcttggttcaagactgaaagaatacatgaggcatttttttaaaaagaagaggccaggcgcagtggctcatgcctgtaatcccaacgctttgggaggcttgaggcgggtggatcacctgaggtcaggagtttgagaccagcctggccaacatggagaaactccatctctactaaaaatacaaaattagccggacatggtggcgcatgcctgtaatcccagctactcaggaggctgaggcagaattgcttgaaccttgggtcaggtgtggtggctcacgcctgtaatcccaagcactttgggaggctgaggcgggcagatcacggggttaggagatccagaccatcctggctaacacggtgaaaccccgtctctactaaaaatacaaaaaattagctgggtgtggtggtgggcgcctgtagtcccagctactcgggaggctgaggcaggagaatggcatgaacctgggaggcggagcttgcagtgagcagaaatcgcgccactgcactccagcctgggcgacagagcaagacgccatctcaaaaaaaaagcaaaaacagaattgcttgaacccagcaggcggaggttgcagtgagccgaggttgcgccattgcactccagcctgggcaacaagagcaaaacttcatctcaaaaaaaaaaaaagtagggaagtctacaattttcccagttttttgttttttgtttttttagcccataaatcctataaatttacaaaatgtagtcagccctccctatctgtgggttccatatctagatttgactaactggattgaaaatacttggaagcaaccggccatagtggttcatgcctataataccagcactttggtcaaggcgggaggatcacttgagcccaggagtttgagaccagcctaggcaacctagggagaccctgtcattacaaaactaaaacaaaaacaaattagccagtgtaattgtgctgctgcattcctgtctgggtgccagagaaagaccctatctcaaaatatatatttggaaaaatggatagttgtgtctgaactgaa

SEQ ID NO: 14217 - DNA, 12616 bp, Human
gtgatgtgtgcatacgaggtaatgtgtatcaagctcttagcaatagtggttggtatacagtcaatacttattatcacagtcattattaatactttaaagaatacatttatctagtggcctagggaaatacttcttaaattgccttaaacgggattagatgcccctttggtctgggtttgtacccaaacccaggcctaggtttgaactaaattgaatttctcggtttggtggcattgtgggggtggggagatggaagtgggtgtagcagagtaggaggcaatggtgcaaggtgttgtagccataggaatatgaatttccatgtcagcatttggtttaatttggcaccgagtgttattcaaacaaagcagcgttgtgagtggtagaggaagggagaggaggaaagtcaacacattcttggaaataagatgtggcttttgctttgctattttgttttttcttcagctacagacatatttctttgctcttgggctcacactgtaaatccctttcagtacatatctaagtttcagagaaacttctctttaagatgacaagaagttatcaagacttcccttgatccttgtttttagtataagaacccttcagttggggtcatttagcctagggagaaatctttgcatatacttagacacccccctccaccatgttgaatatttggtatttcctaacgactttacctcaaagtgtttgaaggtgtatgtagatgtatcgtttatccattctctccatgtatttgtgtattaggcctttcaaattttagtaaaaattttagtataaagcctggcaatgcaataattaattttccaacagttgctgccttgcacctcagacgtctggcaagatgttataggaactggtcctaggtcaatattcgaagcacagggaagctctgtgtgaccaagtcaatggaactttcctgtgttctggtcctgaggtgtatgtttaaagcaacgtttcaagcagaaaagtttgagtattcatctctcctccacaaatgcaggtctttttgcaatggcaatagagtaaatagccacttgtgatattaagcttgtgtcaatgatgaagggttggattgcatagggaactgatacagccttctaaccccgttcctctagagataacacaaactcacttaacactcagtctctgccttcaaagagctgacgctttagttgagaaatcagaccttaacgcacctcctgtgttgtaacaacatagaccaatatattcacaatatataacattaggttttaatctctctgtaatcagctgggttttgatgggaaaaaccaggtggctggaatgtacagtgcctttctgttttaacatttaagaggaggtcacactcaccagggatttttccattgcactctctctttttaaaagtttacagcgaatagctgaacttacatttcactattatgtaaaaatactttccctcaactttccaattacttaggggataaaaaaggagaggaatactggggttttgcaaagtcctgcaggtaaattctaaagtcattattatctttaatacctagcttagaaattctttcaacaagtggtgattattttcctccattcacatctccccttcctaacccataaaacaatgttcacaaattgaaaagcacacaagtgagaaaaaaatcagcctaattccaccagaggtaaatttcactgttcctttcagtttttgtctaagcacacgtgactgtatgtattgctttgcaatccgctttctttttgcaaatatatttcttgtgggtattttcccatgtattttcttaggtcgcttttaacctcttcattcttttccttctctctagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagattgtactccacagagagatgcagacaaagtaaacaatgaagtaaggtgccttttaaaattttctatttggcaatatttgaagacttaactgaatgcaaaattgacccagtttttaattttttttttgagatagagtcttgctctgtcgcccaggctggagtgcagtggcgcgttctcggctcactgcaagctccgccttccaggttcacgccattctcctgcctcagcctctcgagtagctggaactacaggtgcccaccaccacgcctggctaattttttgtattttttagtagagacggggtttcactgtgttagccaggatggtctcaatctcctgaccttgtgatccacctgacttggcctcccaaagtgctgggattacaggcgtgagccactgcacctggccagtttttaatttttaaatataagctgaaatagatagggcgggtaagaattgagttcagacggccagcaagtaacacttttttgtttatttattatttagtatttttttttaaagacagtgtctctctctgtcacccagtctgaagtacagtgttgtgatcatagctcactggagccttgaactcctgggttcaagtgaagtaacacttttaaatatataatccagaaggtggaaataattgggaataattatttgttctgttgagaacatatggaagagaatagatttcaataaaatgacaatcaaaggctatgatacatacatctttctgcagaggtatatgatcaaagtatttattaccataaatatatctttctgcagagttatatgatcgaagtatttattaccataaagaaaagcacaggctgcttgtgctgtatttaatctttgtttttttcctcccattagggttgttttataaaggtgatgaccattatagagtcagaaatgggagtcgttgcaggaatttcctttggagttgcttgcttccaagtaagtttttgtagttacttaggaaatatttcatccctcttgtaggtgtaagctagaagattttcacttttttttttttgagatggagtcttgctcggttgccaggctggaatgcagtggcgtcatctcagctccctgcaacctccacttcctgggttcaagcgattctcccacctcagcctcctgagtagctagaattacaggtgtgcgccaccatgcctggctaatttttttgtatttttagtagagttggggtttcaccatgttggccaggctgatcttgaacacctgacctcaagtgatccgccctcctcggcctcccaaagtgctgggattacaggcgtgagccactgcatgcagcgagattttcacttttaaggcttataagtttttgcttcaggggactggatagtgaggacatttttagggaagtcgcattttcacaaaactctcagttactggtcacagtataaaaatactttatttaggagaaatacctaatgtagatgatgggttgatgggtgcagcaaaccaccatggcacgtgtatacctatgtaacctgcacgttctgcacatgtatcccagaacttaaagtataattaaaaaaaagaagaaaaaaagtaagatttagaattaacttgtagcagtgcatatcttttgaaagcagttaactgtggaaagactcagtgccctcttagttatggcaactttccagtatcatagctcatgaaacaaaacattagataggaaccttggttctctctgcggtcagtcaagattctaaaatgttattaggatcttttctgggctgcaactgcctgatgagttgtatacaagttccaacctattaaaatttagatgatgccacccccacattccttatgcaccagttgtttggggttgattccacgttgtagatcaaattgtgtttcccaagttgtgtttcccactgtagcatgaagtttgttttgtggctctgaacgtttttttttatattaaacactagaaataagactaattcaagtttcgtcttaatatatttttaaagtagtaagcaaagctatatctaaatctatgctaatgcagtagccactagccacctttgaattgttataaattattaaataaaattaaaacctcagtttgctggagatttgaaatacttagtagccatgtggctgctgcctactatatcggacagtacagggattctagaacattttcattattgtagcattgctgtggatctttccagggaaatctctgccctcgttgatggagatttcacttgttaagatacttattgaaaaccatgtatttgttttttctgggaaatgagagtaagaaaagtttcttcaaaactcgtgactgaattttccttgagtgagtttgctggattttcctttggtgagagttgtgaaattctgggtcacagtggcaataaaacttcacttagattctttgaatgtgatctagatgctgcagagtattaaacataactctagaaaaactcaaggacgaaaattataagcgaattacaagtgagaggagaatatagtctgaggtgttcaagttcttttgtgtatgtatttaattttgttcctattttatttctagctgattggaatctttctcgcctactgcctctctcgtgccataacaaataaccagtatgagatagtgtaacccaatgtatctgtgggcctattcctctctacctttaaggtgcgttcattttggtcctcagctctgttagtgttgatatttattctagcctgtgtatgtgatgcatggactaagtttgccaagaacgtcttgtctagtaatatatttaaatctagctggtgctatgtaaaccctgtgtaggcaggttaggtctctatacacagggcatggtcagaaagtaatgacttagctacagcttatctatgcatgctctctacagttatgcaacagaagactccccgtgtgggtttatatatttacatacacatgtcagcctaaagatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagttgaagtcagggaattatttctttggttttgagtctctttatacatccattagtagaacctgtctagtctgattgccacagtccttgaattgatggtaagggggagtcagttacagttagaaaaaaacctgggcaaaaactactagttaaatgatcatgaattttgagtatgtgttttaaaatgcttggagttattgcagaaaaatgatattctccattagaacatttgatgtgtgacttttgacataggataaggtgataagaaaattaagttgaaaaatagtgactcaagtacagcaaatcagatttttggctactgagattaaagaagcaaatatttaaaggattatcagcaattttcaaatacatatttttcactgcagtggttttgaagaatgttttaaggttatatttagagtttttaaaaaagttttccctcagccagccatggtggctcacatctgtaatcccagcactttgagaggctgaggcgggcggatcacctgaggtcaggagttctagaccagcctggccaacatggtaaaacaccgtctctaataaaaatgcaaaaattagctgggtgtggtggcaagcacctgtaatcccagctacttgggagactgaggcaggagaatcacttgaatccaggagtcagaggttgcagtgagccgagatcacaccactgcactccagcctgggcgataagagtgaacctgcatctcagaaaaaaaaaaaaagttttccctcattattaaaaaggaaaaattatagaaaattaaaatatagaatgtagaaagaggaaaaacaccacacatcactcgtcaggtggattggtttgtttatttttaagatgggtttattttggatagccagttagaaaacgcccttatagctgatgtgtgcttgtgcatactgaattgtatacttaattctgaaagtaatgaggaaacatttcacctaatgataactggtacaaaggaaagttcacgtgtctttaatagtttgctaattagactagctggttagaaagagggatcactagattggagagagagatccagtttccactggaggcagtaggtctgctcatttccatggtgacaatcctaatggcagagggagtgagtttcccttagtggcacaggctgggggttttgagcttttaagttttgttttatagaaatctggagaattttacattttacttcactatatatctatgtttaaaataattcatttttgatgtcccaaaattgatgtgggttgccttatttccaggcaccaggttgctcactgcaaggtgacattttgagaagcagaaatctctaggtatatcttaagtgtgaaaagcttgttagatttccatggcctattccaggtgggttgttgggtttatgttgtaagcatcaaacttttgtggaaataaatacctaatacaaggtataaataccatttctggttttcctcagagctcacaaaagaatctttgagacttgatgttttcaacctcctgtcagaatccaagttggtgatgcacccaaacaaacctgttaaaatatgagacacagagccgggcgcggtggctcacacctgtaatcccagcactttgggaggctgaggcaggtggatcacgaggtcaggagatcgagaccatcctggctaatacggtgaaaccccgtctctactaaaaatacaaaaaaattagccaggtatggtggcgggcgcctgtagtcccagctactcaggaggctgaggcaggagaatggcgtgaacccgggaggcggagtttgcagtgagccgagatcgcgccactgcactcccgcctgggtgacagagcaagactccgtctcaaaaaaataaaataaaataaaataaaaaagagacacaaagcaatatatgcattttctcatgaaacagtaaactttggttcctttggactattctgtgagggtttttgtttgtgtttgcaggaaaaaaaattaacctaagatattaatgccatttctacttttcctcacagcatatataagataatttgagatttgatttttttttaagtttgctacttttctaggttgaaactttgtgatgcggcaaaccaaaccttactaatttaaaaaggaaaacaaaaggctaatgtgtcagaaatgaatatataaactgaaacagctatagggaaataagactttcatttttaagtcatcgctttaaa

SEQ ID NO: 14218 - DNA, 12139 bp, Human
tttgctcttgggctcacactgtaaatccctttcagtacatatctaagtttcagagaaacttctctttaagatgacaagaagttatcaagacttcccttgatccttgtttttagtataagaacccttcagttggggtcatttagcctagggagaaatctttgcatatacttagacacccccctccaccatgttgaatatttggtatttcctaacgactttacctcaaagtgtttgaaggtgtatgtagatgtatcgtttatccattctctccatgtatttgtgtattaggcctttcaaattttagtaaaaattttagtataaagcctggcaatgcaataattaattttccaacagttgctgccttgcacctcagacgtctggcaagatgttataggaactggtcctaggtcaatattcgaagcacagggaagctctgtgtgaccaagtcaatggaactttcctgtgttctggtcctgaggtgtatgtttaaagcaacgtttcaagcagaaaagtttgagtattcatctctcctccacaaatgcaggtctttttgcaatggcaatagagtaaatagccacttgtgatattaagcttgtgtcaatgatgaagggttggattgcatagggaactgatacagccttctaaccccgttcctctagagataacacaaactcacttaacactcagtctctgccttcaaagagctgacgctttagttgagaaatcagaccttaacgcacctcctgtgttgtaacaacatagaccaatatattcacaatatataacattaggttttaatctctctgtaatcagctgggttttgatgggaaaaaccaggtggctggaatgtacagtgcctttctgttttaacatttaagaggaggtcacactcaccagggatttttccattgcactctctctttttaaaagtttacagcgaatagctgaacttacatttcactattatgtaaaaatactttccctcaactttccaattacttaggggataaaaaaggagaggaatactggggttttgcaaagtcctgcaggtaaattctaaagtcattattatctttaatacctagcttagaaattctttcaacaagtggtgattattttcctccattcacatctccccttcctaacccataaaacaatgttcacaaattgaaaagcacacaagtgagaaaaaaatcagcctaattccaccagaggtaaatttcactgttcctttcagtttttgtctaagcacacgtgactgtatgtattgctttgcaatccgctttctttttgcaaatatatttcttgtgggtattttcccatgtattttcttaggtcgcttttaacctcttcattcttttccttctctctagggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctgggtgagagacgaaggcgcctggggccggcaggggatcccgggcttttagttgtggggggtgtgaccctgagcggcgggagctcaggtcgggaacggtgtggggtttgggcggccatcgcgcctgggaccccgacgccggcgaccagtgactgggccccgaacaaagagctcaggcatctcgccggcgctggggtcggagtgcgggacgaaggcagccgagaggctgagctgggacccagacgtaccagcgttcgagttcgatacgggaggcgaggtggggccttaagcccccagagcacgcagacggtgaccctggacctttgcaaaggcaagcaaggcttgcccggcccctttgagggctcacttgcataatagtgtctttcttttcactgcttcgtaagagaggagtgtttcgcaggtaagtatggtatgcctccactcccgccagtctatccttgggcttgcttttgtgtaccagtcctttgtaccctgtgcccatccctacctggagaggacgggggaagtttctggaactcataaaatcacgttttttttttccccttcaaggttttcttcctaaggttggagtaagatagttaaggaagttttgatccctagggcaaatatgccatgggcttgtgtttacacacaaaaagatgaattttaagaattttgataagatacctggtccacagcctgctcttgtgtgcagatccccccctaaccccttctactcttcccccttgtctgccgtatcccagcatattacacctattgtgccttaaatacctcatgcgttgtgatttgaagatgctgctgtacacagtgcgtaactgtttgtattctctgaattcccacatagatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactggtgagtccttgttttcattagaattgattcttggttttagaaaagttttgtatgttatagaattcctttgttggaactggccatggccctttacaatttttcctgttccttatggaaacttatcaagtaacagttcagctgccagtttccactttcaaaatagacatgttgttattttccctgcccttttcaatgaaaacatgatgaactaattgagaagacgaccattattttttctttgactccctttgcagttgtgctatatcttatttatgctgacttggactttctttcttatcctgcagtatgcaatgtttctgactctcgtttttttggtcgaactggtcgctgccatcgtaggatttgttttcagacatgaggtaagcctgaattagggaagcttagcatgttacatttatcctctgagagataaaaatggatttattaaagtagaagagtcagacctctgtatttaaacctgtagctgacaataatggccttcttgtaaaaattctggtccacttctaatttaaaagaaaatttagaaaattgtaaagactgatagtcaccagaagaaaattacttacttatattccctgtcgtttttctgtgtataaatacctattaaaacggagatagtacaatttataactttgctgataggaaaatattcaaagcacaaaattgataaccttcttatgccttgcattttgaaaagattggatatacttaatgcaaatcatcagaagtttaatattgggccgggcgcgttggctcacgcctgtaatcccagcactttgggaggccgaggcaggtggatcacgaggtcaggggatcgagaccaccctggctaacacggtgaaactgtctctactaaaaatacaaaaaaaaacaaaaaattagccgggcgtggtggtaggtgcctgtagtcccagctgctcgggaggctgaggcaggagaatggcatgaacccgggagatggagcttgcagtgagccgagatcgcgccactgcactgcagcctgggcagcagagcgagactccatctcaaaaaaaaaaagcttaatactgaattagaaaacaggtaaacttggggttgttcaaataacattcggtgagtagcaaaggctcattaatgagagttctcataaagtggtagcacagcctcccaaagtaaggttttgtagcttacaaattccataggcatcgaatttgaactcagtttaaagtggagaaaaattagcagggtgcagaatacagcaatactgcattgccactcagataaatacatattcccacagcactttgaacttgtagtggttctcatcatatattttaatgttttgcttagtagtcccctcagctaacctataccccttagaggacaggactgtaccatggaagttaattactatacatgttgctgctgtcaaagatatgaccattggtcagattcgagaacttatttgacctgaaaccaaaaactttctagaggattttcttactgacattgtgtttctttgctatagattaagaacagctttaagaataattatgagaaggctttgaagcagtataactctacaggagattatagaagccatgcagtagacaagatccaaaatacggtaagtggtaaccaccacctagaggggaacacattccctgttgcctcagagaaaagagcagagtctggctactagatgttatccacctgtaggggaaagaagtgtgacgtgtttcattttcctcacatgtgcacctgttctcttccttccccacttacatcatagtccaggtacagttagtaccaactatagcaggaaagtaaggccaatacaaaactgtcatgcatggtgctaatcagggacccagtgctcatctcttgaatcaattgaggagagagatcattgagattagtaaatgttttgagcacaaattgcaatagaggatattaggttaaatgtttgactacaaagttgtaatataaactgtaaatgcttttgttgggtttttcagttgcattgttgtggtgtcaccgattatagagattggacagatactaattattactcagaaaaaggatttcctaagagttgctgtaaacttgaagattgtactccacagagagatgcagacaaagtaaacaatgaagtaaggtgccttttaaaattttctatttggcaatatttgaagacttaactgaatgcaaaattgacccagtttttaattttttttttgagatagagtcttgctctgtcgcccaggctggagtgcagtggcgcgttctcggctcactgcaagctccgccttccaggttcacgccattctcctgcctcagcctctcgagtagctggaactacaggtgcccaccaccacgcctggctaattttttgtattttttagtagagacggggtttcactgtgttagccaggatggtctcaatctcctgaccttgtgatccacctgacttggcctcccaaagtgctgggattacaggcgtgagccactgcacctggccagtttttaatttttaaatataagctgaaatagatagggcgggtaagaattgagttcagacggccagcaagtaacacttttttgtttatttattatttagtatttttttttaaagacagtgtctctctctgtcacccagtctgaagtacagtgttgtgatcatagctcactggagccttgaactcctgggttcaagtgaagtaacacttttaaatatataatccagaaggtggaaataattgggaataattatttgttctgttgagaacatatggaagagaatagatttcaataaaatgacaatcaaaggctatgatacatacatctttctgcagaggtatatgatcaaagtatttattaccataaatatatctttctgcagagttatatgatcgaagtatttattaccataaagaaaagcacaggctgcttgtgctgtatttaatctttgtttttttcctcccattagggttgttttataaaggtgatgaccattatagagtcagaaatgggagtcgttgcaggaatttcctttggagttgcttgcttccaagtaagtttttgtagttacttaggaaatatttcatccctcttgtaggtgtaagctagaagattttcacttttttttttttgagatggagtcttgctcggttgccaggctggaatgcagtggcgtcatctcagctccctgcaacctccacttcctgggttcaagcgattctcccacctcagcctcctgagtagctagaattacaggtgtgcgccaccatgcctggctaatttttttgtatttttagtagagttggggtttcaccatgttggccaggctgatcttgaacacctgacctcaagtgatccgccctcctcggcctcccaaagtgctgggattacaggcgtgagccactgcatgcagcgagattttcacttttaaggcttataagtttttgcttcaggggactggatagtgaggacatttttagggaagtcgcattttcacaaaactctcagttactggtcacagtataaaaatactttatttaggagaaatacctaatgtagatgatgggttgatgggtgcagcaaaccaccatggcacgtgtatacctatgtaacctgcacgttctgcacatgtatcccagaacttaaagtataattaaaaaaaagaagaaaaaaagtaagatttagaattaacttgtagcagtgcatatcttttgaaagcagttaactgtggaaagactcagtgccctcttagttatggcaactttccagtatcatagctcatgaaacaaaacattagataggaaccttggttctctctgcggtcagtcaagattctaaaatgttattaggatcttttctgggctgcaactgcctgatgagttgtatacaagttccaacctattaaaatttagatgatgccacccccacattccttatgcaccagttgtttggggttgattccacgttgtagatcaaattgtgtttcccaagttgtgtttcccactgtagcatgaagtttgttttgtggctctgaacgtttttttttatattaaacactagaaataagactaattcaagtttcgtcttaatatatttttaaagtagtaagcaaagctatatctaaatctatgctaatgcagtagccactagccacctttgaattgttataaattattaaataaaattaaaacctcagtttgctggagatttgaaatacttagtagccatgtggctgctgcctactatatcggacagtacagggattctagaacattttcattattgtagcattgctgtggatctttccagggaaatctctgccctcgttgatggagatttcacttgttaagatacttattgaaaaccatgtatttgttttttctgggaaatgagagtaagaaaagtttcttcaaaactcgtgactgaattttccttgagtgagtttgctggattttcctttggtgagagttgtgaaattctgggtcacagtggcaataaaacttcacttagattctttgaatgtgatctagatgctgcagagtattaaacataactctagaaaaactcaaggacgaaaattataagcgaattacaagtgagaggagaatatagtctgaggtgttcaagttcttttgtgtatgtatttaattttgttcctattttatttctagctgattggaatctttctcgcctactgcctctctcgtgccataacaaataaccagtatgagatagtgtaacccaatgtatctgtgggcctattcctctctacctttaaggtgcgttcattttggtcctcagctctgttagtgttgatatttattctagcctgtgtatgtgatgcatggactaagtttgccaagaacgtcttgtctagtaatatatttaaatctagctggtgctatgtaaaccctgtgtaggcaggttaggtctctatacacagggcatggtcagaaagtaatgacttagctacagcttatctatgcatgctctctacagttatgcaacagaagactccccgtgtgggtttatatatttacatacacatgtcagcctaaagatcataagtggtcccttttttaacatgttttggcctggagagaggagaaacaaagaatcccaagaatgaccttattcgtgaggttccctggcaggtgcactctgctcctcaccaatattgacattttccttagtccttttcgtagttttcatttaccacaatcttaatcagttgttgagagtgtggctttcttggtaaaaagatgtttttggtgggcttttgttaaaaccgtaaactcatctggtctaataaggaaccagattttgggaagacatgtgtttcaatggcgttagtatttgactggtaaaatactgtgagaactgttgttggctgaattgatccctagggcacactttgcattttacttgagccactgactaggaacacataggaaggtcttcattagcaggaatagattagaatgtatgtaagcaaatacagatgttgaaatttgggtaacaagtacattaactttttttctttaattttaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagttgaagtcagggaattatttctttggttttgagtctctttatacatccattagtagaacctgtctagtctgattgccacagtccttgaattgatggtaagggggagtcagttacagttagaaaaaaacctgggcaaaaactactagttaaatgatcatgaattttgagtatgtgttttaaaatgcttggagttattgcagaaaaatgatattctccattagaacatttgatgtgtgacttttgacataggataaggtgataagaaaattaagttgaaaaatagtgactcaagtacagcaaatcagatttttggctactgagattaaagaagcaaatatttaaaggattatcagcaattttcaaatacatatttttcactgcagtggttttgaagaatgttttaaggttatatttagagtttttaaaaaagttttccctcagccagccatggtggctcacatctgtaatcccagcactttgagaggctgaggcgggcggatcacctgaggtcaggagttctagaccagcctggccaacatggtaaaacaccgtctctaataaaaatgcaaaaattagctgggtgtggtggcaagcacctgtaatcccagctacttgggagactgaggcaggagaatcacttgaatccaggagtcagaggttgcagtgagccgagatcacaccactgcactccagcctgggcgataagagtgaacctgcatctcagaaaaaaaaaaaaagttttccctcattattaaaaaggaaaaattatagaaaattaaaatatagaatgtagaaagaggaaaaacaccacacatcactcgtcaggtggattggtttgtttatttttaagatgggtttattttggatagccagttagaaaacgcccttatagctgatgtgtgcttgtgcatactgaattgtatacttaattctgaaagtaatgaggaaacatttcacctaatgataactggtacaaaggaaagttcacgtgtctttaatagtttgctaattagactagctggttagaaagagggatcactagattggagagagagatccagtttccactggaggcagtaggtctgctcatttccatggtgacaatcctaatggcagagggagtgagtttcccttagtggcacaggctgggggttttgagcttttaagttttgttttatagaaatctggagaattttacattttacttcactatatatctatgtttaaaataattcatttttgatgtcccaaaattgatgtgggttgccttatttccaggcaccaggttgctcactgcaaggtgacattttgagaagcagaaatctctaggtatatcttaagtgtgaaaagcttgttagatttccatggcctattccaggtgggttgttgggtttatgttgtaagcatcaaacttttgtggaaataaatacctaatacaaggtataaataccatttctggttttcctcagagctcacaaaagaatctttgagacttgatgttttcaacctcctgtcagaatccaagttggtgatgcacccaaacaaacctgttaaaatatgagacacagagccgggcgcggtggctcacacctgtaatcccagcactttgggaggctgaggcaggtggatcacgaggtcaggagatcgagaccatcctggctaatacggtgaaaccccgtctctactaaaaatacaaaaaaattagccaggtatggtggcgggcgcctgtagtcccagctactcaggaggctgaggcaggagaatggcgtgaacccgggaggcggagtttgcagtgagccgagatcgcgccactgcactcccgcctgggtgacagagcaagactccgtctcaaaaaaataaaataaaataaaataaaaaagagacacaaagcaatatatgcattttctcatgaaacagtaaactttggttcctttggactattctgtgagggtttttgtttgtgtttgcaggaaaaaaaattaacctaagatattaatgccatttctacttttcctcacagcatatataagataatttgagatttgatttttttttaagtttgctacttttctaggttgaaactttgtgatgcggcaaaccaaaccttactaatttaaaaaggaaaacaaaaggctaatgtgtcagaaatgaatatataaactgaaacagctatagggaaataagactttcatttttaagtcatcgctttaaa

SEQ ID NO: 14219 - DNA, 40649 bp, Human
acctcactgaagggtatttggagggtttctttcataaatctgttgcattaccaccctgagtcattttgctcagaattagtctctgactctcagcaacacaggacaaatacacacatatgccctgcaaaggtaattcagcacagtggtaacaatgattcttagaaatcatttctcactcttctgatatgcagaaaaaaatttgttatgatgtagtattgaagtttttctttcctgataaaaatgatttccactttaaaagttttttgttagttctgtaacggtgatatttcagggaaatgttaaaaatgttcttggaatatacaattcaacctcaggtcttttgttgttgttgttcctagaacctagaaaacttcaaacattgttgcctagttagaaaaaaatttgaatgtggattgctccctgtaaacccccttctaggaatgaccagtaaccctttcaaattctttcactcccagttacttcaaaaaatcatccaaagtggtctcccaagtgagtgcctttaattagaataaaacaagaggttattatagtttttggttatccacttttacttgcattaacctttttttcttcttttacatttagaaagagtaacctgctttagaatagtcccttttatttacagaagctgctgatggagttaacttctgcagaaattcttccttaaggcaaagcaaaaaaagcggggagggggtggggggaaggaagggaaaaagattctcagggaactacagcccacttgcttctgtttcttagagacagaactgacctaaagatgccccctttgcgatgacttctgggatagagcagcactctaactaggcccccgctgcctcatggggaccttaggcaagtagaggagaggcctgacacacacacacacacacacacacacacgcacacgcgcgcgcgcgcacacacacacacacagcctttcaaacctagggcctggaatgccatcccaagaggctttagaaaaaggcacaggacctttggcctcccacctcagggtcaaagtaccagttcctcctctccctagtagggagtggagggttggatggaggcggccagagaagagggaagttgggtgctggggagagagttaacatccacgttggtgggcgcactgcttggggtgttaccagcgaagactacgaagaccccaagctcgaatcagaagggcctctggatgtgctaggggaggtgcttgggtgtggctgtaagagatgggacagagagtaagcagcaaggtcaagagggaccggggggctcacgggagggttgaagggtccaggctcagggtagaactggtaaatccagacaaggagcccatggagaaggggaggggagactggaaaccatgaaagatcccccaccgcagcctcagaaaggagagactgagaaataagttctcggtctccaggtcggttggagtcgtgtcggagtgccagaccatcccccaaaagaccctctttggaatgagcctcagcaaaggcaagctaggaggtcgaaggacttccccaggtgactcggtctagtctagagttcgcaaagcctatcctccctgtagccgggtgccaagcagcctcgagcctgctccccagcccacctgccaacaaaaggcgccctccgactgcaacccagccctccacagacaggacccgccctttcccgaagtcataagacaaagagagtgcatcactgctgaaacagtgggcgcacacgagccccaaagctagagaaaagctggacggggctgggggcggggtgcaggggtggaggggcggggaggcgggctccggctgcgccacgctatcgagtcttccctccctccttctctgccccctccgctcccgctggagccctccaccctacaagtggcctacagggcacaggtgaggcgggactggacagctcctgctttgatcgccggagatctgcaaattctgcccatgtcggggctgcagagcactccgacgtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatgtaagtgccttcagcttgtttgggggagactgggtagagaggttagatgggagggcaccctgccctgaaaaggaaaacctgtaacctgaattccaggtacacttggagggcagactctcaggcatgtgggaaaacgccggaattgataagaaacatggaaattactttaaaaaatgaaaacataaaagccttgccaaaagttagggaacttttcctctaagttcagagtgagacagttaactcggtctggctcctcagcttagtaacccccaaagggagcggaaggtctttttccctaaggatgagatattaacgaccaatgtggtggaggaagtcaagggcctgcaccccacaggccccataaccgcactgatgtccaccttgtaaaacttgaggcctgcgttagaaagcccttcaactgagtaatgtaaaactcacctcctaagagcttttatcttctgggcattgtaaggcttgtccggaggaggaggatgacgatgctgatatgatgatggttataaggcgccctctggaggaaggaaaatgaaagtacaggggacagggccttaagcagatggaatcccaattaaagcttctacggatttatacagattaatgatcagcatttctggttggagcctttcccagtggctagtcagtgaaccctggaaagaagaatggatgctacttggagtgggtacattctgaaaagtaatataagtgtctcaattcactttctagtcatggaaatggtaacattttttaactcaaatctgctctaaattttgtttgagcctgagaattacccctttgacatgttcccagtgataagcaaacattatgaacgcagcaagttgagaaatatcaacattgagatgagactcaagagaccggggtttttcccatgagtctgacaccaatttgctgcgtgactttgggcaagtcaaacggccttttctaaaatgtgagacagagattaaagggaccccaaggccactttccagctctaggttccatggccagactttcatgtcaacagagaatgaagaagatcagtccgttttcatcttgaaaatggctgccaaagtgctagacaaagatattgactagatgggggatggtattgtctgaccacacccagtactccaaaaagttgttccacccacacagcacggtgtctaccactgcataatttctaatgcatttgtgtgcttgtgtgtgtgtgtgtgtgtgtgtgtgtgtgtgtgtctgtgtgtctgtgtgtctcttcccccttcattcacttttagtatacatactgtggatactaaggagtaattgcagtgaacaaattcacattaccgagttcatatttttaatgagatcttgagagtgggaggaaagagtcggctcctagagaataaaatgaaggcagacttagggaaatttgaaggtacaaaggcaacttaccttctgatcaacagccaaccacagtctggaataaatgttatcaaacacacattcttcaaaatggtccatgtctgagtaattaaaaggcaaatttccaaaatcataaggacttccgttaatcaagtcaggcataattattcttcctactgatggacacaatgaagtaaacatatcattcttgtaatttaacagtaattctcgtaaattgcccttaaatgtcagtgctggatgtggtccaccctcctaaattgtgactgttgcaacagatgttctcacttcaaataacgcacttcttggccacctaattaaagcaatttttggggtgattcatcctactgcaagcttggccacacttgtatcctgtattaacctataatttttgtaccgtaggagaagaattcactctttaaggacttataacaattatggcaaaaggggggatagtacttttgtttattttttctattatttttcaagatctttaatccggtttttccatttatacaaaactctttctccgagacaaaaatgatacatattggtaaaatgatcttacctaatttaagtgaactaatttaaagcaaaattcagatgtctgaattaatccattttcatagttaataatgtgcaaattagaccttttgaaaaaggatattaagaatggtacaaactcaatgaagtactaggtaacttcaatgttttataaaaaagtaagtcagcttcaatgtttcataaaaaacaaattcaatatagaattttaaggtaacatactttcctaaattttaccttttttcgatatttaggtattaaaaatgatcaaaatcataaattatttcctcatcaatctactagtcttacattcagcgattcatctgtgcactttaccagcttaattgctaagcattcaaaatatccttcagacacattaatatttcacaacagttataaaatagtaaataattaataatttaattcaaaatacatttacatattaatattgcaaacaaatcaccctgctgatccctgccatacttttgacctgcataatttctaggtcattaaaatattcttaaaaaaatataattggtccttaattaggtaattcaattctataaacttgtttctctatttgttaattattgctattgatccatgaagtgatactaataattgtttcctactttttcttttttttttctacagctttacaagaggtgagtaaaactttttttagaatttttaaaaatactttgattcccttggctacagtgatgtcttctcttggaagggaagaagttacattaatattgaccatcctagattcccaagaaaattgtgaagaattatgatagtcaaaacctttctggctgccttagaaagtacccacccaattttccaaaataggcggggctactgaataagactaggtttataaaatattcataagaaatatagagtaaataatccaatagaagtttgagttttaggatcagcttctatgaagcagaagatttcactgagctagagaatcttttcactcctttggaattatttgcaaaagcacttattgttaacacattcttagctcatgagttgaatttgaggcataagtacaggtacgtattgctatgtattttttgttctgtaggtacatatttttatttgacatgttggtaaaattttaaattgtagtttgaaatattaaactgagataatagtaaatgcataatgtaatgaattgtgaaggtatatttgtatactacaccaaaatggaagctgtttttaaatatatatatacaattttcttcataataatctttgatttattcttttctaggaaactgtaagaaaggtaagagtacactacttctccataaatatctaaaattatcagggataacataatttaactaaatttatagtagactatagaaggaaaatactttatcaaaattttgttcatatgaatatacattagctaaagcataaaataaagtagctttgatgtttaagataacaaagtttaattatcttctggaatcatctgtaattacatttatgtgatacaaactggtgatttacatacaaaaggaaaaaaaaagacttgtttttattctggagatggaaggcatattatgttaattatagggagtaaaaaaagtttattttaaagggctttgactatataaatgtgctgttaaaaatgtaacaaaatgatcatttaatctacagttatcatcttattcaaaatgctatgcatagtattgacctaatagctgaagactatagcagcttccaatcctccagctgaaaaaaaattacgtataattacaattaaaatatatacttttatctattgcattgtgtcaattttttatatgctatctaataacattgtagttacatcagtcttaccaactaattattatcaagaatgatttgtttgttcactggaaattacttcttaggcatttattattgtcctgtttgtatctttcctgtagggcccagccggagatagaggaccacgtggagaaagggtgtgtaatttttgaactataaagggcttcgtcccgtatttgaataactatatgttagaaactacaggaactggcaatttataagaatattatgtatccagataattgtacacccctttaaacaggtaatgcactgcagaagaagcgaatgagcattattatatatgatcaatatttgttttaggtcaaaattaccgttaaaaaagaaaaactgttacagtcatattctttgcatggtctactttctttatttgtaattgacccatccaacacatgcataatggaaatatatctacctaccaccacagtcctctttttaacacatttcatttgcttttgaactaagatcccttaggtagcttggaaataatagtgaattagtagtcagtaacatgtttctctgctcaaattcatgcatgtacaagtcaggcttacattttatttgtggcattcttaaatctccctgctatgcttatttgacatttataactatgtggttttgcattgtataacacttttgccaatatatgaatacctatatcttatatctattaggaagaggagacttacatgtatttcactcaatttattagaaatagaattaaatcagttaattattttaacaatacaagtagttaatgatagtaaatctgcaggattttctctcctatgataaagtgaccttattaactgtcacatcagttaattcattcacatgtaacataccaaaacaattgaatcagtttgtcacagtcagagatcggcaataaaaatacgatgtaagtccttgtgcactgttaaacatatgaagcacgtggaaccatacattttggctataatttttatatttgaatactggagcttcagtatgaattaatattcaatggccgagatagttctttaggaaaactaccctgtgatatcttaagagttattaaccctctttctaaaatagactcataagtgaatttcaatcaatgacaaatatagtatattaaatttccaccctacttgcacatagaaaggtctgaacaactgatcttaccacatataattcttaggtttctacagggcctgtctaacctgaccttactcactttttacataacagggtccaccaggccccccaggcagagatggtgaagatggtcccacaggccctcctggtccacctggtcctcctggcccccctggtctcggtggggtaaggtgtcttacgtattgctaacttttagctaacttcagttgaaagaaggtttattgtggaatttatttttagcagttaagggataattcttccatttgaaaattagtatattttatttcatttatttggttttttcactcaagattctgctttacccattctctttgtgagcccttgtcaattacaggactggtctttgtgtgcactgaagttagctgtggccatcattaccattatttaatttggagatttaatatcttttattagtaaggcacaaataagaggtgttgcattattaaggattttgattagattgaactgtgtaagtgaaatccctgatcttaagcaattttacaaacatcctacgctttttattctccttgacttgaagtctgctgaaccaacattcaaagcggttttaggtttaatttgcttgaaactaatttgagaaaagtacatttccctttttcattaatatcttcttttagcttcatgtctttaacaatggtatgagtgccaaatgacctcactgcaggaaggaaaacatatttgcttaattggttagcactatgaatcagaagcctgattctaatacccaactgtatgtcagtaaaataagacctttctcccccaaagatcttattatgattgcttatctatgaattgcattaaaaagcagcttctttaatagagctaccactataagagagatctttaacagtaaagttattactgtgaactagtttttagaagttttatcttccaaggggtattttaatttaattttcctctaaacttgaaaactctttatgcccttcctgaaactccagcaagaaaaagatctcttagtcattttgtgtagctccggtggggaagggcaacaggtgaaaatgtgaagatgtcctcttgagctctgtctaatttgtcaggagcccttagtaacattaaaagtttagaaagcttcccttcctcagagtagaggtaaaaggtgggagtggagacaccgagttaaggcagaggaagggctcaaaaagtaaagtagggaagttctccatttcaaagaggtgtcggccaagtttttgacgtacagctctcataactttttaggaatttagttcaatatagaattttaaactaataattatatcaaaaacattgccctcttttaaataacaacagaaaaatatttacaagtagaatgagaaaatgaactacatgactagtaactaaaaatattttatatatatatataattttttttttttacttctctagaactttgctgctcagtatgatggaaaaggagttggacttggccctggaccaatggtatgcttatctgtttatcttagccaaaaaaattgctaaataaatcattcattttatgtcacattttaccacgccatttatttagctacctaagttaacactcaatacttagattatataaaaacaactctttttgttttcaaatttatgaaaacataagttaaggagttcacttttctttacaaaagaaagattaattgatcttttatgattatatgatctttttgattatatgatcctcattaagatagatcatatacttatgtccaagaaataatctttggacatagtaaccataacttgggcaaatcaatttaatttaaaacagtaatcactctgattaattttttaatattctttaacattgcttagaattttaagcaacacttagaggcatagaactatttattaagttctctgaacttgttggaaaggatcaacaagttctatctagtccagctaactcattttaaaatgggagagtttaagcccttttctcaaagtcatccaggtaactaatgacataactagaactagatgccaggcaagatgtctaatatttgcttacatcatggtttatgtacctagtccttgaataaaccactcatttagtcaacagatattaatcagatgccttcaatgggccctaaactgtattaggaactggggaaattacaaggaatatgacagattctgatccttcctcaaggagttaacaatataggaaatgtttctttttctgaattttgaccaaaaaaatccttttttagtctattgattgtaaatctatatagaagagagtatgagtaaaaatctagcatttatgtcactcagtacaaatattcagcaccataccctatcagtggagcaccgcttagaaacattccctatatgatgatgatgatgatgatgactattaacaaatgaagcttctaacaagcattagagagaagtttgaagggaaaaatgctaatacgagcatgcaaaatgtatactagcatatatgaaatagaggggaaaactgccagaagtcaaagtgttaggttgattaagcactacagaatttaatgtatacacacacacgcaatttagtgattttaattaattgtttcaaaacaaaggtatttatctgcccaaagtcaacaaggtctttaaaatgtaaattttacctgagcagtgcacttagtgctctatcttcaaaagaagatgttctgctggagctaatggcccacagtaagctaatatactctaagggtgagataatattttctgtaaattaaaactcccacttgagaaataatgtacctttaattgacgacttctaattccctaattttttctggtagtttaaaatgttcatatctgaaatgaaaaagtagagtgtttcttttggctttgtttatattggatttttgaaattagctgtttcagctaatgctggacattagtcagttttaaagcagtacctacatctcaagaagaagcaagggggcggaaagtaaagagctactaaatgtcatttttaaaaagcccactaagctgggaaaattaatatggatttcagatacccctgttttcggaacatctgtcttggcataaagcagagtattttactttgaaatatcagtgaaatataatttaagcttgcacatccacacacatgcacagacatatgtaatcaacagatatctgtttcacaaatagggaagataggcagcaataaagtattaaaataatttccatgttggaaaatcaataactataaaaccccacagggttcttctctgaattaatgagtaatcacagcctccatgaaatacactacattttatgtaaatgaaattgttgcaaatacatgaaaaaataaatataattagaaattcatgatgtcaaagaaaattattttttaatgtatgcctaaaaagctattgtgatggaaaagtgacagtttcttttaatgtcagagcaatttctaaaaccaaatgaataattcttataattaaaatgacgtacattttagataaaatccatgttatttcactctaggcattaatacagtaaggtaggtttgactgcagagtccccacagctgatgtcacgaacaaattacttgagactggtacatgaaatattttcagcattatgaggaacagaccctacggatgagcttacacaggcattgattactgcaaagaggagtcaagaaagtgtatttagcttacaaactattaacagcctgttttaccctacttttgtgctatggaaacaacaaaggggaaaacaatcttccatcatttgggccatattttcaacaataatatcatataatagactcttccagaaggctgtttcaataatgttttatttttccttcacccctcattacatccacttttgtttgacattttcatcagtcaccaataacccttagaggagcgataaggttataacaaacttctctctaatcattaagaaggacttttgattcttttcaatttatgtcctttgtggcaataaaaataccaatttcttagctaaatatgacataggaagatgacatatgatcaaagatatccaaatggacatgcttcatctgctgtatagaagacaattgtatattctgcacttctgcaaagactgattcacttcattgcatcagaacaatctcaatatgcccaattgtgcacaactttaaggaacctatctgccccgtctaattctcattgatttctgttgatatggattgggagaaaaggaaaagcaaagggagagaactagtgcaggaagtttgagtccttaaattcttccttgggaggaataaaaactatggaatcaaaccacaacaatggcactgctaagttggtcatgtctgaccccagccaacaccatgacaacttatcagtgctaactgttgatatatctgctttctttacagggcttaatgggacctagaggcccacctggtgcagctggagccccagtaagtactgaaagcttgtaatgcctcttatgtaaaaagacagagaattaagaaataaaggcttggagtatgacattctttttttcttttagggccctcaaggtttccaaggacctgctggtgagcctggtgaacctggtcaaactgtgagtacatttttccacctttgtgataagtttttttccaggaagtttatgaatataaccttagtgaaatgatgggtctcccattttcttagggtcctgcaggtgctcgtggtccagctggccctcctggcaaggctggtgaagatgtaagtatttactcttaagcactttcaaaatgctatttaaatactcttgcctcaacaagattttctagattcaaattaagtattctgccaaaagctgaatatgcctgacagaactcttaatgtatgggaaatattattttaatgaaatattaactaacctacttgtattaagggaaagattaaatatatatctggatccatatttttatgtgataactttctccccttttgtaaaaaccaagattcccccattttgtctgatagtttaccaagaagaagttgactctacaatgttttcatgtttagggtcaccctggaaaacccggacgacctggtgagagaggagttgttggaccacaggtgagactttttacattggtagatagcacaaacatcataggcctataagatagttgctaaaactagcatcaatctaaatgacaacatagatgtcacccaaactcataacatgaatcgaaggcatctaataaagaaaaaagcctagttaaaaaaaaatgcatatacattttattcatgcaaataatggaatataaatgacagcaagcataccataagcaactaaattgtgttttctacaaataccgtattattagttactcacattagagcaagttaatttgtcgctctgtgcttagaggtatactagactttggttcaaagcttgaactttgatgagaataaatactttggagggaagaagtcactgtctttttatttatggtaaaacattattcaccatcttctgtatttctttctaagggtgctcgtggtttccctggaactcctggacttcctggcttcaaaggcattagggtgagcacattctttactcagaagagagaaaatgcctattaatttttggaaaaaactcaagtatgtttaaaatcttgggtgacatatactcactttcaaatccctggagtttgccaaagggaagaaagagttaaagagtcagatttcttgaaagtaaagtggggtgcaattttttcagtctgttcatagctaccaaaaaacaggctcactacagagaaaattatatagaacatgtattacttattgagtatttacaaccgtctgaaaatcataaaattattaaggatggaaaagatgtgagagaacacctagtcctccatccttctctctcaatggcaagaaagttaagtgacctatctagggcaatagactgagtttgctgggacctggaacactggacttctttctactgcagcagacaagacttacccaagagagattaatggcaaagatatacaatacaatttttatttgaccaaacactatcatggaacagcattttataataaggctttcctttcagggacacaatggtctggatggattgaagggacagcccggtgctcctggtgtgaaggtaaatattaaattagaagcactgtttttaagcacttgattgaaattccccatgacctccaaaaaagtatattatactgaagactacccatattacaaaaagtatttttattttttttctttcctgtacttcaaatccctcaaggatggggactatgagagtctgtgaaaaaaggtcaattattaatatttattaaaattcaatatctattaaacaattgagataaaaataatattaatagtttcttgttccatttcctttcctccctctataattccagtgtatctctgcagccaaaataaaagtaaataaacatataatcagagattacgacactctgtattattttaaactgtaaattctcctttgccacacactaattagataggtacattcatgtcgctatacacttttcaacctctttcctgtgatttatctgtgcacactcaaaaaaattttaattaggtaattaaagtctcagaagtgtgttatctcttggctaggctcttctctgacagcgttttcaactataaaatgttctctttcctattaaggagataatgtgatattaaagtgaataccaacgtaattacaaattaatgagtaacgaatactagcgggaccagaaatgaacatgaatatggagaatctattctaactttccagctgccacacaaatggataaggtcaaactcattctcccaagagcccgatataacagctcagactactaatcactgtatcataaaatgttagagctgcaaggagctttggagaccccctcattttgcagaggtgggaaactgaggcttcgtgagagcaattgacttgcccaaagtcacacatctagaggttagaaagtcataggctagaaatgatccccccttgccacttcaatgcttattcccaaagaatagacttcacatagaatcctggaaattaagggtccttatgaggtctcttaaaccatatttcccctatatctaaatcagattatctttaaaaaaagttcttttacatgtgccatagtattaaatcccactactactactactactactactaccctggtttttactcaggataagaatatagattggaaataaatatgatggctctaaaaaataccatgaagcttcaatttttcatgcacattttatgaaagtgataacactgagtgttcaaaataactttaaaaaggataaatatggttacattgaaagcaaatttatcctttgccatctctttttatgatattgtttctagtatataattgatatcctgaatctaagggagaaattggggaggaggtacactcaaataaccacatctccttagaacctggatatgtggtactatctgaataaaaactcatgttagcacattttaaaatctgtgtgtctggcataattgaaaaacaatctatatgtgtaagaaatattatgaagtatatgaatggttcaaagtaaaaaaaatagagtaaaattgcactatcaggaaaaataattgttatatttaatgaacaaaaactcaatccttctccatgtagggtgaacctggtgcccctggtgaaaatggaactccaggtcaaacagtaagtattgactacttcattgtaaatttaaatgtgtacactctttatgagatggaacttctttaatgtttttgctaatcactgtatccttcagcattgtattctttgatgtttttctaatagccttctgatacttaattgaaatccactactgtttagttggaattagaaggcaacttatttatttttagtgtattcttgtacaggttggaaactgaacaaagcaaatgatgcctgtgactttttttaaattagcattctggattttattgaaaatatttctgcttctagggagcccgtgggcttcctggtgagagaggacgtgttggtgcccctggcccagctgtaagtgcttccatttttgttcagtttcatccttttaaaaaatcttctaatggctgtcatttaagtttccacctgatcttccctttattttcttcttagggtgcccgtggcagtgatggaagtgtgggtcccgtgggtcctgctgtaagttttgacactggggagtttgaaaggagttgagaatgtggggtgggtgctgtcttcttcattaatctcttacgaaatagcatcatttcagacactttaccaaatgttctgtgaggtcttttgaaggctccatttataagtagtgtaagccatttataagtacctgaacttttgattgatgtataaagcaaaatatccccaccctggataccatgaatgtcttgcctttgatgagatcctaacgacaacagactggttgtcagtttttttctttactaatataaacagtgtcatgccactgtaagcaacttcaatcttctgccattgttattgttttcttaatttacttggaggaaatttcttaccaccttctgctttgatttcagggtcccattgggtctgctggccctccaggcttcccaggtgcccctggccccaaggtaaaaacactggtgaccattgtcactactttgataaactttttactgtgatgtgaaagattggaactgtgtttgcagataaagagataattacgaaacagttaccttaattattccttcccttcaaaatggacatagaatgaccagttttctcactctacatttgaaatagatcatttctctgcactgtgcactgtgcccatcgatatagatgacaacatggaaattgtctctaggactagttagttaggactgactgagaaccagagtcaaccacagagagacagaaggagagggaaggtagtaacagtagccaagatggcagaatcaagcaaggaaaataggaaaccaaactcaaatcttgtaataaaacggataagaaaaataattgcaattttgaagttttatgaagacatttcataaaacttggcatcttaaaaacagatatgctgtttcattatttgctggttaattccttggtttaatttcctcttttagggtgaaattggagctgttggtaacgctggtcctgctggtcccgccggtccccgtggtgaagtgggtcttccaggcctctccggccccgttggacctcctgtaagtagccactgtctttaaactttattgagtaaaagaaaacaaaggtggagtatggggaagaagaagaatgaagatggggtcaaagaagaaccgaaatattccaattaactgatatccttctcctttccttttcctcatagggtaatcctggagcaaacggccttactggtgccaagggtgctgctgtgagtatacctgtgtagctaaaatgtgctgctatgattttaaaggcatttaatgtgtgctgcctctacagcccatcacctccctaatggaccacactgcattttccttcatagggccttcccggcgttgctggggctcccggcctccctggaccccgcggtattcctggccctgttggtgctgccggtgctactggtgccagaggacttgttgtaagtggtcatgactgtggttctcatcatcctgaaataccacctctgccatcatttcatcactatctagacttccacttgtagttttattattcctatttttctcttccttagcatttttagtttatatttcttatatatatatgtacactcccgtctgctatatgcacacagacatgcccttcctgttatcttaaatcattacctcaaggtaaatgaggcaaagttctacaatatcagttttgtcccttcgaccaataataccattcccctgtactcaatttaaatatgaacagggtacatttcctagagaacttgagcttctctttaccttgacccacaaatattctaagagatttgtctgcaagagagtttcaacaaatgtttgtcctttgaccactgttctgtattgaaccctagggtgagcctggtccagctggctccaaaggagagagcggtaacaagggtgagcccgtaagtagctctatcatcacacttttataaagttaattgtttttctcattccagtttctccagctggacatagtattaaaattatttttttactccctcttcttttgttcttttcattaaacagggctctgctgggccccaaggtcctcctggtcccagtggtgaagaaggaaagagaggccctaatggggaagctggatctgccggccctccaggacctcctgggctgagagtaggtttcaaatgctcccaacaccctaacacaccagaggcagattatgataccccttcattgggaattggtcaaaattactgactgtgttttcttaggcaaaaaaagcatctgctttccatctgccttattaaatcagtgactctcaatttaatatgttataaaattggcctggaaacaatgttgacctacttttgcaggatgctcatctatgaattcctctaggggttgggtgaagtgttttggcttggtttgtgtctgtatctcccctgtaaggagatcatgctatttttaacaaactctaccttatcaaagccaagagatttctttaattctctctatttcatgtactttcttgcagggtagtcctggttctcgtggtcttcctggagctgatggcagagctggcgtcatggtaagctgtctatcacttacttcctagaaaggggcttgctgcttctggtggtgggtgtgtcattagctttagcatcctcctcctctatctgttttttttttttttttgaatagggccctcctggtagtcgtggtgcaagtggccctgctggagtccgaggacctaatggagatgctggtcgccctggggagcctggtctcatgggacccagagtaagtttcaaactgattctgagcaaatcacacctggcattacttccttctttaaagggttggttaatattgaagataacaataaaaacatcaaaagtaaatttgttagtagtcttgctgacagttgcatttttgactttatcaaagctcagtagatattttcatgcatttaattagttcataaattttctatttattacttgatacaatggctatgaggtttttggaagaatagatctattttaatatatccaaattagattggtcctcctatcagcatgaatcttttatcttaatttgtgagttttatataaggtgttcatgaaatatattaggactatacatttttggtttattagattcataagtgaagtctttttcctagcaatcacaaagtgctgtaatgtattcagcatcacactagctatggagaaataacctctaggtccatagacacactaatccatagcaatagagtaatttttttgcctccattacctcttatgggtgaatatcaactgtaattgtaccataaacaagtaatagggacaccaaatatagcaataagaaatccactttggaaattgtttactaaaagtattagtttttctattatgaggtaaataacgtgatacattttgcccatatacatgttgcttaacagtttcttgagatatctataaaaggatgagttgcactaaatttcaataaaaggaaagccacaaaaaaatagaagaaaaatttcagaactcttttcacacttcccagctagtggctaatattcctaatgatttaccctaggcaacaaacaaaaagtcgggggaaaaggtgcctttgttagacttcagttaatctaaggcttgagtatgtaagttaaagtgccaatataaaaacatcctcatttattttatagggtcttcctggttcccctggaaatatcggccccgctggaaaagaaggtcctgtcgtaagtattgctcattttccattatattttcaaggacacttattgcacccttatcaagtctattttgtggcttatttatacatgaacacattgaaaataaatatcagacacatacatcatctgggaatgcagagtaatagattgtaattatggagtccaaatgaatacaggactgaaagcagagcaggggagagaaaaacatggcagggaaaattgaagcaggtgacaaggggatgcaagagaagggaatgagggaaattgcatacatacgagattgaattggctatgtgtgtactgacatcctagttagaaaaggaaaatggattcataatttattaacgctttatacaagaagctctatgcattcagaaaactattctgtttcatccgtggcagcatcataagcttgaggttgtgagaatatgttgacactgagtaaacttgaaataactctgctttcagggcctccctggcatcgacggcaggcctggcccaattggcccagctggagcaagaggagagcctggcaacattggattccctggacccaaaggccccactgtaagaatcaccacaactttcttaccctcagcactttctgtagccaaattttaccaaactctagtatttatctcctgcgaatcagtccagtctcagggagtttcctttcaacacaggaaaactgcaggccacttatcacattaaaagtttacctctagtgtatccttatatccctgctaaaaatccatctcctgagccccatgcttccacagacacagggacatcttactgtacatggagctgcatggtgatggatcatccttagataacagaaaccacagactagggatctcaaaagaacacaaaaacaagcaggattcaacattgcaaaatcaccgtggttaatttgacattaaatgtgcaaagctgttctttgttttgtttttcatttttactctagggtgatcctggcaaaaacggtgataaaggtcatgctggtcttgctggtgctcgggtaggtgctaacttgtgtacagatctattcacatagcattcatctaagaaccacacttttttttttacaccatctgatatcattttgtcactttcttttcaagatggcatccccaggggtccttttactatcataaaatgcctttttaaaaaccaaacttataaaacagtgagcaaaaacaaatcagaatatacattaggtcaaaaatacagaagcacttggcttttattttattcattttgtaattaaaagggtatgaatatgtagtagcattctctggcctttataaattgccttgtgtcgcatacttcgcttgagtcatatcaaaagttagtaggcaaacccataaatatatatacctactatgtacccacacaaattaaaaatttaaaaagttagtaggcagtatttgggctttcgtgggaacccacaatgagtttaattcatgctaaaatgacaaacttgttttaaggaagtaatacctgaggctttgagacatcttaaactacctggcttgcagctaaccatcagcctttctgttaaatatttttagggtgctccaggtcctgatggaaacaatggtgctcagggacctcctggaccacaggtgagtatttctcccactcttgtgctcttctgcactagaatgtatatagtcctcaaactggccatctccattttcagtccaaaagttatacagctagacaacagtggtgacatacgttgctatttatgctctctttcctgtcactttcagggtgttcaaggtggaaaaggtgaacagggtcccgctggtcctccaggcttccaggtaagtcaactcaaacatatacaatactgcctttggtcagcctattgagctgtaaatcaccataccgtacctctcttctccaccacaataaacatgatttcaggactgaagcaaagaaaggtgcatttttttcaaacaaacttttgtgtaatgcttaataacatacaatcgtgctcatgttgatatttggtagccaccacccccaaactcaattattagcaaatctcctgaacgtagccatgggattgagatttgtatttcttttcatttttagggtctgcctggcccctcaggtcccgctggtgaagttggcaaaccaggagaaagggtgagtaaaacaagtaatagtaagtagtaactactaaacttgagaatttccccctgtttaataccccactgctatgcaattataatatgtaaaagaaaatttcgtatttcatatgttaatgatagtgttttacatactttggtgctgatggagagaatgagccaaattactttagttctgattactttgttttacagatttaatgaaacatcaccttatgaaagtaaaatctatcaatgaatattttatttaatagccttactttttgtattgttcttgataacgttaagatacaaattatttccttccccatagtgaaaaagtaaatgcacaattttcaatcaaactagatcccgaaaaattccttttgtgtttttcttggcattcagacatgacactactatacacaatcagggcatgagttctgagtcattttctctctaattgtgatgaatgtgcccctatttagttacattctgtggcctggtctcctttgtcaacagtaggacatattaaggagacagctggtcagtaataaaagagatacacttgggtatacaattaactaggcaatgtacagaatatgataatttctcttaagaagacgatctgttatacagctaaaaataggcaacgtctaatattcattattatttatcttattattgaaggaaatagtctgtcactttttaaaaagcaataaactaaataatgggaaacaaattttttgataccaagttctgggatggatacatttttgtcaccaataaaattctctctttctgtatctttccatactaaaagttgttcttattagcctgtgtacttatgcactcatgtagatactgccaggtttatttcactctttccaaatttttcaaatattttaatcataagtgaatttagagatcacacacagatttcatgctttattctcatgttttgtctagggtctccatggtgagtttggtctccctggtcctgctggtccaagagtaagtgttacttcattaactttcataaactctggcaatgtgtttttaaaagtagtagtgctttctccttaaagccactgatgaccctgcaacaagtctctgatgctcttctatagtcaaatgtaatctgtagaaagcattagatttctaagttgatagtagaattttttgtttcattgctcatatttcctattcaataattacatagttataagaaacacataaatcaatatatattatagtcagtgatttatatagacaactatgctacatttgtgacagtggctcaacttgagctaaggaaaaataatatgttactaagatataaagttaattttggccatgtgtgttgatgttcaaagcctaaagccgaacttatgagtagtcatataaagaaaaaaaaacttagtttctctatgggtattagcatcactgaaatgattaatttgccctgaaagtattccatcatgtcactagttaacacatatgtaggaagctcaaagaaccaacttataacaaggtcctttgaaacagttacaacgtggacctatgtgataaatattttgggctatagaatgctatgctctagtgatatttagatgtaaattgggagatatttagatagacagacatatatatatatacacaaatacatatatcaaatatacatatgaatattgtaactgttatatcattattacacagggttataaaaagggggcatagataggagaatatctaatgttatctacacctgccattgctattcaactaaaatgacacaatcttttctttgaatactacacataactggcatctgtttttacctatggatttatcacagaaaagactcctcaaagaaggggaatgaattgcaaaaattgaatattatactctagaagcaacgaattctggagtcgtagtcatggaacattagagctaagtgacactttagagaatatctcatcaatctcttcattttactagtggagaaattaggaacaaaagaaattttaatttgctaataaatgcaaaccagggctcggaagctacacaaatgtaaactctcatatgtaaaacagtatcactgaaagtgatgaatggtgcaacacttcttctaatcacttttttcagggggaacgcggtcccccaggtgagagtggtgctgccggtcctactggtcctattggaagccgaggtccttctggacccccagggcctgatggaaacaaggtaaaatcttatgttttctatattgctggtttggcccagtctgcctggaataagtagaccctttacaatagaaagataattgtttttcagatttttatttatttccagttctgtgatgacttccctctcagtaaacagcaatccgattccagtggacctgaattattctaaacaaacaaacaatagcaacaaactgtgggggaaaattcagagttcccaaaacataaatgaattagtatgggttgtcactcttttctcctcacgctgtttatgcttttgttttaatctagaaacattgtattcattggacattattttcagagaaaataactttttatcttaacatctcatcccatagagtaaaatttcaacaagtagtctgacttttaataataagagtttatgatgatgaaaattcattgggcaatacattcacccccaaaaatttgtctggaaacttgtgttccaaaatagaatctgtggtttagattttaaaatagatttaatatacattcctgaaaaagagattaccttaaccacaataaaaagaagacaacacatattattttcattcttaactctaggggaaaaaatgtaaacattagttgcaaaaagctattttagtgtatggaaggatgttcttgggaaaaaaataaaaacataaaagggagagaggaaataaagaaaccacggttttgtgaggtagtactttcaaagggatctatttatctcagaagctagtcaacaggttttaagtatgtggaattgtagggttttatataaaaatggaagatacagtctctactcttaaggagattaaaacacaaacatctcctcaattgacaaggtctctttccatgctttctatctgggctaagagacttatccttgaaaaatgtttgtgggtaaacattttttactctctgcttcccattgtcctatcctcttctccatgcctgccatccttaagaggactgaagcaggttatagaggaatcgcagctgtgcactcccactaccctcatctcttcagtcaccatgtcattaacagcatctctctctgctatattctccctcctttcaatagcccagccttctttgtgtttcaaagcaggcaagaagcctgtctagctagctgtttaaattggaattcttctagagtttgattcttcattttcttctttctccactaaaattgatttcacatgtgtttgactcaagggtgaacctggtgtggttggtgctgtgggcactgctggtccatctggtcctagtggactcccaggagagaggggtgctgctggcatacctggaggcaagggagaaaaggtacgtgttgacccctattacatattgttgatgaactctagtaaagaaggctgcacaaggatgcccaagttttcacaattcttggcaggtggtctggtagcattttcatatctatctatatacatttccctctgccacctagcacctacacatttctaaactcactaatctggcaaaattccttgctaccatggaatttcacacaaacagatggtgttgagtaatacatgaggctcattttaatgccactaacaataatgcctcatcctgtcctaattaatgggaagaagctacattgaacagctgtcaaccatgctgctgcattagttatgccgtaagagtgatcaggcgctgcagcccattgtgatgttgccttacaattctgtccacatgaatctgtaccttgcttgattatgcttcaggagagtgtacggaaattagaaaagattgtttaacaataatctggaaatggccttgaattattttttcctcattatttttctcgattaacattctacagaatggtaaggaatcgagacattgctaaaaatcttaaatgactgaaggtatcatagcatcttctgtaaaaaagaaaaaaacttcatattaatttcgattcaaaattttggtcagaaaacaaaaagttgctcttgctttatactttcagggtgaacctggtctcagaggtgaaattggtaaccctggcagagatggtgctcgtgtgagtagaattttgtttgtatgtttcttcgtacttggattttttttttatgtttgaattgagaagttttccaaattagaactacacacactttatttatcaagtttaataaaataatattcctttctctcctgggtctatgactaataatatcattttacatgttccaaaggaaaaattaaatgggatttaacctctttgaaaataatatcctgaattttctaacttccctagtgtcaatgataccaactacaaactatagaccaaaagctttaggtttaatagaatattaaatgattgcttcaagtgataacagagattaaaataaataaataaataagtctcctatgctttaggaagccgggacctctaacaagattctatagttattcaaacctactccctagaaatttatcacccaaagagcagccccaaagattagctgttaatgccatgaagatgccaaagataatcccatgacagtctaattaccttatctcgtatgtcagcctcatgggtcttctaggccacagtcggcctggattcctttattcacctctccttcagagctgaaaactgactgtagcacatctgtaatagtctttcttttgaatcacatagttctaacagtttcaaacaaggctactcatttgctgctctccagggaattttacaatagcggaaagttcagatctcccaaatttctgacctgctattgacttacacatttccataacctttattactggagtaccctccttctgagagtggcttctaatagtcttgttaattagaaccaaaatacatcagaggccttctagatatccaaccagagtgcagtgaaagtgttcagtcactgtataagcacagaaaaaaagaatgacaaggttcacttttgatgatacggggtgttattaataagacatgtttcctttttggtactagggtgctcctggtgctgtaggtgcccctggtcctgctggagccacaggtgaccgggtaagcatgcattttcactaagccaacagcaatatctaaaatttcccgccttccctagtcccaaagagccccagcaattcatttttatggcttggtataaagcctacttatttaaaaacctagctattgtgatagagcagcaggaaacaaatgctgtgtgtttaaaattacttttcccttcctatagatttgccagctatctgatctatactctaatccctagcatttgttttaaagtctctccatgttgcgcattaacaatatcctaatgcactgaggcttctcaaagccttcaattattaccaaaaaatcaataaaatacatagtgtgcccatttcacattgaactctccacttaaaatagatcttatttattgtattgcaaagattgccacaaatagatcagccccgtgtccatctaaaaattaaaatgtcctcctcctggtattgtaggcactgatttatagtgttttctcaagtgtataacccataccacttaacccccaaaatgaatatagcattaagtaaaaatccacttcattttactctgtgagatgtgcgtcagttatctcttccaaggcaactacagactctgtctgtccaccactgttctctctccctcccagttctttgagcatctatgtcaggcacattaacagattcatctttggtcccattatagggcgaagctggggctgctggtcctgctggtcctgctggtcctcggggaagccctgtaagtaagaacctgggtcattttgtatactcacacctcacaatgtttagacattgatgaacctaggattgataacacatttttaaatcccttctcccacctagggtgaacgtggtgaggtcggtcctgctggccccaatggatttgctggtcctgctgtgagtatcacataatgaagattaatctgaaaacatcctaagttggggagtagagtgggtcggaataccagagctgtaactgtttatttccaacagggtgctgctggtcaacctggtgctaaaggagaaagaggagccaaagggcctaagggtgaaaacggtgttgttggtcccacaggccccgttggagctgctggcccagctgtaagttgaattcactggtggtccacacagcagctacccattagatcttccaattaaatatatatccgtcaagtgcctgctatgcaacagggaatataccagatagaagatggaaaataacggaaggattaacatttgcacactgctttacaaagtataaaagtttcatgaatattgttttattttaattctctgataacctcataagggtggtaatattgaagaacattctgacacagatagtcattttttatttctatattttcttctaagagatgcgggaatgatccacttgaagaaaagagtagcatttacaagggtttgtttgtgatttgactccatctttttgtttgcatttagggtccaaatggtccccccggtcctgctggaagtcgtggtgatggaggcccccctgtgagtatttacaatggactctcgccgcttttcttttttcagaatctattaaggacacttgaaagttttgaaatttttggtaaatttggactaccatgaggaaacttttgagattcaagttcattctattcagagcaattccgatattgatgttaacttgaactcagctggaactcagtgtatgttgctatcagctcacttgaggtaataaccaaggtgggccctaggcagtttaattgtaaagtcggaaaaaatattccttttggcgtttattaatatgccccttcttctgcctgaccatgtccttctcctttgcaggcaatgctatcacaacaattctctagagacccagagctccccaaaaatgaactttactgacttcttctctcactggacagtgctgaattatctaggtcatttgttattcttttgtccatgaacaccattacctattaagtgtccatttccttaccactcagccaggtggtaaagatagttattaatgtatacacattaatgtgtaataatgacatagtgtcttatcttcatacctttacaaccataagataatatgtcagcatttcagaaaggaccatccaaaccttaacgcaaaatatgggcattgcaactggtaatatgctggtaaggaagatgtgtggagaaggagggccttcagggtcctggctaaataatgccctatatgaagctgcctgattttccaaaacaaagaaattcccatcttacccaaattcttggagttgatgttgactgtggaattctaatgtgcttggctcttagggtatgactggtttccctggtgctgctggacggactggtcccccaggaccctctgtaagtaaatcactgtaaacgtgtcttcatttactctagccaaaaggcctggcttctgataggaaactggtaagaaactcttcatgaaaacacatcactaatattcgctattactctcctggtctgaagtcagcttttctgaaccattaaggtatttcatcacaagttatattttataatatcagtttaagaggcttttattcatgtgaacaccagtcccctttcaggggcatggtctttttgaaaaaaaaaaacaaaaaaacgaacagttttagccacatatcagatatttctatatctaattatcctttatggctaacattctgcctccattgttaaggtataattgttcctgaatttaaaggtggtttggcctctaatttaattctgattcagactctcctgtcaggactcaagaaaatttaattaattaccaaggattaagtcttctggttaaggtttctgggaaaaaaaaatagcaaagatgttgatttcttggaatccttttacaggttcataacagaaaaatcttcattccctgtaggcatttaattaaacctagttgagaagtgtgtgggattcctcaattatgaacaaaacacgtatattggctttctttaaaaaaaaaaaaaagaagaaaaaagaaaaggcaaagtccttcgaaactcagagtcccattcatttatcattaactcctatcattctacatagttctgattccaatatgccagggtaccagtggcatgacattgtttttcctcatagaaatttgccatagtctctcctccattatttggttggttacagcctcataaaggaagacaggagttgcttctttctgcaagaaagaaggttaaaaactataaatatttcccccaaatggccagggtattattttattgcatcacattgtttgcatcttaagatctagaatctttgctgctctcttccaggcccttggtgattaacagaaaggaaatgaccttgtacatttgctcatagggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctgtaagtgatttccaactcctctttcttaataccttatgctgaattaaaataaagcccctacacaaatcttcaagtggcatctatttgttgatgagtattgcaggctctcaagtagagctcagttgagccaggaaatctgtccagcacacactgaggggctgtggcttccaagatgctcagaaagcacaaaatcgggaagacaataaatgagggaactcagttttatcacaaagcccttaaagctattgaaggcaccttactggtaccaggattagaacagagtcccattgctgtggccatcctactacatattaatcaatctcagtaggctaccaatttcttaaacatacactgtccagtattagtgctactctgaaaggtgcccctattagaccttagaggccaaagtcaaaatttgcttccttttgatatactgattttactgatttcctttttgtttttgttttttgtttttgtttttgtttttttgttttgggatggagttcccctctgttgcccaggctggagtgcagtggcacgatctcagctcactgcgacttccgcctccccagttcaagtaattatcttgtctcagcctcccgagtagctgggactacaggcacacaccatcatgcctagctaatttttgtatttttagtaaagacggggtttcaccatattggtcaggctggtctcgatctcctgacctcaggtgatccacccaccttgacctcctaaagtgctgggattacacatgtgagccaccccacccagcctgatttcctttcctttgtgtatatacccagcagtgtgattgctggatcttatggtagttctatttttagttttttgaggaacccctcctactatgtacaactattatgtatccataacaatttaaatttttttatttgtttccctgcctagaggctataaaaactctatttcaccaccccaagtgtctttataaatctcaaccacatatttttaaatgttgtgccattggtctcaaggatgaatcagatacaaaagtattcatgccaagatgtaaactcaccgtcatcactagagaaaagatatccaaggatatgtcctagtaataggaggtcattagcctttttctaagctgaagacagtttattctcacaatcttcaagccaacctgtgttatcacctagggtcttacccataatactcagtattttttctctatttagggacctcctggcactccaggtcctcagggtcttcttggtgctcctggtattctgggtctccctggctcgagaggtgaacgtggtctaccaggtgttgctggtgctgtggtgagtgcttgacagtattctgactccattaacataagaaaagattttaaaagctgccacttcaaatgtgacagattgatcactgaataacttcacttaagatttttattcatggcattttctttatacagatcacatgtcacttatctaagaagctttaataccaccttacttagacacacactataaagacacagcttaaaattatgcagaatgatttttgttctttccacgcacttaggaacgatacaatctctaattgcgtttactcctctgcaatatgaaatgctggcatcatttatcctgtaggaagaatgaaactctggaagttctgaatcgttccattaaaccttatacgtgacaacaactagaaaccatctcatctccataaaatatatcaactttttgaattcatttcatttgggatactgaatgacacgaggctcactttttacagagcaacatcccgtgattacataaagctggccatctacatgtggagaaggagggcagagatgatactaatgatacttcttaccattgtgtgacccattcacattcaatttaccttcttccttcaaactagaatctcctgagtagggttgttttggaggggaaggttagcattccatcgaataaggggaatgtcattttatcttctctgcctgtttagggtgaacctggtcctcttggcattgccggccctcctggggcccgtggtcctcctggtgctgtgggtagtcctggagtcaacggtgctcctggtgaagctggtcgtgatgtgagtccaacacttggtttgtaaaataaaactgagcaggatttcattgtgtgaaactttatgtcctgagctgaggttctcttcttccaaatttctgaacaagatggtcagcttctccatagtatctacacctagtactgaaaatatgaaaattgcttaggccaaagaatgggcttttcaatagcacactgcaaaactgggcccaagtatttaaaacatctctaaaaaatatctaggttggcaggtttttatccctagttttaacagtctgaaagagggttcgttactgagcactggaagtgatgaagacagagtagctacaacataggggctggtaggcagcagagcctcaccaacagccttaatttgtgtggtgtcttcacagggcaaccctgggaacgatggtcccccaggtcgcgatggtcaacccggacacaaggtcagtacacttttcatctttctctaattcaaaagtgattaaaatgcaacccagattgatgctaagcttcattttgcctttggtagggagagcgcggttaccctggcaatattggtcccgttggtgctgcaggtgcacctggtcctcatggccccgtgggtcctgctggcaaacatggaaaccgtggtgaaactgtaagtttgtgaataccagtccctcagtgcagcattctcgtgggcttcacttctgacttccccacacttggggatggtggaggagtggggaggggtatcttgggcctagctaagttgtgtttttctttttcatttcacagggtccttctggtcctgttggtcctgctggtgctgttggcccaagaggtcctagtgtatgtacatgctgaagatttctttgcaacactaacatttagagagaatcagtccaaaacatctgttaagaaaataaacaatatatcagctagacttaatattttttaaaaatttcagtccatgctgagaattgatacaaataacttgagctattttaaatctcttatgcttgtttgtattaaacaattacaaggatctagccactttacagatagcacaactaaagcagattaccagcagaggtgagagcctagctaaaccattacatgtcctgagttacctttgtaaacgaattaagcagtatttgtggtgaagtgagtgccatttttttaaaacggtaagtcttatccatccttctgtttctttatagggcccacaaggcattcgtggcgataagggagagcccggtgaaaaggggcccagaggtcttcctggcttaaagggacacaatggattgcaaggtctgcctggtatcgctgtaagtaaactgtagccatctcgcacataaactgatcctgaaggccttcagctcagaaggattttcatattttcactgctattgttccagtatagcctatataatatccatttcccattctctggctaactccatctcactcttggaggtaatgctatttcatgccaacatgaaaggtgaggattaagggagatagaaatatacatacaataaaatctcctggtaacaatgtccttcaaccccacttaaaataaacataattagaggaatgactaatattgcactgctgaaataggttgtgaaaaaaaaattgaatataatagacataatgggagaaaagagccccactttacattttcaattttctcaatccggagtccatttaactaaagtttcccattgaatttggaaaaaaaaaaaatatgtctcttgacatgtgctctgaaagtgtgattttcctcttctgtctttaaagggtcaccatggtgatcaaggtgctcctggctccgtgggtcctgctggtcctagggtaggtggactcaagagaagacagttcatctctgaaatagaggctaaagcgagcagtgagccccaggctgctgctcccttggtgggattcaccagctcacatgtacctggtgtctgtcttccttagggccctgctggtccttctggccctgctggaaaagatggtcgcactggacatcctggtacagttggacctgctggcattcgaggccctcagggtcaccaaggccctgctgtaagtatgatttggggaaataataaagaagatcacggacctaaggaatgttttcttcagactaaaccaagacaactttgacaacccattaaagttagccccatttcaatatatcctctaaaatatctggaaattgtctatatgcaatgggcttgttaagtccatccctgcaagtgtgcctgggggctcgttatttatttatgtgaacttgattattttttactgatgagaacatgcttccgtgtgaagctcaactgaaaatctgctgccatggatgtctctcactgtaacaaaatataaagcctctcctatctcactttcacctttgcagggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggtaggtcaagatgtccagaccagactgacccttctcacaagttgagcttttcaaaattagtttccattgacatttagagtgaaaatgcatttgggtaaagattacattatgtgaaatcacacccaattaatggagcgtcatcttctcccaaccagcacccaacctcatttcccttaaaatgtatttttgcacttttcatagtaataagtaccctgatttgatttttcatggaggaggggagggaaggaactgtctaatcttaaaaatagccaccctcttcctcttaaatatggggtagacaatcaaaaatgttacttatgagagtcagtatctttcattagttattattagaatctgtgttctgctcaatgagaagtttcatgatctgaatgttattttcttaaaaggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccaggtgaggaatcccacaaacacctctccttctgctaaataatattttggtaggactgtttgttaattatctgcattttaatctctgacaaaaatgggcttattaaaaaaagacctgttcctttcctgggttccaattttgtcctaaattgcacattagaagatggattgattggacacatccatgtaattcaaagttattattcaaatttgacttaattggtaatcattgaaaaaactgactaatgtcatttagtgtgaaggagcactggccagctatatgccacactcatacatatgcattttcagaatgtgagcagcttttctgaatttttaatcaaaccttttcaccaactttactgaatgcctactggaattccataaattacaaaatgacagaaaaagaaaaatgtcagaatttctacctcctcattctcttattctaaagaagaagcatatgcaaaaaggattaattgaaacagataacttttttagatgaccttgcctcagtctagtaggtcttatgttcatctaggtaactgatacttcaaagacaagtgaattaagttttctttaaaagtacccttttcctaagcttggatctgagtctactcttcctgagatctttttttttcttttttttttttttcatgtttgactcttagtatctgagtccttctccacttaactggaatttcatcctattttctgtagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctgtaagtaatagtgaaatatgggaatagctttgggaagtgggatggagggggttctaacttagactgcccccaagggggggtctaaaggggggttaaaagaacagaagaatgagagaactaacttatttcataagtaaattcagtttttgtatgtattttatatttatttatttatacgtattaatttcgtacttaaattcagatgataaattcagagtattcttatcagatagtgccttctgaaatgctgaaatgtatactatgtccatgcattgttttttctttagcatgttttttaaatggtaatgtgtgcccagaacttaaaatttcttgagacttcagtggcctaaactataatttatagttatgtgtattttattttacttattagtatggcctacatttaacttttaatgctttttctacaatatgctataaatataagaaaaattaaaattcactaacagcaagactacatacccacccaggtcccgctcccaaagacacacatagagggacatacacacaacaatcctaaaaatgactttgtagagataggtcacttggaatgtgtgttgaaatgttgttggtttttttggtttgtttgtttgtttgttttttgttagactgatagggagcccctcccactaaagacacccttgatactgttatttcaaggatgaacttatttatctgggacagacatcttcagaatgacacatgccaaacagtggttcttattaaatcaaaggttcagatattatcagattcagaaatagtgatgctttgtgtatctattttcttctctttaaacagaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatattgagtaaaattccttgcttcaatgctctttgcaatataaatatgcatctctaccagccattagaccaagtgcctctgattagatagaaattatgcaaaaagggcagtttggtgtggtagaaagagcagagaacgaggacccaggagagctgaactccagttctggctctgttccttgtggctgagtgaccttgaaactctgagcctctgcatttcagtttccatagctataatatgaaaaaattccttttcagcactattaagcatttgccctactcaaaatatgtaatatttaagcaacatggcatttttgacctaattttactataaccaaaggtctatagaaacttttggtttattatatattaagcactttataacagtggctgaaagttggtctatgagcaattaatactattaactaaaacagtttcaaatattcagtaaaaatgccatacacttaaatctgaggcaactgaatacaatgcctgttaagaggtaatgtgtgtgctgtcaatcaggatagacagttgtggataatagtaccacgaacacctacctgccaaatcaagttcattttcctcccctgcacctttcaataacatctttaatacacttaaacatagtaatgtgtcaagtaaaatgttaagattcatttagagcttatttcctgttgcagaacataattgtgattgtaatatttgccttgtgttataagtcatctcaagattcaattagttttaaaggcaaaagactgaacatggtaaaaatgtaatattaaccttaaaaagttagcaaggtctcctaatcaaaatgcagattcctggtcctcatctgccaaattcagatttagtaagaaattgctattcttacgcatcctgtgaaattcagatgtgcaccaattgaaggaccacctgatgaggttactgccatagtcctttgtagctctaatattctgtgtctgacaagaaggaatatatatatctgaccaaaccatatataaagataactcctgggatccgaatgctggtactctctataaattagtaattaaaatgaccatgcaaacttacatgataaaacagaaatctctggatcaaatatgaactataccctcagacttatagcaaaaaaaaataaaacgcatttattgagtacctgctagaggcaaaagccatgctaaataataataatgacctttgtcaaactgaatctgaattagcagatttcctaagccaatgctcacttaataatcacttaatcatcatcagtgtgagacaactgaaaatagtcaaataaataatggtacacctaatggattacaatgaggaaacaaattatggtatatccagtaaacaatgaggaaacaaattacagtatatctaatagataacgataggatgaatagtgaaataaattttggtatcccaataacatttataaggatgatttaacaaaagaaaaacttcttagaatagaattttcaatcttgaaaatctaatattcaagaacactgtcattataattagatattttaaatatacatgtaaaaaaatgctgagagtaggcacatttgtatagaagtttaaggatgatttttaggcctaaaattttcaaatttgcaacaatgtagctatattacattattatttacaacaaatttactcttaaaatattatgaaagaagcagtcaaaagtgaaaagaatctggttcaggagtagccatctccagggaaggagtggtcaacctcccacccacctgtttcctgaagagaaggacaagcctggcctaagggtcatcatccaccatggaccagccatcctgagagaagcttgggagggtgtacaaagctctaccaggccacagcatcttcagggagctcagggagcttatagtgcggttccagaggcagaataaaataatgtgtgaacagaattttaaattacatatcctctgaggataacagaagacactattaattaattagagggagtctcggga

SEQ ID NO: 14220 - DNA, 23902 bp, Human
cccaactttctgggaaggggcccaggcaaggcccaagaatatcacagtctggcctgcacagagtgaagaaggagaaaaggggaggaacctgccttgggaacttgtctcattcttggctctgctctgaagctcctgctggcctccctcataccaagacctgggcctgcctttccttcttgcccttctggcttctctctaataatggctttgggttggtctttggagctaagatacctttgctcttgagcaaaaggttctggaagagggagttgtcctttacatccacccctgacctgctaaggatgttccctagctgaggcaggtctacattctaaggaacgattagtagccatgatggcaagactgctttcctgagaggaaaagccaggcaccatggcagcagatgattaccgtgagggcccagtgaaaggggcctgatcacgaaagctgagaaagtagtggccacccctctgggccccagggacagggaaaagagaagcagccatgacctttggctctaggtattgggatattctcagggctggtggtcggaggttgccttctgcacggaaggtgcctccagctccttgctaggtgccgcactgaaggaaaggggccagcatgactggtcggcagtccagatttgcaaataggactccacgagttgtggcacagtttgctctgcacgttttctgccctgtggacagggtctctagggttctctcgagagaccagagaagccaatgaggtttgaccagaggctctacgacccagcaaagctaaggccctagccttggcagtccgtactctgaaataactcaatcgggaaactcagggacttgaaggcctggaagcccaggaataacaccctctcgagggagagacaatgaggaagaagccatggccaaagcctagcagggatggaggtgccagagggaacagaaacaaccaaaatgatcccaagaagtcaacagtgggaggagagggaaaggcgccaagtcttagaatgtgtgtctgtgggtgcagaagaggggtgctctgcaggaaatgcagttgaggcgctaagaaggagaatgctgggaaggtcctggcgagagaccgagaagcctggagggctcaattcaccacgagtagctgtttggggctgaagagagatttgggtcaatctttagagaagacagcctctagggagagtctttgggagggtcccctcaaggtaaagggacaggactggggtgagggctggatcccagcgcaggaggtggagtgtttctgggtctcaggcaacacatttgtgttacgttacattctcacaacaaccatgagagggactgctattgtcccatttcacagataagaagaccaaaccttagtgctctgaagtcactaatgcaaggccccactgcccagtcacttgtggagccagtgaattcacaccacctgactccaaacctgtacactttaagagcccactgacatcctctcctttctctgccttcctccacgaccctccttttccgcctgccttcttggtctctgctgcggggggccaacctggaccttggggtccagtgtcctgccattagtcatctgatacccgggcactaagcccaaccggagggacaaagcccacaccggccacggggtggaggagagtcgatgtcggatttagggcggggctgaaccaagcccagggccgcgggggccgtggcttcagcaccgcggagagcgccatctccgggggcggggctggcggggtgggggcggggcctgggcggggcgcgcgagaccccggccgggtcccgggggcgcgcgcggggcgctctcgccagtcccgcgggccgtgcgcggtgctgtgccgcgccctgccagacacaggtgcgcccgcctagcccgaactccgcggcggcggctgccctctcgccgcgcctccgcctccttcgcagccgccgcctcctccgcgccgcgctccgcccggatggccagggctgtgcccgagaatggcggagcgagaaagcggcggcctgggagggggggccgcgtccccgcccgccgcctccccgttcctggggctgcacatcgcttcgcctcccaatttcaggtgagagtccccggccgccgcgcgcctcgcccttcagcggggactgatccgcattggctgccctgcccgccccccaccccagaacctcgggaacccgggaacgaaagggctgcgtgggagtggggtctcttcccgggacagagcccccctcagaagccccgccagcctcaagtccggactggtagccgttgcatgttcacgaggctgttccctccgccattcctggtcctaggctgggaggtctgcgctggaattggaggagggggctcggaggcctccttctccccaacctccgggctgcggcagggtctggggtcggggttgcgatcccggagcgggcaggcaggctgcatcttagcctgtgaatagagctgggaacagcctggaggggcgcgggtcgcagtttcctggggcaacgacattgttggtgctgggaggaggatgtttgagcccctccccgagccctgcctggccagatgggcctacctgccaggcctggcgtggccgggcccctctctggattgggcagcaccgacctaggcaggtgtgtctctcagggcaggcgctgaaggctcagcctcaaccaggggaatcctaggcccggctgcgggaagggaagtcggctcggctctggagtagccagggccagcgagggtgtcgaggggatccctgctggggtaaatacccagaaccctgacctgagctcctattccaccacccccaccccccaatctggtgttaggcccgatgcatttcagagaagtgaggggtgagtgttgtgtggaggaggaatagatgtacctcccccataattctgaaccctagttggtggggaggaagaggccgaagtcactgctcccggcctagagagggaggcttagacataccccattgtttccccatctcgagaactggcgccttcccctctcctggggcaccaccccagccaggctccagctgggctgtggtgccagcccctcctgggagcaaggggtcactggctcccaggtcctcaggtgggcagagacccctggggatctctaatagcatcatcaaactcagaaaccttccctgaggccctgagctgagctggaaggaccagagggggccagatggaggaggccaggcctgaaggctccagggctgcagctctctgataatgccttagactgaggtctgagactccacctggcatggtgcatgaggcctccatgcaaatactgcctccccacctggaggcctctgcagtggaagcacatggggcttagagggacctgggttcaaatcctagctccactactttctaactgcatgacccaggcaggtttttgtcctctctgggtgccatctgttaagtgggctaattaatattgattcttgcctggaaaggagaaaaagcacatcaggtcagtgttcaacaagtgtcagcccccacactagcagacaacactacggctcgctgctgtccagagtgtcttcccaaggcccctcctttaaccctcataactgccccaagagagggtagtgacctgcccattttatagatgaggtgattgagattaacaaaggcagggtggctcatctggagactacaaaagagtcagagactaaggctacactgggacccaggtctgtgcgtgtttagtccactctacgtcccagccctgcctctggcccagtgggcagcttttcttcctcgacctgcttccccaggtgtcatagatgctttaatgagaggagctgaggaagcagacaccagccagtgaatgtgtggccagctctgcggcatgtgggacaagggtggcagtaggccacgaggctgaggtgtgggccagcactccagaacatggtggcctggctgcggagacaaggccagtgcgtgggaataataagcgtcagtgtctcaggccctgccggcctgccccgctgctcccaaagcccccgctgccctttctcctggcccgcctctcactgtgcttggccaggctccacttaaccctgggtgggtagatagtgctttcttgtggctctttggtggagtcatagatccaactggcctgggtttgaatcctggctggcccttcttacctgtgtgccctgacactgggcacttaagccctctgagcctctgagatgccagcactggcccctgctcaggatggtcctaagaatcagatgagataacacgtgttgagtgtttcaagggctgaggagagccgcctgtaggcagggctgtgtgtgtgcacacacacacaggcgccttgacccccagtgccactgtcagctcccagaaaataaagggggtctgtacccaaactttggtatccccattgctcagcacgggatagttactcaataacagtggtaagcgctgacatttggaaggcactcagttcgcccaggcaccattctaagagtttcctatgtgcaagagtatttactcctcccaataactgtatcaacagagcgttgttattatccacacttgcatgaagaaactgaggcagagggaggttaggtaagtggcagagcttgtaagtggcaggcagtctgatgtcagagccaccccaaaaagaaagagccctagagtattggaagagcatgtgcggagggggcgagcatgtggacctgacctgaaggggtgggagcattcgtttgtttgtggtaggttaaatacgtgttaatttttgttctgattatagctccagctgtttatagtggttggttacctttgggtatggtatggggtgagggatttttacttcttattttacatactttttttttttgagacagagtctcactctgtcgcccaggctggaggttggagtgcagtggcatgatctaagctcactgcaacctctgtattctgggttcaagcggttctcctgcctcagcttcccaagtagctgggattacaggtgcccaccaccacgcccggctaatttttgtatttttagtagagacggggtttcaacatgttggccaggctggtcttgaactcctgacctcaggtgatccacccatctcagcctcccaaagtgctggaattacaggctcgagccaccacgcccagtgtcatacttttatattacaggttgagtatgcctgatctgacatgctttggaccagaagtgtttcagatttctaatttttttggattttggaatatttgcatatgcataacgaaatagcttggggatgggaacccaagtctaaaaatgaaattgattttttcttatatatcttatacatatagcctcaaggtaattttatacaataatttaaataattgtgtgcatgaaacaaagttttgattacaacctgtcatgtggagtcaggtgtggaatttacagcctgtgctgttatgttggtgctcaaacatttaggattttggagcatttcagatttcaggtttttggattagggctgctcacctgtatttgacttcttattttataatgagtataggttacttctgtgtcttacaaaataataaaagaaaattcaaaattaaagtgatacatgttcattataaagaaaactctagaaaagagaatttagaaatttacacagtggagacattggcactgggtaggtgggacaaagaggaggggcagaaggacagttcacgtgggaggaacagcagagacaaagggggtttcatggacaagaagggagcgagcggcctgtctggggtgtgtagaaggggaatcgtggatctgagagaccttagagaccagctcgtccaaccagctccctccccttatgaggaaacaagagagggcgagtggctcccccaagagcacacagcaaattagtggcaaagctgggatagagccaggccatggctgcctggatggttgccatctgccccagcaccctgcctcagggatgagagatggggccaccgagaggcttcttccttcattcactcaacaaacgtttgcactttgcctaggtcaccagggaaacactgcaaaggcccagacgtgggcctggccatcatgctattggtgttgtagaggggagacagacagacagacggctttacagatgggctggtcggtgtgatgatggctcaggtcaagggacccaggctcagcgggtctagacaggccccccagaggcagggacatttcagcttaggcctggtggacgcataaaaatatcacccaagggtgtcactggagtgaagggcggagaccagagcgggtgggcagggtgtctggtgcccagtctggcaggagggtggagagcaggatgtgcaggaacttgtaggccatgtgacgatgccgacctcttcaccaacagccagaggagctggcagggggttaggaaaggaatgacagggtcagacagatcctctaggacaggggtgtccaatcttttggcttccctgggccacatggaagaaaaattatcttgggccacacgtaaaatacactaacactaacgatagctgatgagctaaaacacaaaaacatctcataatgtttcaaaaaagtttatgaatttgtgttgggccacattcagagccgtcctggggctcacgcacccatgggccatgggttagacaagcttgttctaggaggatcacctggctgctgggtagagagcggccaggggactagccatcctgctggtaagaaggagggacaggttcagggtgtgaggaagagttagggggcagattagcctgcttggtgagggatacagaatagggagtggggaggcaggagtctaggatgatgctggggctccttggtgggtggggtgtccagtgggagaccagagggcggtgggcagggtgtgaaaatcatgtgggaacctgctgaatttgagactggggatcattggaggacccaattggaggattcatacagtcagtcggttttgggtctggagctcagaggagaggatagggctggggccaaagaccctgggagtctgagtttggagggatggccactgaagcctcagagaggacatcactgtccagggagactgagcagagggcaggaagatggctggccggtggcctgttcagccaaccatgtttcggtggaggtggggaggtgctgctggagctgcctcatgcccaggaccgccttggcctggctcctgatggaccttggatgtggaggcagagagtgttgacttgcctcacacagtccggcagtggccagggcagaatttcaaccccagctcgctgatggcagagctttaaagttcgtctctggattgctggaaatgggccacaacacacttctagcttggggcccccatggttcccacaaattgggtcacagccaccatccacacgtagttcttaatcattctatgatgccatctttgttccctggccccactcttgtattcattccaaaatagcaggagcgtctctgggtgctttgccttgttccgccactggagatgccagtggagagctcatggctcctgctgtcatgttgcttgcagtgcctctttaataggcactgatttagcacctatggtgtgcagggttttgggctttgtgcatagattggagcaaaggtggggagtcagtgcccaggtgagtatgatgaccctgccctcaggaaacttgcagctctggggagggcaggcagcccagcagcagacggggagcccatgctaggctggcatgacccaagatgaaagtctgtgaaggacagcaaaggagaaaagagcgccccagattctaccccatctcacaactctgtgtccatgtgagtgtttcttcctgtgtgcaatatcatcctggggagaccactggatcatatatgctgtctttttgctcattttattagttgtcaccttaatacacagactttataatgttgattccaaaagactgcatcacatttcatctgctgatggccacgatggaaccagccccctggtgctgggtgacgcaggtgttttcagttgtttgctgtgatgaggaatgaacatcctgtgtgtaacagttcttctccaaacaatgtgggattgtttcctcgaagcagtttcccaaaagtcgaacaactggatcccagagttcttgcaatgtatcagcatgaagatgtttaaacagatcaaacatgttataaccgcaagtggggttgtccctcggggctcatttctttggttggattcagttttcgttggagatgacctccgtatggaggtggtcaggaagggaattctgacccaaagaacaaacccagcccaaccccatgttcacccagagccaggtggtgggggtagagcgagggcctgagagggatgctgggtctggctcatccccaccccaccgtttcagccagcaccgtcttcccagaggacctgacatcctagcccagactctggtgtaggtggggacacaggaagttgattggaaaagtggactaacttagagatttccaaggcaaaaatccagagagccctgggacacctgtggttaattcattcagcatttgtcaagtacctattaggcaccacacatgttgatcaaaacagatatgatcccacccatatggattaactgactccaaggggaggccaccgcgggccgcataacccaaaggtaaaattacagtgatacggaaccacagccaggagggactccgagagcccatagcagggcggtttggcttggtcccagaggtcagagaaggcttgcagaggagaccatgctactgctttgggagctgcgctattgaaggaggagataaaggtgggaggtggggggaatgaagggaaatgatactggttggagggaaaggaggctttacagagccttcaggccacagatgagaatttgggccccttctcctaaggaccaggggaagctattaaagggctttgagctgggaagagtgaccagaccagatttgtaattcagaggtcagctttgctgtcattacctggtggagagtggctggtagaggaaccagagggaaatggggaacccacttagggttgagcggccagtcaacaggtgtcctgagaactcactgggagccagcttcgttctcagcacttagagggctgcaaagaggcaggctggatccctggaccacacgtgccctctgtcacaagagaggcttgtggggcattgtggccaggacccaaggtcaatcagctggcatccttacctcctcaccacagcacagccaggaacacaaaggcccaagaatgacatccgaacagccaatgcctggctcagatttggccttgctcagctaaagcctcagcactttaccacttaacctttgctttacatacacttctaactcagcctactacggagctgaaatagtccgttagaaagggcaggactgtggttggtggaaatgtgacccagcaaggcaggggaaaagggcctgaaatcaacatcagaacacaaaaggcatgtttgttcagggccatttagaaaagtgcagctcagggtggggtgggagcaggagctggtatggcgagaacagtgaggagctggcagggcaaaagcaaggactggggcagcagagtaggagggatcaggtgaatgcaggaacagggcctcaggtagaaaggtcagggcggtctccagagaccaaactcacagctcagagccaccaaacgttaatatggatgacgtctcaaggatcacagcatccaggatagacaagcaggtctgatgggtgggcaggggctgcttctacaggagactgctgaaacttccagacccagaggtgagggaggccggcctgcggagggccgtaggattcagtttggaggcctcctggtgctaaggctgccatgagcagggtggatcaggcgggacaggagggaaccgccctcttttccccttcttcccctcccttctcccctccatcttttcctccctcctcctttccctcccttccccacattgaccttccatgagccttcagggaccaagtgtctgtttagccttctctccataaagggaccccccagggttttagctgggaggccagaacatctggtgcctggaaaagaggaaagggcagagtcttggatggggggtgacttgcacagggtactctttgaccaatcagtcccccttgatccttggtagtgacctcctactcacacaaattccattctgctaaccctcaccagccctctgaggtgggtgggcagggattggtggcttcatcctgtatctgggaagctgaagcataaggcacctttatgtctaagccttagtgttcctcatctgtaaaatgggaaaaatggaacaaaccctctcccaaggttgttgcaatgaggattaagagagatgcatggcataaatgttggggccaagatggggcagcttcaacgtgaaagagtcaggatttatttcaggcctcctgcttccaagcctgatatggtgatcattcttccatcctgccttacttatgagaggcacctaaaaagtcagacaaagcatcccccttaacccaccccagtagagccagggatcaggcataggctctctgacccccagcccagtattctttctagcattgcccaattaaagcccagtgccctcagctgtacaggaagaatgctgctgtccttgccccacccagacctattgtccaaggaagtgggaatatcaggtgatgttgagggtgtagaagtgaactgagaagcctctaacccaggtctaagccagaccctgcaggccctgctccagcctgcagttcgagaggagcaggtggaggcagaggctgtcctgtgacagacatctagcaggctcatgctgaggactcagtgtatgcaggatgaactcgccagctctgccctccaggagcaaggggaggaaggggtcttgatcacctgctgggtacagtatagggtcatcaatcagggtgctggatacaggccccatccacctttggagcagccagggggtgggaagtgggtgtttctgagggagggctggccctgtctgctgcacacactactgtacatccaggcagatggtgacatcagccacatgcaagggctgggagggcttcctggaagaatgagcttaactgagcactcttccagcaagcatggtttgagagtctgccacgtgctccctctgagcactgggtttggcactggggagacacagtgcccacgcagactacgcatggagctggaggccttgcctgcaggcacaggaacctgctgctagtggagagccttgagggttccaagtggggcgggagggatgatggcatttctggcagttttgcctgatagtggcaggtggagtgggatggtgcaggcatagggagactgagacagacaggccagtggggacatctgggagggcagaggcaggagctggactagggcttggcagtgaggaagcggagccatgtgtgaggagacacagatgtgtgcaggggggctgggcaccatggctcacgcctgcaatcccagcactttgagaagccgaggcgagcagatcacctgaggtcaggagttcaagactagcctggccaacatggtgaaaccctgtctctactaaaaatacaaaaattaaccaggtatggtgatgcacacctgcaatcccagctactcaagaggctgaggcaggagaatcacttgaacccaggtggcagaggctgcggtgagccaagatcatgtcattgctctccagcctgggtgacagagcgaaaggccgtctcaaaaaaaaaaaaaaatatatatatatatatatatatatatatgtgcagaggtcactggcagagcaggggcatttcagggcacctctgggtcagcggtcctgcagctctcccatgccatctgagtaccaggggctcccttttgcaccactggccttctcggtgaccatctgggcaaccagtgtgaattgaacacttacttggtgctggccactgggtttttgtccctgagcctgagatgccaccctgccctggccggacggaggagggctgctctggcttctgggccaggccctcctccccacttccaccccagctggccagccacaccctccccatggcctggggaaccaccacccttgggctgcaggtcagacgtgaccctacagggcaccttgtccatccagcccccattccccacccctctgtgcagtgccctccaggggcctccaggttctgtttatgtcattccaaagggagaggaagctcattaccacacagcagcccttccagctctgctctaagggcccaaacactggcctgcccttagctgtggctctggtgcctcctgcttccataggccctgccttcctgggtcctgaaggctcaagccctggctgcagaaggaggcagcccagatcaaacccagtttggatgcagcctgggcccacagaagcctctctgatgaggtcggggggctgagcctatggcagtgcaaaccgagtgttcattcttagggtgtttgggaagccccccttcatctcccacctggcaccctgactggggaactggccctttaaagccaaccaagggctggcttttggggggaaacatcctagatttctgccatctacttacaagcctgggccagggagggggggccactcagcccccgacaggggcattggaagggcaggtggagccagtggcattgattgcagtaacctgatcccgtgagggaggcggccacagcggcagcagcgcaagggccaggccagccgggaggaaggtgcctgcagctgagggctgcgctgggaagagctggggctgggacccgggtcggcagctgcagcctcctctcctggcctgtctatttttaatgagctccccaggcttctgcagcaggcaggacgcagaaagacaggcccaagcggtggaggccagaggcccccagccctgccttgagccctggcccccccacccttccgggcatgagagggcagccctggggccccgcagccccccggccgggcagggctctccatgcagctggtgctgaagatggattcgagcccagacaatgacagctggttggaggatcaatgggagcgctggtaggggctaccggggctggcgggggtggagaccgagttggggtgagctccatcgagctcagggtctctgatctgaatgaggcgagtggcagggagtctgggcctcctaggttcccctgggggctaagccaccatctctcctgggtgaccttgaactagtgggtttcccttgctctgtgcctcaatttcttggacttatttgggaaaaggctcatacattctccccaacttcctaaatgttctacccccccaccacccccccagcaagccaggcagagtgcccaggacctagaggtgagcaagagacaggctgccttgcagtggctggcccagccctgcattctgaggtggggactcagggctggcctagggagaggggggttctagtggagctggttagtattctggtgccctggtgctctgagctgtctcccaaggttgtaacacctctggtcccacctggggcttctcctgaccccatctgtgcagcctcctgttcagggtccttacactggataaggagaagatgttgtggttgaagagatgagaccaccaagtgcacagcatgaggctggagtcctttctggaataggctgaaactacccacactgacaccagattttccttcgcttgttccctgggctcaaggggcatgagtcttcctgagctggggcgtggggcactcctctgaggctgctgccggcgcctcgggtcttgctactgcagggattgcactgggagctcccctactccaggctgctcttctcaagtccacattctccatggtgaactggccttggcacctgccttgaccctgggaggaggctctgaccagttgggccttctaagcactgcctgctggttggcaacagaatgacagcttccagggaggagccagagtgacctggagcctcctcttccactgccaccctaggaggactgccttttggcacaagcccctcgctctttccctgcctgctgaccaccccctgcattgatacagatgaaccccaaatcctgtcctctgggggctgtgtttggccttcaagaggctgcaccctggaagaggtaacagggagatgtgagcaggcatagtgcccctgagttgtaactttggcttcctgtccccaccaggctcacccatgacatcagcctggaggagtttgaggatgaagacctctcggagatcactgatgagtgtggcatcagcttacagtgcaaagacaccctgtccttacgggtaagggcaagctcccaggagctcctgagtggggtggcaggaaggctagggacaggggtaagggtatccccatagtgacaaagggggtttcaggtctgtgctggcaccctcatgaaatgaaatgatgtgcaagaaacataggtatactgcttggcacgtcttgagtgtacaatcagaatttcatttggtattattattattattactgctgtcggggactaagacaggaagtagctccttcaactgcccacgagatgggagaggccaggaagtcttgagacctagggcagtaacaattaggaccagacttaagggagactcagggctacccctgaatccttttgggagcagccctggcagagggcctgaggcagacagggtggagtctggtggaatctgcagtgctttagggcaggaagaaacagccaaggcacccctggaatagctcctgtggctgctggctgctattacaccagacagatggcaccacgcggcctcccagaccctctctggcctatagtcctaaaggcccccactgaggggtttgcccagcattgctgctggtttgggccccttggctttgtcatagggaagatggctctctcctgtccctaaagatctgaatgctgccaggaggtccccagcacctgggtaactggggtcagatggggatcccaactatgtcttttcagaacaggaagaaggggccggcttgccaggaaatggaggacagagcacagggctaggttttagagcccagagctcctctgagcccccaagagggcgggtagccagatacggtgtcaggagagtggttaccataggagcgtgaggtgtgccttggggagggagtacctgtctctgtgttgacctcctgctactcccagagactcagtaagctctgcaagaggaaaccaaggggtgaggataatcccctagtccccagtaccccaaccttccactctctggccaggccaggaagaggcagaggcctctagatttggggaatggtctcagagccctgacttagcttctcagaggtcaggcacctgttctggactctcaccctgccctctcccccagctgcaccagcagagccttggagagggttgcctccgagctaggcaggggccccaggcactactggccagaggtgtgcccctaaggggcctcagacaagctccagcgggcttcacacacgttccagtgaatactcagctctctcagaggctgggaggcagtagtgttatccccactcaactgatgagggggcctgaaggatcaggggatctgtccaaggtgccagggagttggcggcagaactggagctagatggggctctgcatcctcaaggcaggctcgtggaggaccgatctagggctggaggggccccgggccagctggcttagggcgcggctgccaccgccttggttcctggcccccgctcgcccctccccctcggcgtctccttcccatccctctcaggtctccgccgttccttgcttggctgagcctcagtttttccagttttcctcaagaccccttcaaatactatttccccaacccccatcccttgcccaccccaccccgaactccttggcgaccactgagtccccatagcaacagcggtgacttcactctgggctcggcttacaaccccggtgaggtcaccggccgttgccaggggaacgggagggcgcaaggagtccggggtggggactgtggggaggtgctggccgtcagaggcacggctggatcggggaggcggcggcctcgcgcttcctcgcggcggacgggcgagagcgccccagtctccggcggcccctgctcggctcccctcgtgcccccttcgcgccacagaatggactcgcccgggcggggggcggtgcaagcggcctcggccccgccccggccccgccccctgacgcccctccgtgcgctgtgcagcccccgcgcgccgggctgctctctgcgggcggcggcggcgcggggagccggttgcaggccgagatgctgcagatggacctgatcgacgcgacgggggacactcccggggccgaggacgacgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgccgcggtctcaggtgaggcgccaacgtggggggcggcgccctgggccgccgcggagatgtgagggggagcgcagaggggctgcagcgggaaggggcacccacgggtccagtgcctggggacagcgcctgcataggggccgcggtggctcgctcccggtgttgggatccgaggagcgggcagaaccatccttacgaagagggggctgagtccagctggccgggcttggagccttgaggcgggattgaaggagggaaggactggggttaggagaggagtagggaattaagagaatgaggctttgaggggttcgaagggtttggagcctgggacctcaggctgtgacagggtttctcctttaggatatggggctcctggtgaaagtggagcaggagcagggcctggagaaaagggcatctgaaatggtcatcgtgggggaggccgtgggagatcgtggcgaggtggggatgggaagctcaggggccacagccagtttaagatctgggcagctgcgaattcccagaaggcaggggggaggaatgggagatggagctgcttggctaagttggggacctagggcccctgggagggtggctggatgccaaggagagttgaatagggttgggggagctggctgtggccctttgtcttccaggcccatcgggagcggtgcaggcaaggagctcctgggaggtggggcggctggggctgcggggaaaggcttggtccctttcccaggatcctgtgaatggcttttggcagcccggctcaggaacgtgagggcttgggagagagctcccaggggagggagcctccgtggagtggagggagccctgtgtgggcattgtggggaggggtcccagggctgagaatgtagaatgggcagcccaggagatccaggaaggagggctgctgacaactgcatctgtcactcctcagtctcatgccactgtggtggggggtgcaggaaaactctgttatggatttgtcactgggatgattcatcctggtcccccaggccagctgctagggagacccttccttgtgctttttccaggctctaccagaaggtcctcaccccttctaggccataacttcccaagctccagagcagagagtcacctgtctctgacttgggctggatttgagcattttccaagtaaccctcagtacctgggactgggggtctgactgtgtctccagagagctcctgcttctcttctcccctgcctcctccccctcttgccaccacacacattggccatcaccacctttgttaaggctgataagagcatctccctgagggttggccagcttccctgagcaaggcggagggccatccagagccggcaagcctggctgtgacttgccacccttcctgcctgctccagaggagagttacgagtgaggcctttgacagtggaggcggggtggacacagcaaatggccctagggatggcctgagggggcagggccggggcctccctgtgccgggcactgttgaccacttccatcacaagagccttttgttccctgcacaggacacactgaataataattctctgggcaaaaagcacagttggcaggatcgggtgtctcgatcatcctcacccctgaagacaggtaagtcagggccctcttccttacctggacctccgcctgccctgactcagtccccactacagagagcaaaccctacagtctccaaagggctgagtagaggtgaactgcccacccacatccctgcacgagcccatccaggggctgagatcagtggtggcatgagtgagttgactggccccagagcctgcgaagggcctgttgcccagggaggctttgtcttggtttctgtgtcaccaagctgagagtggcaggtgcaggtagctgggagttgggagagagcccctgccttcatgacctgcctgctctccaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgagtcagcaaggggaagcagtggggtgggggggtccctagcgggggcagagccaaaatgcgaagtgttctgggaggcgaccccaggccccatctggttaggactgaggcttctacctgccccgctaaacctggatcagagctgcgaccccccatccagccacaccacctcacctgcaggtgctgagtccttcgggctgttctcctgcatcatcaacggggaggagcaggagcagacccaccgggccatattcaggtgagagccatgggctggctgggcctagccaggcagcagtttgggccacacaccaccctctacttgtcacccctacatggcctcagcctaacccctgccatcagccttcatttatccactcagccctgggaggacagtgtccactctctagggactcagagtatggtgacaaagaggatggctacagtgagggatcccagaactgtgcacctagtctggccaggggcagggcacccaggagggtgaccaggaggatgcctgcccacaccccacctgacccttctctagacaaaagcctgcgcttcccacagcctctccattttagagggggccctgcccacaccctcccttggcctgtgtttcctcgatggcagatgcatgtctgcttgaccttgctctcccctggggttagtactgcaacaggcacacaggatgcttttgcaaatgtttactgaaataacgatgctgctgtggctcccagaccccagagtaggcctggctggacaggccttggtgccgaatttctcacctgtccttgctggggacaggtttgtgcctcgacacgaagacgaacttgagctggaagtggatgaccctctgctagtggagctccaggctgaagactactggtacgaggcctacaacatgcgcactggtgcccggggtgtctttcctgcctattacgccatcgaggtcaccaaggagcccgagcacatggcaggtagtgttccctccctggcctgtgcccccagccaccacatctgtctgccccaacttgctgctaggtgaacgtgtactccagatctcagccagccaggtggggggctgagtggaagtgattttaggtccttttcacgatcaagcaaagtgaggcccggccaagttgggcagccagggattgtggcagcctctgtgggctctgccattccccgtgcctcacccaccctccttcacttggctgctcagctccctcctgctctttctgcccctcctcaattcacgcttgctttccagccctggccaaaaacagtgactgggtggaccagttccgggtgaagttcctgggctcagtccaggttccctatcacaagggcaatgacgtcctctgtgctgctatgcaaaaggtacctgagccctctcccttctcctcccttggatgggtccctggggcagagggacgcaggtgtctagaggcagtaaagggctcaggccctgggacaggagggatcagcagaggaacagacagcagctgacgtggctccatttgtcacctgtagattgccaccacccgccggctcaccgtgcactttaacccgccctccagctgtgtcctggagatcagcgtgcggggtgtgaagataggcgtcaaggccgatgactcccaggaggccaaggtgacttcttccaacccagccccttccttccatggccccaagctctcccccaagacttgcgatgaagaggccatctcctgtcaccctcactgcaggccaggtgaccgccctcttgcttcttttctccctcctgtaggggaataaatgtagccactttttccagttaaaaaacatctctttctgcggatatcatccaaagaacaacaagtaagtgggggtgggatggcagtggaggaggcacgggtggtctgcagccttgaggtgggtgggtgtgggccgagcccccgtcccagcacagacagacctgtccctgcaggtactttgggttcatcaccaagcaccccgccgaccaccggtttgcctgccacgtctttgtgtctgaagactccaccaaagccctggcagagtccgtggggtacgtgtacaccctgctgagcacccagcccgagggagcacgcccaatcccaggccctggggctgcttcctggcgctcagctttgcccctcggtttcccccgcagctctggagaactatctccggaccccagtgcgggtggcctggagggagggtggcgcggcagggtgagcctgaggagcagcttccaagcttggtagctgttgggccatgtcttcaactgacatcttactgggaaacgcgatggcaattctgtagagaacagagccaagtggccccagccagaggaaccagagctgcacttgggccccaaggctccagcgggaaaaccctgggtcgggatcctgttcctcccttgccagtggcgatctgagccatctgtgtgtcccctggcttctaggagagcattccagcagttctacaagcagtttgtggagtacacctgccccacagaagatatctacctggagtagctgtgcagccccgccctctgcgtcccccagccctcaggccagtgccaggacagctggctgctgacaggatgtggcactgcttgaggaggggcacctgccaccgccagaggacaaggaagtgggggccgctggcccagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccttacctcccctgccagggctcgggcgctgtggctcctgccttgatgaagcccgtgtcctgccttgatgaagcctgtgccacctgcaagtgcccgccctgcccctgccccaacccccaccgaagagccctgagctcaggctgagcccagccacctcccaaggactttccagtgaggaaatggcaacacgtggaggtgaagtccctgttctcagctccgtcatctgcggggcttctgggtggctcctgccactgacctcaccggcatgctggcctgtggcaggcctaggacctcaggcggggaggaggagctgccgcaaggccctgtcccagcagaagagggaggcttcctgactgacacaggccagccccatcttggtcctgtcaccctggccccaactattaaagtgccatttcctgtctggactgcagtggatgtatctgcatgggcccctcccgtccccgtctcgctcccagcccaggaaagccaagcctttgtcacacatggtatctttatgagggccttgggtcataggtgtgcatcatagtaatactcggcaaggtcgggcccgtcccgcttgcgctgctgggccctagacaggaggggtcgaggccctcgcggccttgggtgcttggggaggatgccatagtctaaagagagaaaagagggcatgggtggtagggggcagctggctctgatggaactgaagtcacccttgaacagatgtggtttgggatgacaagcccctgaaggctggacttggggcacctcttaggggcgtctccactgtcagggatgggtaggggaaggggacaagagagatactaccatccaccaggccggaaagtggctgcgagagttccaggggggcggaaaatgcctcaggaacagaccgctgagacctgtgggagatgtcggggtgctcagccctggcccagaaggccaccgccacctccttgtgaatggggggatggctcagtgtgggggcacttggcaagccctcgaacgcccagggtaccagggccagccccactccagagaggggaggggcagcacctccaccatccggcccaagtgccctgccctctgtgccccaggagtcacctcagaggctgggagcgaagcagtgccactgccaggatgaggtggaggaagaggctgagcccagcccgggggtgcagagcccccagcatggcgagaaccatctcctacacgggtcctggctcctgtcgtccctatgctggcaggacggaacccgttgccggctcccagggccacctcacaaagggccttcattccaagcctgcgtcagcacctgccctggggcagggccagcagtctcccccgaggcttgtttttgttcttattgatgctgttggctaataggtgccaaacccgatcttgttctagtgttgctgtccaaggaataagagcacacactgtggagtcagatctcagttgaggtcctgaccttgcctcttactagccggacaagtcacttcatctctgtgtgccggagtttcctcatctgtgacgtagtccattacacaccctacagacataggccctccgaagagggcaggggatcctcaccacccagagccccagccattcctacagcaccccccccccacccccactggcatggcaggaggtccgagcaggtcccgccagctgaggag

SEQ ID NO: 14221 - DNA, 49011 bp, Human
  misc_feature (1)...(49011): n = A,T,C or G
tctcatcttgaatgataactcccacaattcccacctgtcatgggaggaaactggtgggaggtgattaaattatgggggcgagactttcctgcgctgtttttgtgatagtgaatgagtctcgaggatccgatcattttaaaaatgggagtttccctgcacaagctctttgcctgccgccatcaatgaaagatgtgacttgttcctccttgcctcccgccatgattgtgaggcctccccagccatgtggaactgtaagtccattaaacctctttattttgtaaattgcccagtctcaggtctttattagcagcgttaaaaatggattaatacagcttttttcagagaacagtaaaacattgtcttggttcttgggtgagtaagagcagaagggacacttttggtgccgtggcatctcttggcagagaagtctaatttcactgctaacttgctttgtgagggtgcatttgtgacaagaagaacaaatagatgtgcaaagaaaaaaaactcatacacacacatataggcatatccatgggaaattattcagatccttctcctaccccaaagtgcctaattattcaaggcttgactcaaatcccgtctacttgaaggaactaattgattttatgagcatatagtccaaaaagatttagtttgtctggcttcagcaatgcctacctggagaagtgacatttaagctgagatttttaaactaagatctaaaagatgagttagccagcgaagagttgggtgaagcagatgttggctcaaggggttttccaaactcagggtgagaagtccctgagtttggagagtgtggtttatttgaagaactaaatgctgaagtaagcaaagcagagtggcacattatggggttggacaaagagatcgggaaaccagggctttatagtatgtattaagaaactgaattttataagagcaaagaaaagccatggaaggattttcaggttggcaaatgacatgatctgcttttcaattaaaaaaaaaaacactcaaactcttgtatggagaatggattaaaagggagataagggctgaagtgaggcagccattcgggaatctactgcagaaggaggcagcagaagagatggagcagagtaaatgagacttgggaaatatttaggaggaagaatcaattaagatttgaggatcaggtgttgcgaggtgagggagaaggcaatgtcaactatgaatcctaggtatctgtcatgtgccatttctagaaaaagagcaggtttgaggagaaagatgtttggttctgaacatagtttgtagagctcactgcacatacaagtggagaggcaagtgggagttgtaggtgtgaagcccagaggagaggtgtggacgggataagcatttaagactcctccatctagaaggaaactgaagctgtgggtgaggtcatcacagcacagcgtttaggagaagcccaggtaaagaagctgacgaatgtctggaccctgacaaccttaacatataatggtttgatagtggaggtggaggcaatgtagaaagaatgccagaggcaggaaaaagcaaggaggatgtgttatcatcatgaccaaggaagaaacgtgtttcaagaacaaaggcgtcaactctgccccatgcttccgagctgtcaagtaaagtgagaaaaacagaaaagcgttccctgggtttagcaacacggaggtcagttgctaaagggagcttctagaatgacggcgtcgccgaatctgtcctctgcctggattctcggcgatgaaactactacagagacctccaagttnnnnnnnnnnnnnnnnnnnnccccgccggaagccggcggaaataccccagcgcgtgggcggagcagcggcccgcagagggaggcggtggcgcccacggaacagccgcgtctaattggctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagagtgagtggccgtgaggttcccgggtgccgggggtgggacgcgcagggacagagtcctcgggccgtgcagttggacgccgggcgaggacggcccgtctgtgctgacccgcgaatagtgatcccagaggaagaacgcgtcctgagtattccaagtgcgagcagtgccacctgttctcggagatggcactgctcagcacgattgtccttgccagtcgtgctctggcagtgaagaggacttgtgaaatataattttcctctagaaggcactgcaccttcccatttaccgtcactttctcccgtttccacccctttccatcagtcacgttttcttcttttcgcagaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggtcagtaaatgttcatggaatcagatgaatgagtacatgacttcggaatcttaattatgtttctatgttcaaagatggaagggcttaatgtcttcctagagtttaaaagtgatgtttagtttttgcagaccccccaccccaaaataatatagtcttaaaaaaatttctggccggtactgaagagttctgtggtaggtatgcagaggtgtggttgattgtgctttgaatgttgtttgtatagataaggagttattttcatagaacagaaacaggacttgagcctccagcacagtccattgtgcaaccattgcttaatgaggatgctggactcacacttgtgagatcataatatggtttgctttttactttctaattccgtctgaaatatacataatttcaattcaacaaactgtttcgagcacatagtatatgcagggcactgtccaaggtccataagatgttaaaaagcaaaataccccactactctaccccctccccacccaccttcccccgccggggactctggaggcatcacagagctttacaaggaaaactggaaccgatgctctaatagaggtacagaattcagtgagacgcaagtcaaagaaagcttaattgtgagtaagtctcagacaactttatgaaagaaggggcttttgtacatagctttgaatgctataggatttagagacgcaaaaatttgtggagaggctgtttccaagggcgagtagctggagcaaagcagaaatgttgggcacagttgaaaaacagtaaatgatttggtgactgggttgctttgttgatggatgaagatggggtggggtggaaatctgcctaggaatggacagatcataggatttttgcacaggagattgatgtggtccaatctgtgggcagcagaggctggactgggaaggtagaatgttggagacaggaaggagcaggtcttgggatggagtggaaggaatcaaccctaaatctgagatttgagctcagtgactgggagatggccatgccactccctgagttggtaacaggttttgtgagtagatgagactgactccagatttgtgaacatgagcttatttattcattgttttttttttttagagacagagtctctctctgtctcccaggctggagtacagtggcgcgatctcagctcactgcaacctccgcctcctgggttcaagcaattcccctgcctcagcctcacgagtagttgggactacaggtgcacaccaccatgccctgctaatttttttttgtattttagtagagacaaggtttcaccatgttgcccaggctggtcttgaactccggagctcaggcaatccgcccaccttggcctccgaaagtgctgggattacaggcgtgagccacctggccagcccaaacatgagcttattaattcacctcttctgtgccaggtgctacatatgtactagctcaaccagccttaagaaccaactgtggcagggtgcggaagctcacgcctgtaatcccagcactttgggaggctgaggtggaaggattgcctgaggtcaggtgtttgagaccagcctcagaaacataacgagaggctgtctctacagaaaatttaaaaattagccaggcttcttggctcgtgtttattgtattagtctgttctcatgctgctataaagaactgcccgagactaggtaatttataaagtgaagaggtttaattgactcacagttctgcatggcagaaggcatctcttcacggggcagcaggagagagaatagatgcaagcaggggaaatgccagtggcttataaaaccatcagatgtcatgaggctcactcattatcacgagaacagcatgggggagactgcccccatgattcagttacctccactggtcccgcccttaacacatgggaattatattacaattcgaggtaagatttgggtgggggcatagagccaaaccatatcacttgcagtctgagctccttgggaggctgaggtgggaggattgctctagtccaggggttggaggctgcagtgaactgcgctccactgccactgcgctccaacctggatgacagagcaagttcctgtctactaaacacacacacacacaccttgttgataggggagtaagttacctgggttcgcttggctaataagaggcgttgcagctcccattgcctgacggtccagcatatctgctttaggtagatccttattagttaccaagcagggagggagacagccacagatttttccactcaggtaaaataaaactgaactgaaaaatcaaattgcttcagcaggagtgccaaggggctgggcttgggtccgtttctactggtatatatgatgataactagctttataggccagacatttcctcacactcctttggaaggacatttgtggagtaggcgtgacctcatgcctgcatacatgtgctcggctacaagtatgcatacacactcttccatgccctacttgaaaatccagactccttccccagaggtctggcaggacaagattcacttgtgtctgctctgcatattgccacctgtgtgctgatataaatcctaagttacatgatggtcatgggagactctccgttttcctaatgaattttaggacttgcttatatcaagtttttgttgtgattttgaatctttaggatcactatgtaaaaatggacttaacagttatccaaaaagctaagtgttactttatccttttaaattacatttaatgatgttttaatctttaaaaatcattacttctttatgccagatttattgtttgtagtaggcaaagaagaaaatatatctttttaaatgtgtataagaaaaataatgaattttaccatatgaatcataaatataaaacaagtttgaaaatatttgagttaaattacaaatgtactgtgatttgtaggagagcaattttgggagagtcttgtgatttgtcttaaagcaagtctaattaaaataatgtttttcatgtatttatttgataaaatcacaaactcattttaaaggcatatttattggatacctactatgtggttgacattgttctagggatacaccagtgcacagaatcctccaccaacatccatcccttcaagtggtgaaaacagacaataatgaaaataaaatatgtggtaggtcagatggtggtgtaagtactatgaagaaaaataaaccagggaaaagagagagcatgtttccagggtgggaggtggttgcagtttaaataaaagaggccagagaaggctgccctgatatgttgacaataagcaaagacatgaagatgtgtttcgtggaggagaaaaaaagttcatccccaaactcaattaaaaacaggctttagactataaatgccatttaaataaaatattcctgggacaaactatgttttggattaagcaagatatttaagagtacaacctgatgctaggaaggctttctttggagctatggtttccatatacatagaaagaatgtatattctttttccctataggatgtctcagtggtacgaacttcagcagcttgactcaaaattcctggagcaggttcaccagctttatgatgacagttttcccatggaaatcagacagtacctggcacagtggttagaaaagcaagactggtaaggaaaattcactagacagaagaagaagtttacaccttaaaagtactggttgattaagtgacttggggccatgtttactggaagatgaattccatcaatggccactggaattatttgttgtagaaaagtttgttgatttaaaaaatgactcaacaaagttgagccaaaaagtgtctcaacaaagttaagtatattagtcattaagcacttttatacagttttgccaaatttaatttatgatagatattcctaaatgctttggacaagttacggaatactgacaccgattattttccaacttaggatccagactatagaaagaagtaatttaaaagaaataaagccaaattaatggttaaacattgattagaaatatgaagaaggtagtaaaattaaggggattttttttaactgataggtgttctactttaaaatttattatttgctaatttaaaaacgtcctgaaagtatttgacatagaaagtgaagggtcccctgttgacttttcccccttcagagatagtcaccatgaacactgtcatgcacaatctcttagagtttagaattttttgtgctaattgcacataagagaaataccacataaactgctgctaaaagcaatgtcagtttcaaaagaagaaaataaacctaagaaaatacttaaattatttttaataatttcaataaggaaaccaacatttgttttgtctgttttacatagacatttagttctagaatgaaatgtgtaaatgttaaatctcctagggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggtatgacctggtttttgtattttagttgaaatgttctcatgtttatggaaggcagttttcttcattcagcaaatacaattgagcacacacttattggtatttagagaagtaatagagactaactccatttatgttatctacagcatcagtaaatatagcataagtaaaataagataccaatttattttataaacacagaaggaatttttagggttaaatgtatcacctcttaggtatcagtaatcctgagaaaaatgtgatgctataattttgttttactaaaaattgtcaatatttaaaccaaagaaaaggggctacattttaagagcaatgatctatagtaatacattaaagctccagggaacattagtggttaggttcaggtccttgctatgcaaatgaggaataaaacaggaaaggtttgactttcacctaaggaagtcaggtgacttcaggaactagactccaccttgccttgcttctggtggagttggcctctcctggaagagaaagtcaaagaaagatccagacatgagagaacatgctatagagttttaggggttcttcagatgtactcccagcatgcccttggggtggctatcatatttatgttgtgtaataacagaacttttctgttttaatggaggtgaaagctatcattttcttctttcatacaatacaactgaacttttcagcttaggtaattggaagttgtttttttttcctttgtgaatgtatttatgattttatttacgagtggggaaatcaaattaactttacagaaatttgttctcatacagaccttgcatgaatgtacctgtataaagagccattattgctattggtagtgttttgcaaactagctttgacaatggcaacagaaaaccctagatgaatatctttggtctagttcaaagcttagaccaacagatgcattcattgaggaatgtcatgtatagtttttatatcatttgcattgtctcgggatcctaaccaaagataattggccttaagaaatatggaaagatattaaagtaaaaatattatgtgaaccatatgtgaaaatacttgtttttaaatcaaaaagtacgttaggtacctgcacttagaaagttaaagcaatttttgtcataattcgtgaaagaaatattttgattttaacaaacatagcttatatagaatttaatagatgagagatgaggtttcccggagaatataaacaaattcatatcaacttacaatacacaataaagtaaacattctgcattttaatttatttttgttctaaccactcaaatctaggataattttcaggaagacccaatccagatgtctatgatcatttacagctgtctgaaggaagaaaggaaaattctggaaaacgcccagagatttaatcaggtacttttttctcattgaacacataaactgtaataaaataaaaatgtattcattcatcaaatactattagggcccatgtcaaagcaatgatgaatatctctctaattttatagccccaagaagtgggagaatcagatttagagattttatagaaccaggctttaagaaagatcctaatctaatggaattaagttctaacgaggagagagaacatataaacaagatacttctgggtagcataaagtgctgagaagataacatgctgaattcatggagtggctgggagtggggttgttcctttagatcagggtcaggaaaggcctctgagttgctggcacaggaatggaagcaggcagatagagggttcttgcagctgtccaaggtagaggcagtggaagcttgcgctcagtagaatcagtggaggtaggaagaggtggacagattcaggttatgctttggatgtgataccaatatagaaggatccttatgttgaaggattagatgcaggagtgagagcagaaagtcaaggatggctctacagcagctactagaaccccttgaaaaatggtaatgctgtacacggagctgggaaggcaaggagggggcaggggcaggagttttgtaggactcaataggtttgtggagagaaaaggaggctgatgggaaaatcaagggctttgttttgagcaacatcaagatacctattaaatattcaaggcatcaaacagtaaatgagtcagagttgtactagtatcaagatttttgatcattgttttattaatcctaatacaaaccttcctagttgtcagggttcagcagagttttgaatttgctatggcatttagtattcctttcttgagcactggggtggtgacaacaagccaacaggcaggcagtgtgaagccaccatgttatggattgttctggaggagcccattgctatatggatgccagaggacacagtatgcatcctgtgtgcatttcaccaacaaataactaccgaagtgaactgtgtgacagtggagagggagggagtttaggtgtggtggaggatgccattctccacacactgcctgagcatttgtcccagtccttgtaatcctgtcacttccctaggcgtatagttcccatcttcttgtcacactgatagcatcttgctgaactgagcatgtaaagatacatattgcttattctaaactcaagctgctagctcatctggtacccagcctagggaacaaaggtgtatatcaacgctggaggagaagctggccaggttgtctcctctgaaagaggtgtgcctgtctctaacctggcatatacctgggagattttcagccggcagttttgattatatggggcttccatcctaaaagtagtatgcgtgggcctcctctgtatttctaatagacttgaaaggacagccaggagcaaagatgggcagaaggacaacctgtttcccccagctgcaagcatgtcatcctcacatttggccccttggcccagagatggcattggcagcagagtaggtgacccctgctctcccacatgaacctcatcccctggctttggatcttgaaggtttaccagcttttgagctccctccccattaaaaatgtaggtaatctggggattgttttgagcctctcagaggacacctgagtccgtgaacacctttgcaaagccttcttggggtgtgagggaagtttctgggtgtctggggatgtcagggaaagggaaaaggcacaataggtgcctcctttccaaagttatccagccaactattggctaggtaggtcagaaacatttcttcaccatttccccccttgttgaagtaactttattttattaatacagacatgcatcacttaatgacacagatacattctgagaaatgcaccactaggtgatcgcgtttttgtgcaaacattatagagtgcacttacacaaacccaggtggtataacctactatacacctacactatatggtaaagcctattgctcctaggctacaaacctgtacaatatgaagttgtactgaacgctatgggcaattgtaacacaatgttatttgtgtatctaaacatagaaaaggtacagtacagatagtgtgtaaaagataaaaggtggtacccccataaagctccattctaatcttatggggccactgtcatatacgcggtccatcgttgactgaaccattgttatgtggtacatgactgtgtatattctattcatgctaaagtatatgtgtatggaatggtgtgatgtctggtatttgcttcaaataatcccatttggggactagaagagtaaggagaatagggatgaaacaaggccatccatgaatgctaattgttgaaactgtgataggtacatggggattcaacagattcaacaagttaaaaacatgcaaaattccgagttagttcagatcatttagagaccacaaaattctatagacatgccgagatgggaaattattgttcccattgttttttaatataagagcttttagaaaatacatttaagagaatattatgctatacacactgtagtagactataaatgtttcgtgtgctgtcttacagcacactaagtttttttctttctttttttctttgtggtgaaaaagctagttgcatgtctagacaaaaatttaggtccatagggtctgaagggatggggagaatttctttcaggtgggagggaaagacatgaggtggattctaagcttcctttgctgttccatctttgtgttcttaaggactaatggttaccatatgctgagtgcttatcatgtttcaggccctgtgctaagcactttataaacattatttcatttgagtaaatactttcgaaactatcactgaagttaggtattcttatccccattttaaagatgagaaaactaaggtttagaggtcaggtacttcactcagagccacagagctaatgagaagtaggtttggaatttaaacccagtattgtccaactctaaaactagttcactggagaagtcacttttcagttttctaatctgtgggatgggatatgagggctttctggctggaacttctcacacccatggagtgcctattcccttacttggacaactgctcactctattggaaaggacccccttcctgagcagaagacttttctttgctctggggtctggagtaaccaagttcccatccaaacaaggtctctagaggtacagtagtgaaacgagaaagtaagagtcaatgacagccgaagtcccttccaacttcagtgtttgaaattcccgtggtttcagtactcctggtttcttagaaagttaaaaagttaaggactcactgtgaaagtggtatcagtactaaagtgtacaggagcagccaagcatctgcttagcagatgggggcagggtggagggaagcagggagggatgagtggaaggggtaagagagcaccaagggtttgagtgacttggagggactactgcccaagttggaagcaggagatttcttaggccctgccacagtcaccaggtttttccaccaagcatctcccagcaagtcagtagaaaggggatgtagaagctggggatgtagctgctgttttacagccattgtttatatccctgttctctaaaccgagccttggtcatttgggaggaggcctgggaagtcagaattctccagtggcctggtccctctctctaggtgtagtgtcccagctgttacaaagcccacaggacaccgtgcccacatcctgctggcttagaagttgtattagtctgttcttgcatggctataaagaaatacctgagactgggtaatttataagaaaagaggtttaattgacttatggttctgcaggctgtacaggaagcatggtgctggcatctgctcagtttctggggaggcctcaggaaacttacagtcatagcagcaggtgaaggggaagcacacatatcacatggccagagcaggaggaagcaggggagaggtgctccacacttaaccagatcttgtgagaactcgtgatcacaaggatagtaccaagaggatggtgctaaactattcatgagaaactgtccccgtgatccagtcaccttccaccaggccccacctccaacaatggggattacaattcatgagatttgggtggggacacagatccaaaccatgtcagaattagacaacagcaaagatttccctgcacaggcagaaagctgtatggaactcctcaaagtgacaacttattccaaccgcccagagaaaccccttttgtcactgagtgatatgtggcaccttggacttacagaggataccagtaacattcatgtatttctaatacacactttacagctgatacaattcacatgctttgaacttctgctgttggagaatatgtaacatgaaggaaaacttcctatgaagagagaataactttgatgacgtatgcctgataaagataaaacaaaaaattatggaccaattttacttatgagtatcaatataaaagtcctcaataagatattagggatcagaattaaatactacattaagaaaggacatgaccaaatatgatttattataggttacaagggtagtccatgactgggcaacctattaatgcaattcactaaattaatagctacaaggagaaaaaagcatttacttccttccacagaagctgaaaagatctaacagaattcaatactcattcctcataaaaacattgaataagataggaattgatgggtacctctttaacacaaaaaaatatatatatctccattctagagacagtatcttacctaactgggaaaactccagtaagtcagaaacacagcaaggatgctgtgtttccactgctatttagcatcgtattggtggtattggccaatgcaattagacaagagaaaaccattagaagcataagaattaaaaacaacatcataaagatattagctctccctgagttaacttgtaattttaatgttattccaataaaaataccaacaagttgttttctggagctacacaaatttgttctgaaatttatgaaaaataaacatgcaagagtagcgaggcaacttctgaacaagtagagcaatgaaatgggactggccctactagacagactataaatcctctatagtcaaacatccttcaagggttcaggcttatgaataaaaaggccaatgggaaagaagagaaaaatctagaaggaaacccgtgtgcatatggaaattcatgtgataaagttggcagctcagagcactggggaaaataatggacttttcagtaaatgctgttaagacaaatggaaagctaactggaaaaaaagtgaaagcaaaaagtggacccatacttcactctgatcatgagaataaacaaatatatcagcgatctaaaagttaaaaagaaaaaaaggaaaccttgcaagtgctagggaaatgagtgaatgatgtaatgtcaatagggaaaggctttctaatataaggaaaattccagacatgaagaaaagatgatacaattgcacatataaaaacacccccgtagaatctgtgctgtatagggcactgtgtaagaaaggttgacaagcacagtttttgctgtgtgggggatttaactctaaaaaaataacatctttctagaatttaatctctatgagaacagggatcactggttaccactctaacacccgagcctagagcattgcctgacatttacttagtacctagtatgtgcagggtacatctggtgtatgaagcaagtagagaccctgtcacttctgagtgttctgattatcaaaaataggactgaatactcccaggcaagtctgggtttatattcattattgactttatagtagcagattttcattgatggccttaatggagtgatttcatatttcagtatacctctggatcacccggaattgtgttaaaatagggttttctgattgcctaatcatattagcccttgagattttccaacaagatcctaggtggtgagatgctgctggtctgaggaccacactttgaatcagaaagctttaagataaataaggactgagttaatgagagtaatcttgtgtatagtatctgagaaaccgtgaactaaattccagcgtggtaccatgcaactgtatgaattaatggaaactcccagaaatactgtttattttagacatgaattgagcctagtttttttgtaaccttgttaacagtttgccagcattttccagggccttgggaaaaatttcatattgacacataagcaggaagcctgtagtacatgtcagaagatctggaaggcaagtggggacttgactttggagtgtaaccagcaagtacacaccctgaagaaaacgatggctataatcatgcccttcccattacaggctcagtcggggaatattcagagcacagtgatgttagacaaacagaaagagcttgacagtaaagtcagaaatgtgaaggacaaggttatggtgagtattgagtaaacacatgcatttattctgaaactttctgtaggggaaaaaaggtttcaattgcttggggtgtaaacctcgtaactgagttcagtcttttaagtagttgggaagaaaaattttgcagaagtctcaagctataagtaaacaaattggcaaaatcaatgaccagatagactttttgaatggcctcttataactgccaaacattgagtttagctttttcttccctgaaagatcatgcagtaaatgttgactttgcccagtacccagtaaatgagatgttgctgctctaaatgggcctttatgtccacacctctcaaatcacagtgccccaggataaacatggcccatccttcccagtcatctgttttatcctaagacttggaagaggaacaaaaatacattttattgaaagaaatttggatacatttctgattaagacatccacagcaattttaggatacaacttccaagtcaatttatggaagcagagggctgctctggcgtcctcgatggtgcgcatttactcctctccactgttagggctggtgtggggagggtttgaggagttctttttcacagaggcctgtgtttgtggaaaaggccttccagcttaggggtttggtcctctgtggatctctgggtaatagcagtatggccttgacttacatgcttcagacagcatctttccaaactccacattctttggagcaacttcatcttgcggtctcctagggaaacatttcattaaagtagaaaccgagtgagcccagtccagaaatagccatggaaatccagagaagaatatgtggaaatgtgaccaaatcccaaacaaatgaggcttatttgtagaatgaacatacaatttattgtccagatggagatgcatttgagccgccaagagggcactgtttataattacagcaagtatgaaaccaggtctatcccggtaaagcagggatgtatggtcacttttcttacttggaaggaatgaggaaattttctgtgagctttttccccgcctgctgtgggcttcacagtggagttcttaaatcatatctcagaggtagtctcaaaaatgatgaggaagaatcaaaatttaggcgctggaaccaggttaaggacatacaaatcagtttgagaattattgtacgtttgcttttttaaaaatgttatgacatacttattaatgaaaccgaaattatttcatgtatatgattagaactgtccaagtcagatctctttttgggggagatggaattgttttcgtgtttctctgggttccatagaagcaatactctgttgcctaaagtctttggaagttgctgatcagtagaaaacatgtttacatctttgtttgtagtgtatagagcatgaaatcaagagcctggaagatttacaagatgaatatgacttcaaatgcaaaaccttgcagaacagaggtaagggttcacaactgaagtggtgcccgttggctgcaattttttctgttcacactagataacgaagatgattactcctttctatttgccgagtattttatgactctgaattcttccttgataacccaggccagggcttctcaacatccaatattattgacatttcgggctaatttgttgttggggctgtcctggcattgtagcgtgtttaacagcatccccgacttttacccaccagatgccagtagcactacccaggagccctcactagtgacaaccaaaactgtctccagagattgccaaaagtcccctaggggtcagtgacccctacttgataaccactggttatgtgttactcaccatatttattgcgcctagcccactgactgacacagagcgatagatatgtggagttcccctgccctaatatctcaggtttcttcaaacgttgcagggccacgtgtatacacagcagataagctcagtatttttctcatgttttaaagcagttttactgtattttcttactgttgcgtgtttttaatgagagtagcaacagaaaagatctcaagaatgtacattgtgtaggacacgtagggtactgctgttactctattcatcatctggggtataccatggttcataggcagagattatcagtatgatttgggtagaaagtataagagacagcaacttcaactaccacttcctactcatctacttctctttgaaagctacagctatgctttgtatacattttttatctgaattctgttcagataaaacattttattatttacatttatttttataataataataacattattattaatgttatttacatttatttaggtaattacctgacagtgtcttaagtggcagatactactatgtctgatttacatgggtcactgaaaacaagttttttttgttttttttttgttttttttgtttttttttggagacggagtctcgctctgtcgcccaggctagagtgcagtggcgagatctcggctcactccaagctccgcctcccgggttcatgctgttctcctgcctcagcctcccgagtagctgggactacaggcgtctgccactgcgcccggctaatttttgaaaacaagtattttgtttcagtgtgtctagttgttatacttaggactttttttcatgttcattaaagatcgaagaaagccaaactttgacctgtcactaggcagcatttgtgtcatatttatcctaaatttatatgaatcttggcttttgttggttttgtcttctttatatatttactggctgtctctcaatttatagaacacgagaccaatggtgtggcaaagagtgatcagaaacaagaacagctgttactcaagaagatgtatttaatgcttgacaataagagaaaggtagttatttactttccagaatagcatgccacttttgttatacactgtaaataatggactcaaagtttagaagagaggaaaaattatagccacctggcttagagccccagttgagaatgaaatgatatttgcttttcttttaaaaaatattttaaaattcagtgattaaaaatgaatttatttcactttgtttcttctattgcctttaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggtaagattctccaaagcagaaaactggcagctgactggctaaccacataaacacataaatgtacctttgagctgtgttagttgaatggaccctgtcaaaacattagtatagagtttgacatagtccagcttctgcttaccctggaaacactcccttggaaagcacagtgttattcatgactctcgccacgttcagccacgtctgcttggtttggagcactcctgtaccatggggtgtcgtttgactgtacaaaacatcagtgacatggtcgttatagaacacatttaatgacttgactcttaatgtttccttaaaaacaagatagcttgaggcatttttctaggcttacagaatagttttttaggaaacattcagtcatccatccagtaatacttattaaatgcctactgtgtgccgggcactgtaggacctgggcacacaaggatgagtgattcttggcccttgccaacaaggagttctcagtgtggagggggggatgtagacatggtaataattcgtgtggtaaaagtatccaggtgctctagcaaaaggccatcagaattctgtggaggacaaaggaaagcatctccagggaaggtttcatagaggaagtggccttgtgctgactcaaaagtcactaggattactccacgtagatcaaggggaagtgctttccagcacagagcacagcgtgtgcaaaggcacacatgtgggagactgcaggggctgtattgggtggctggagagtggggtgtccagggagatgggaaggaaagtggacccggtgggagatgctggagcctgatggtgcaggttctcagcaccatgctgggaatgggggatgtacgcagctgtactgctgagccaaggcaggcttttttcttaagcaggagatgtatttctctgatctttgatttagaaagggcactctggccacagcctggaggataggatagagacagaaagaccagttggaatactattagcatattagtgtggtccaggtgaggggcaacaggagctgaacttggaatcacagagtgaacatgagggaaggtggcctgggacaattgctaagggtccaaggaccagagatctcacgaggttattttctatattgccagtttttaaaaaaatcacaattaatattcagccatttatttttgttctgtgaattgcctgtaggtaccccagatttcttgtgggttagagcagagcttctgagcccagtgcaccccatgtgccttgagggatacatacaaccctaaagcccttcaggtggccagggaggccctggggtgtttagagccccctagtggtcctcctagaccacaggagcctcttgtagggacacacatgccctctagttttcccactgtgctgtcattttctctgtgtgcaagcagagttggggacactggtttagcttctccgctggaactcagccagccgttatcctgccttctcctttcctgacgaagggctgctgtcccagggctttgaactggaatcgagcaaaatcagaaagtgaagtagatacttttcccagggaagaagacacttttaaaaggttttcttctgtcattactgcaagtgaataaaacagcgtttccccagcctgtgttgctgttagcagttgactgcaaggaaggaagactaagagcaatcactgggtttactcattggctttttatgtttagggtctagactgagcatactgccttctcctttcagttgagtgaaaccagaatcatcattccttcctctcttcctgtccccggccttgtctcccatctctgtctctcctcctgcccctctgccccacatctctgactggtcctgccgagacactgcttgctgatgccactctcttgacagaacctgcagtggctctttgctgcctcttgcatcacctggaagcacctgctttgctgttttccctgcctctggcctcctctttgccctgcaccagtcacagatcacctagaagccctgcctccacccatctctcctcacataggcctcagtggtgtgtagaagtttttgatgtaggctgtaatcattcagtgcatgttagttgtactcctcaaataacaaagcttctactgctggcacaagcctcgttccctttgtttttccctagagggcagagcatggcatcctaggtgacattttgtgttgcatataaccacttgttggtttccatgccatatggtttggccgtgtccccacccaaatctcaccttgaattgtaataatccccatgtgtcaagggcagggccaggtggagataattgaatcatgggggtggttcccccaatactgttctcatggtagtgagtaagtctcacgagatctgatggttttataagtgggaatttccctccacaaactctcttgcctgccaccatgtaagatgtgactttgctcctcatttgccttctgccatgattgtggggcctcctcagccatgtggaactatgtgtcaattaaacctctttcctttataaattctccagtctcgagtatgtctttattagcagcatgagaatggactaatataccatgattccctttaatccaggctgcttctggactgtttctcatagagacatctgtgtcttgtgtcttcccaggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagaggtaactcaagggacatttatttgtaccttctgtaatcggtctatacagaggaacattttaccgttaattcagatgatttacaagggtttaataggtgttttttatatatatatatatatatatatatatatattttttttttttttgagatagagtctcacctatcacccaggctagagtgcagtggcgtgatcttggctcactgcaacctccacctcccacgttcaagcaatcctcctgcctcagcctcccaagtagctgggactacaggcgcatgccaccccacctggctaattttttttagtagagactgggtttcgccatgttggccaggctggtctccaactcctgaactcaggtgatctgccctcctcggcctcccaaagtgctgggattacaggcgtgagccactgtgcctggcctcaaattttttaatgacaatgactcttcctgaattatttggttataccagtggttcttcactcttgtggccagctaggctggaagctatagtaaccttccactcctccttcccctttggctgagtctccgccgtgaccctaacatgcctcacctcctcctctcccctcctcatgtctcaggctctcaaatcctcctttctggactcttccccagcctccccaccagtcctccttcccagtccttcctccctgtgaccagtgctgtcccagagcagagttccattctggttcctcatcacctgctgatccaagtgaatgcccagctgggcattcacggccccccttctgcagcctggacctagctgaacactccacgcttcacgtccacacacgcccctttctaggcaaacttgacctcttgctgattcctataggggccatgccgcatacttgcttttctgtggctctcctgaggatacttcctcttcctcagagccttcttttcatgtacctgctttcaaaattgtatcatcccgaaagcttcaccttgtatctcatcatttaatcttcccagatttcccaaacagatgttatctcccttcgtggcctacagtcacccttcgttcctttcctactctgccttttgttatatagttgttatgtatttctttatatttcttgaatatcataaagttctggaaggcagagacatgcctttgtcacccttttcccccagcaggacctagcgcagtgccttgtgaacagtaggctctctagacacacttagtagatagataaatgtcactgagtggaaaagaagggttcatattgcaagtttttttttttttaatgcaaacttgacatgataaaaatgtacttgattttgggtggaagcaatagctgagtggcagcggctgctgattgcgttccagggggcagagtcggggaagacatttactctcccagaacagcctatctcattcctttccttcagttacccgtggtgcagagagtcagggcagcagctgtagcagcaagggtggccgtggcagcggtggcagctacagtgacatgtccagcatgaatcccaaattgattatttattcaaattacttctgattggcgactctggggttggaaagtcttgcctccttcttaggtttgcagatgataacatatacagaaagctacatcagcacaattggtatggatttcaaaataagaactatagagttagacgggaaaacaatcaagcttcaaatatggaacacagcagaacaggaaaggtttcgaacagtcatctccagttattacagaggagccaatggcatcctagtggtgtatgatgtgacagatcaggagtccttcaataatattaaacagtgactgcagaaaatagatcattatcccagtgaaaacgtcaacaaattgttggtagggaacaagtgtgatctgaccacagagaaagtagtagactacacaacagccaaggaatttgctgattcccttggaattctgtttttggaaactagtgctaggaatgcaacaaggcccggcacggtggctcatgcctgtaatcccagcactttgggaggccgaggtgggtggatcacctgaggtcaggagttcgagagcagcctggccaacatgatgaaaccccatccctactaaaaatacaaaaattagccaggcatggtggcgggcgcctgtaatcccagctacttgggaggctgaggcaggagaattgctcgaacccaggtggcggaggttgcagtgagccgagattgcgccattgctctccagcctaggagacggagcaagactctgtctcaaaaaaaaaaaaaagaaagaatgcaatgaatgtagaactgtgttccatgatgatggcagctgagattaagaagctaatgggtcctggagcaacagctggtggtgctgagaagtccagtgttaaaattcagagcactctggtcaagcagtcaggtggaggttcctgctaaaatttgcctccatccttttctcacagtaataaatttgcaatctgaacccaagtgaagaaacaaaattgcctgaattgtactgtatgtagctgcactacaacagattcttaccatatccacagaggtcagagattgtaaatggtcaatactgactttttttttttattctcttgactcaagacagctaacttcattttcagaactgtcttaaacctttgtgtgctggtttataaaataatgtattttcctgatatcagactgttttctcgtggttggttagaatatattttgttttgatgtttatattggtgtgtttagatgtcaggtatagtcttctgaagatgaagttcagccattttatatcaaacagcacaagcagtgtctgtcactttccatgcgtaaagtttagtgagatgttatatgtaagatctgatttgctagttcttccttgtagagttataaatggaaagattacactgtctgattaatagcttcttcatactctgcatataatttgtggctgcagaatattgtaatttgttgcatactatgtaacaaaacaactgaagatatgtttaataaatatcgtacttattggaagtaatatttaaaaaaatgtacttggttccctatggctaatgttcaaacaagaagtcctgtatgttgggttttttaaaatttaaaaacattacttgtactttgagtgcacattttattcttaattctgacatgtaaatgaacataattaaatacggggtttttattttttattttggatttttgagacagggcctcactctgtcatccagactggagtgcagtggtgtgatcatggctcacttcagcctcaacctcctgggctcaagtgatcttcccacttcaaccctccagtagttgggactaattagccacgcctggctaattaaaaaaaaaaaaaaaatttgtaaagatacggtctcactatgttgcctgagctggtcttgaactcctgggctcaagcaatcttcacacctcagcctcttaaagtgctgggattacagacatgggccactgtgcctagccttcattgtatgtttgtttcaatgtaatagtttcacagatcattacagttattctgtttctgttaagtccctattaggttttgggatttctttactaattagaaaatatcactttgttcatccaacttgtcagaatctttcaaatgattttttagatcgtactctctaacccccttttttctttcaggaaaatcattgtgattgcctcaaccttaatggaaatgctaacttatctatcctttgctgggtatttgcagctcgtttgtggtggaaagacagccctgcatgccaacgcaccctcagaggccgctggtcttgaagacaggggtccagttcactgtgaagttgaggtaacaagggaaagatggcatcccatacatcacctgtcacgtagtttgtacccctagtttccttttataaaaactgttatatagggtgcttttgaggaaataatttttcagggggcactttaatatgaactcttactgagaatatctgagagtcttttattaatatattcatagtagaaatgtaactgatatacatatatgtacacactcctggtttttttccaatcataaatgtaatgcgtgttcacaggaaaacagaattccaaattgcagaaatgtgtgtaatagagagtaaaagttcctggctgcctcacccctcttgggcataggctcataacctgagccttatgaaccccagaagctgtatgaatgtggatttataacatgtacatttttctgatggatggatttatagctttcatcagtttctcaaagcagtccgtgatataaatatctgtggaccaccacagtaaatggcctagtgtctgtcctcccaggattttgtccatgtctacacaaatatatatttcatacggaaacacacacgcacaaacatgacataatgtttcctttttaaaaaattaggattccatgtctacacaaatatttcatatagagacacacacacacacaaatatgacatatttcttttttaaaaactcggagtaggctacatacattgttttgtagtctttctcctcgatactaattgtagaagtgtttccaggaatatgtggctttactttcttccattgaatggctgcattgctttaagcattcttcttatgatgagtagctagacgctgaagaactggactggccttcatagttggcccgggtcctttttctggggtgttgctgatttaagtctgtggttaaccctccctggctggtaggtacaatgtcacactgaagccctcgtggaattttagaactcagcagctggaagggacagtagaaatctgatcccatccacctgctccactgaacggagcagacagagccccggggtctccttctcaaagtctccagctcagtggagcagaggtacaccctctcacctgccctccatctttccacgctaccctggggtgactatagatgggacgctattttttctgcttatgggcaatagtttttattgtctcccaacaggacaaagattagatacaagttttaatagaaagtaatgtttgctattttacccatataaattggccaaaggtcgaaattgtgatgaaactgaatattggcaaggttatagaggtaaacagctaccctcattaacttttggtggcaatgtaaaatcagggcggcatcctgtcagaattagtgttacaatttttcctaagcggttccacagctaggaatttattcttacaaatacacttacaaaaatttaagtagatctacaaaactgtcagtttttttgttggtaataccctaaaactggagggggagtagtttatctaaacgttaatagggaattggcataataaataaattgtaacagataattttttttaagtaatggcttttatttttctttccagactgttggtgaaattgcaagagctgaattataatttgaaagtcaaagtcttatttgataagtaagatatctttaacattatataacatacatgtactattgaaatgttgattttgttactcaagcacagattcctccactaaataagcagatttctagctgtggaagggtctatactgggtggaagtttgcctccctagggccccagggctgaacccagagtcctgacaatgctgcgcatgagcagagacttctagtcagatccaccagggccatcacaaatgaccccagcagatttaaatcagcagctcccttggtggatgttgggagcttcccctggagctggtatcaacattcctgtgcctttttagactataaatgaacaaaagagtgagtgtctctttgtgcatatgagattgtaatcagcaagtctcaaagtggctggacttggcatgccaccccttccttctaggtcagccccaaaggagaggcccctgatccaacccgaggctgaacgtccaggctgccatgattctgtggtcatttgggggtttttttctggagcgaggtcagcagcatcttggggagactgtgtggagcctgtgggattcactcttgtctcttctgggcagtgggaacccaggaatgggcatctctcttgggggtccaggtggagcagcctcatcctattttgccctgagaccctagacctggactggcactaacttggccactctcattaaggaacaagatggctccccccccacccctcccatatttaatgtttttgttagcttgtgtcacatactgttttggcaagtttcaaaaatgatttatgatcattcagatcattttcctctggctttttgctttttcccactcctataagaatattcttcctcatagcatggtctgtgccttgtcttccctgccatcatctttggtatatcggttagcttttgcttcctaacaaaccactcccaaaacttagtggctaggccaggtgcagtggctcacacctgtaatcccagcactttgggaggccaaggcaggcagatcacatgaagccagagtttgagaccggcctggccaacatggcgaaaccccgtctctatgaaaaatacaaaaaattagccaggtgtggtggtgtgcaccggtaatcacagctacttgggaggccgaggcacgagaatcgcttgaacctgggaggcagaggttgcagtgagctgagatcatgccactgcactccagcctgggtgacagagtgagactctgtctaaaaacaaacaaacaaaaacttagtggctaaaaactcaaaaactcattatttctcatattctgtgagttgtaggttgtcctggtctgagctagtgtggttggagccaggtgctctagcaaggccttattacatgactgggactcagctgggataaccaggtccttcttcatgcacctcaaaaaggctagcctgggcttttcccatggtgacagtgttccaagtgaacaaggcctgtgagtgctagccttggaacatctatagcatcactcccttccatcctgttgctaaaagcaaatcaaggccagctgagattcgggggatggggaagtatatcctacttcctaaacggaggaagcacaagagttgtgttgccattgcagtttaccatcttctgcgtcagctcagctcctctcagctgcttcgggcccttgtgtcttttctgtcggttccagctctgacggtcttcttagctttgacaagtcagcttttatcatactatcccttttattttaaattctttttttttccaaacgggaaaataggtcccttccatagctaatggtgattgtcattcacaaaagcattgaacttctggttgagattggaaaggaaggggaactaatagatctgtgagtgagcccatgatttctagtctacatctaggacgctcacggatacattatttggccagaacatgacaaagtaatcactggatatagaagtgcaaggtctttcaaaattttaacctcagacttaaaacttaaacttgccactttccccagataactgactttcctggtactttcatgagagcattaaagatcatagagaataaaaatgagaattaaatggtcacattggcagtcctctgagctttgtgactactgggcagtgctgttggctggatccccagtgcttagtgcagggccttgcaccaagtagctgctcaataaacaataacgatagcttaaacatttattgagggtgtactggtgctggtgcttacatttattgagggtgtactggtgaggaattaactagtttattcctcatgatgtcctatatgttggcactgttagtatgttgtgcaaatgaacaatgtaaggcccagaccatttatttgccaaaggtcattcagtgatacttgccagacctagtatgggtagatggaagcagggagtgaatgaaaggctgcaaatccataggtgtagatttattttttattcatcattcacttacactcttatgctcttatactcttataattttgttaaagcttatttcaaattttaaatacgcatatgtgattatatatattttttttgcagagatgtgaatgagagaaatacagtaaaagggtacgtgacgtactttacgctatactgtgctatatttttatttatttaatagttggaagacttttcagcatttctttcctatattgtatagatttaggaagttcaacattttgggcacgcacacaaaagtgatgaacatggaggagtccaccaatggcagtctggcggctgaatttcggcacctggtagggacatcagtttcctctctatgttgtctctggtttcttaggacttttgacaatagagcagccctttttggcacattgccatgtggaggacgcccccctgctggggtttgtagactttgtggctggtgtcttcctgtcgccagtacttggggcattttggtttctcctccttatcccacgactgttcactctgttttctgggctgtatcacttgcagtaaaaatatttcctaagcctgtgtttacgtaaatgatttgcacttgctgcctgcatgatccccacggtcactcacctacgcttgcagttttctcaaaggttatggctcccgtgtcctgactgtgatccaagtgtggtcctgtacaccagggttcactcctcagcccccgtgttccccttcctggtggccctgcccacagcccctgcctccacgccagcctgactctaccaccttttctccagggcagtagggctcattccccaggcagtggagacccagcaggatgctctgtgtgggtgcaccatctttcctcctctgtgaacatgggggctgccagttgctgtgaggctctgtgggtgctgagtccgaagctttccctgggcccagaacctgcaggaggttaaaggcatcctttttcactagagaccactttgtgatccagcaagcctcgtagctaggaagctctacctaactcgaaagcttagcccaactcaggtgcctgagggtattcagagccgccctcagggccccagcctgctccctcgtcagctcagggattgacagctcagagattgacgtccacttgagggcaggtggacctggagtcactgggcccagcctggaggactctgctgagggaaaggggagggagaagctgtcccgagcctcagggcatgaaacagttaacgaaggtgcatggggaaacattcagggaaagtttgaacacaggagaggagcgggttgtgattccaagagatccctccagactggtgtccgcaccatgaggccactgaggaaacgtgcttctgctcatggaccctgaacgagggccaatttgtcccatgttctgcattctaaagataaagtcacgtctgtcattctttctagtcctaactttgttctcatttgtaaatgaagatagcaactttgaccattaccatggtgtttactaagatgattatttgttttatagcaattgaaagaacagaaaaatgctggcaccagaacgaatgaggtgagagtccctttatgttgtgaatgggcccaaatcaggcaggtctgtctagcaaggacaggtcagttggtggctggggacacctcacagaggagttcagacccatcagggaagagcagcaaaggagctgggtatttggtatatctgtgacaacagtaaaaacaccacatttgtgctttactattgtcaaacgattttgcacacaaattcattagacactcatggacaactcagtggagtagctgttgtgggcttttgtattcttcgcatcttacgggtgaagaaattgactcacagaagtttgcaggatttagctaagggtgcacagagttactgtcagagttggaacgagaggccactttgatgactgccttgctgtgtgccaagagggcttttcggccattgcatcccctaccaaaagcattgcctttgcatcagtttccttcctacagcgtgatccttaaggagttgggtttgtgatgcattcagaaatgaactatggacaaaggatgaaatatctggagttgttttggttgagaacactttcgtcatttatgcacacacagtgtgcagtccttccacaccaggaccagtggaggtcacatggagcagcgggacaaacacaggcccaggcagtgcaaagatgccttctagccctggtgtgcgcctgaactatgttttgacctccctgggtctagctgttgcacctctctagttctaagttgtgaggctcacatgaggtaatgcttatgaaggcactttgaaatctatccatttctaccgaaaccaagacaacttgtgacctgccaagttgatgtgagtcagcccttccggtaggcagtagacaatcacaagtatgcacttactcccagtcctctcaccttctccccacccatctgcattgagatgtgcagccacactgggcaggcagacagagctgagggtcgagaagccttaggtcacaaagccattagttgctctttccccattgacaatcattgctctgaatctataacccttgccgtaacttcagacacttatctttcagagcacactgagatactaagaatcattaaatctgggagagattgaatattgagtcttcagacttgccactgattgggcccaggatctctgtggcctgttgcaatgttaattgggcttttgaaagttttaggatctgtgaataattatattcttttcttctttccttttctcttccaagggtcctctcatcgttactgaagagcttcactcccttagttttgaaacccaattgtgccagcctggtttggtaattgacctcgaggtaagacttttatggtcccgagttggaaaacttcattatttttacttttaattgttacatgtatttttatttctcagtgtttgttctggaggtatttacctaattgttttaaaatgatctttttcagctaatactatcttaaccttaatttatggtccagaaagctagacaattgaattaaccttcaaattcaataacttaaaagttccagttgagatcgctgatgttaattttttttttttacattaagcattgggacttatttattttgctctgccctccccccacattttatgttttcattgtgacagttttcatcttctcatattgcatatcccttaattaattattgtagctattattatttttagggacttatttcttaactgaaagatacatcaaagacaagttaaactggacagaagaacagaacttaacacttctcattttcaagtattaaatatgtacaaatttacaaataatcccctgcttttagttgaggctaagcagttatctgaaggtgacatttctgtgattcagatgatttcaaggtctttgtcatcctttagacgacctctctgcccgttgtggtgatctccaacgtcagccagctcccgagcggttgggcctccatcctttggtacaacatgctggtggcggaacccagggtatggaaaacacatttgctttggtcccagggttaagcagagaccccacgctctcgctgctgcatctctgaaatagccccaatggccagttgttaagggagaagtgacaaagctcctgtggtatttctaaggcttttgagtaaatctgggaatatgaagcatggatatgtatttgaaatgagaattacgttttttctcccatgtgggtaagctagggcagtcagtgattccataccactttattgttattatttttaaaatgtatacatctactaaacaagcatgctccattcttagagtgtggatactcactgttaattaattacagtcatttataattattcaaagtacttatgttttttaaagtcaccaggaacacttaactagcaaataatgaattgttgctcctaagggaactacgaggctaggttccttcaagcctctggtcacaacatttttgtcaacccatcaatgcataacattgtttatgtgtgtttctgtttaaagacaccttatctaatacacttgttgaggcattaacattacacctatagctaggatcactgtaactcatgcctgagtgaagcttgcctcacacatgtattttctccataaggcacatcccagccttcccatgcttaggaacagtagaccacactgtggtactatgctcgggcaccattttaaacagggatcaccaacagcagtcacaaaatgcaaaaaacatggcgctaaataggcttcaaaaaggacacgtttttcttatgagaggtgaaacaggaagcgagtgtcattttgtttggcttcagttggaagcgtgttaagagactcgaattctttgctgctgtgtgctgctgtgtgtgcacgggtgtgtcttcaaatgaccccaaagatgccatgtatttagattttggagttacaagtaaattttagtgagtaaacaagttcacaaatgtgcatctgtaaataatgaaaattgactgtatttctcttcccctactgtgaaagcacctgtgtgtcatataaactagaattgaactttgggatggacatatgttttagtgccacacttgtgactggtgtctctgtagtaacccttagattttgggtgttttctctctagaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtatatgcatattaacttgttatgtttataaaaattgaaattcataaaaatatctctctaattgctcttttcccctctgctattttgttaaaggtaaaaaagtactaaaatctgtcagcttttcaagctatagtttattatagctaagtgagaatcatatgtcaccttagaaagaaatatagacctgataacatttaaatgaatccgttcctcattgtctcatattaagatttctgagatgaattcccaagggaaagttttatgaattatgtaaaatatattatttgtggctgaaataagttcctggatgagaaagatgaaggcctattaaccattaaccttggggagaaaaaaggaagtccctgacatgatgagaaataaagtcctggggcttgcccactgcagcataaacccagggcccttgcctcaggtggggcccaggtagcagaggatgccgtccccacaagaggatgcctcttttgatctgcagttttgcctgattggacagagtctagacagtggtagataattccctttcagtggttaatgtcagtgcatttattagtccttcatactaaacaaatcaaagatccactagtctcaaggtcagatctttcagtgagtgaggctatctgaactatttctttaaaaatccgtggacaacttgtatccagatttgctttctgtagagcagcactgcatttactccaaacagcagtaggctcttcctaactcagtgactttcaacagtgccttcttctcttggatatgcagctgtcacagtggtggtcttgtgctgtttaatacaagtacaaaatccccttattccatttctttatttggtgagagttaagaaggatatcttttctagctgtaatggctcatttgtagttctctttgaagaccgataatgggcttaccgcctcttctcgcccaggctgctttaatttgtgtagctaataaccccgggcttcttcctctcgtttctctcacttggtttttgatttgcatcagactccctgagcccatgtcctatttggaggaaagctgagggaaatgcataaataatgtctaaaataaacttgtaaagtcaagtatcagttacattgaagatctaggggtgatcttgggcacctaggttgaactttgaaaaaaattctgtaggatccttgggagagggggctctgctgagcagcagaggaaggcagtgggaagaggcactggatagggaggcttctctaggaggcccagcagaacacctttgatttagtgcaaaaggcaaagtcagctgatggtcttggaaggaagtgtaacatgaagagggcattaaaaggactgtcctctctttagaggagggagggaaaaggggggctggggagggagagagcagatggtaaggctttgtgatgtttccgctttccctaaaaactctcatatcgtggtgcccaggaatctgccatccattcctttctgccattaaactcaaaccaacatatacatattttagaccatttaaattccgccctcttacagcacgtattataattgctcagttaatttggcattaaggtatccgaaaatgtcaactgtgtacatacaatctttgttgggtgtttggctcttttccttgagagcaaatacaagagccatccgtccaaccaaagctttagaatcagtttctgtttgctgaaaaatctggtttttatttgtttaggtcctaacgccagccccgatggtctcattccgtggacgaggttttgtaaggtgaggactgtctgggttttatgctctctaagtcctttttgctcttggttgaggttctcatgtttcttgctgtgatagttacttaactgtttgcttattttggcgtgttcttctctggccaaggagcccctcgggcaagttgtttacttttcttcagtgcaggaggttggtctccgagcaggagtctgacaggaagcacctgcctgagtgataacattctttcatatctgaaatgaggcttctgttcactcacgctggacccctgcccagcagtgttttagccatttctgtgtgaaatgtatgttgtgggctgggtggcgcagcctgaccagccagacgagtttaacggcctgctcgagcagaggggcccactgcggggaacatttagattctgctggagtcaccagacagtgcggaccagcttgcactgctggattttgctagtgtggggcagcttgtgtttccgtgagtcacgctggaggtcacccccaggctagcttgctactgtttggaaagggaagcagagcccggcccagggaagtggagagctctggagagctcctggtctgaatgctgataagagcggggagggaacttgatattccctgccaggggagggatcccattgctgtgctgaatgggacagttccatccttggcacctggggagtctttgcaaatgatggtgggaggggccatggtaagtcattgttttagatttttgttcataatgtctgcatttgtatactttcaggaaaatataaatgataaaaattttcccttctggctttggattgaaagcatcctagaactcattaaaaaacacctgctccctctctggaatgatgggtaagggccaccgatagatgtattttgaaacatatttttagtgctgcgaggttgagacaaggcctgagtccagcttcagtatttgactaggcgtgtgtgaatctcacaggagtgcgcatttataggctgccccttcagggcttcagaagagtagaacctcataacattaaccttacactttcttagtacaagtatatgtattggcaaagctaaattaaaaaaaaaaaacaactcttgagtgccattcatgcattcattcactcaacaaaaattttttgagcacctactatgtggcccctaggaaggaagaaaaacccttttaactgggtaaatcatttctatcttgacttattgccaggatcggctgatatttcaacagaagctttaacttgatcagaagggctaaaatatgaaaatatattgcctaggtcttcctctccagtaaaaaagatgtatacattcagacattgttatggcctttaaaataataaaggaacaataaaaggctcattaatcccacacgtgttattgagcatctgtagcatcctactgacaccatgttcatatcgctttttttaaaaccttagtatatacatgtataagtgaaatgcttccttaagtgtcaactgaacagattttaaaatagtctacgttttttaccgtaggttttttttctcacattccagccattttcttggtttgtaagttagcatgaaaatggaaatcatgattgaactaaaagcccatccgtccatctcttcgatatccaggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcggtgagtgggagtttgagcacatagtcccaccattccatgtgtgtgaagtccctcttcatcgccgccagtcagctcatacagatagtgcgtttgggacatgaaattgcagatcttatacttaccccaaatgagcccccgataggatttaataaaccaccacaaatgtttgtggttgtggttcactctctggaacatattgtggaaatgatggttttgaaaagacaatgccaattctttcctttgcatcaggtttgttatctgcagatcaaggatgtgagtcaatgtaatctgcaacccgttcttggaaggaatcacatttcccacaggagtaagcatccacattctcttagggtcatcccagagtagagtgtgcagatgagacaggcttcgggagaagacttcatacacatcatcagccagggagttgatgcaggacctgttgggacgagtggcagcctctaccctgccttcaaacagagcagctgcaaatttatctttatcatatatggggtttctatttaatcaaatgagtccatggctaaaagactccagaaaccttggtgttatgaagcaggtttctgagggtgaagctcaacagcgtaaatgaaaaaatcataaagaccaactgattacttttcactgttgtttagagtttggtctgtttgaagggcaggaggaaaaactgatttgttttagtaatttttatactttcagtgggtagacacaaaatggaatactcttcttgttctatttatttttctgaaatattcctcttctcctgtttttctggaatactcttattctatttgtttttctgccatactcttcttgttctgtttgtttttctggaatactcttctattttttttttctggaacggtattctttcttgttctgtttatttttcaggaatactcttcttgttctatttgtttttctggaatacttttcttgttctatttttcttctgaggaaaaagcagggaggctgagatgagagtctggcgtgggcagtagtcattagaacctgcccttttcctcttatcctgttcccttcctgaaccagctgagagacagatatagtagaccaagcagagatgaagaaaacccttggcaaccaggaaaggtcaagcaggacactaccagccaggaagggttaggatggcagcatagtctcatgttccacagcaggctccccagaacacctgaaccgtggcctctggaaggtcgacacccaaagggagattctgtatcagctaggaagaaggatctgaattcagtctgggaataagaacgggagtaaattaaaccatggtttattacgttaagggttacagggaaatgtagcaaataggatcatttttaatttgaaatgttgttttctatatatcataatttattttaataaaaaattagatttttcaatatgaaaagaaaaacaaagtgagtttatctctagtaatttaaatctgtggcttaagccaagatgatccacttagtagtaagttatttatgtgcctatgggcagcacatcattgaagatgcaggcttttaaaggtttttaataaatcttttttgcccagatttataaatctaagcaaataatggcaaatagaatgttattgagaataatacctccctttattttccctgagacagtattataatttatttagaaataaagcagtctactgtatatgttacaatgcttagattgtgattagttcttatgaggttcactcaaatccatcaactctgcagtgttttatttctctgtcctctttcattttgggatgttctatgggatttacttagcttttctcctttttagaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaaggtaagtggggcaagcaggtggtaacagcgtggcacagtctttcctgatgagggggtgattattctgaaactccacccatgcagtgttttgctttcgaattggtaagagtaggctttcaaaagatggcataaactcagtgcaggtgaaacataatgcattatttggcctgatacagctagtaagaaatgaatggacaatttcctattttaggaatgttggaaaagtccattgctggtcttgtgtatttgttactatcactgtttccacatgaaaagggtttaaataaggaactgtggtaaaccaacagaaggcatcttgctcacgttaaagttgaggaaactgaggcctgggagaagtgaagtggttcatttagggtggcccaattacttactagatcctatttttattagataattattaagaggaggcctcatctgagaacacaggtctcttgcttctcagttgtcaatgaattgcatttgagaaggttcgaattagacctgttttgtttggaacacaccaacaaagctgtttttcagaatcagaaatctcaatattaggacaattactttggaatgaagatgtccccagcttaccttgacagctgtgaatattcattagccaggctaatgccaataaactggatagaactttgcatattttgggctcagacttcttgtaagatttcaagttgtgtaaagagaaagctcctagctagtgtcctgctgaacactagcttatttccagactgaattcagatccttcttctcgttgtttctgcattcccactagaattttaggtgactcaggcagggaggttatagctccttaaagttttaggaggctaagctgtctagaaacacagtagaactttaatccccccgaaaagttgatgttgtattctgatggaatttcggttgatggaaagcgtacacaatgtgtttatttctagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaagccaaaaaccaaatttgtatttaaggtatataaattttcccaaaactgataccctttgaaaaagtataaataaaatgagcaaaagttgatcagagtgggaaagtagttcttttcaatctagaaaaggccaaagtaatgattgagatacactgtctccacttgctttgattttgttgtttcattttataaaaggtagaaaaaattttggaaatgtcattgtcagttatttggcctgcagcactgtcttggggtgaatggatgtagccttcatgtaaaaacactgtgtggagcagctttatctgcattcaaacctcaaggtagggatgagggactccccagacatttctctggtgcttttctgtccagggtaagccacgaggcattgtcatctcagggtagtgcaccgcacatgctcacacctaggcttacccaggcagaagcggcacagattccagtctggctattgcttatcacatccctggagtgtgaaacatttcccaaggggctgggctggggacatgagcctcccatgagctgtacttttgcaaatgtattttacaagtgtatgcacttacccaaaataaaaatataacgtgataattcaattacagacaaaagataaagtgtgtaagtatgcactagtgctttcatcactcagatgttgacattgctcttttctttttccccattttagtcacccttctagacttcagaccacagacaacctgctccccatgtctcctgaggagtttgacgaggtgtctcggatagtgggctctgtagaattcgacagtatggtgagtaccacggctggcctgtgtgtagctctcaataagtgtgtgtgctcagaggcagggagcgcaccatggcagatcccgggcctgtctgcgggagggagccctggcggagccaaggagagtgcagtgctcagatgagccatgacaagttggagctgctggatttaaaccacctacatcatcagtgggatttttattcctcgcattcagcaccttccaaaaaacaagtgacatttctaatattcaggtttcctcctctcccctttaaagttgtccatgtagaaatttcatatattaaggaactaagatttctttgataagcaaatgtttttcttcggaatgcgatttcatcactgtgtctaggggagggagtgttatttttagaaagggagggactaacgcttggtagttacagtaattagagagaattatactttagcagcaatgagattacttcatctgccttatatttgagagctaatttgtacaagtagctcctggggctgtgaagggcttgccaagagtaaaaggttcaaggagtgaaatagttaatgagattcgtgatagaaatgggaatatgattgtccacaaaagggaacatcttccttttggagggtgcttttttagtatatcaactagtattgtttgcctttcagcctaaaatccttcctcttaaagattgtgcttgcttggctggatttttgctgatgctgtttaattttaagctcttttccacatggagctattccagctcatttttaaaaatttatttaatgcttccaaaaaatatcctgagttattactggcctttcttccttactgtatacccggtgcctggcaaaaagtaggtgctcaacaaagagaggaaggcagggaggggaaaggtgagcgagaatgagagggcgtcactcttcagacatttggggaatgcgatgataaggcctcagtaagatctgcctggattcaggtttctcatgtgtaattttttgacttttttcctcaccttaagcacgggctacaatcattagagattgtaccttcctacactttcctgattgttgttgacgaaataggccatttagaaaaacagttagctattgtggcagcgaaatagtttcattcctattggcaagtgtaaaatgaaccttttctgcatgtaagaaggatcctgctagagtttcgctcccaacactgctataggcctggcacaaaaatggaataaatataaagccctattcagaaaatatgttacatcacaggaactgtaaaatggggggattttttatacctcctttgttgttcctgagcaaattacatcatcatcaccaccaccattaataggtgacattaagcacctacagtataccatgtacttcacaggtagtaactcattcagtcctcacagccaccttctgagttaggtgttattgttattcctactttgacagatgtgggaacagagcccctcctccccacacagccccttttatgtaacttgactaagatcaagcagttagtaaatggtagaaagaatatttgaatctacctagtgagtctctagtgcatgcttttgtccggtatcctggaaagcctcccacaaaaagctaatctttgccccattcaaaacatgcaccctgaagaagctgtttgtacaggattgggtttattctgttattaagacaaaggcatcatggcctttgggtgagaggcccgtatgtgtttgggatttggcaatcagcattccatctctgtcatcaccattattgagaaaatagatggattggttccctctctgcagtcctgtggagcagttggactgctctctctgctctcaggatgatactgtgagaacaatttaaatatgctaagcacatgtcaggaaacagttttgtggtctttggacactcgctgtagccattccgttccatttcaggtgattttattcatttcatttgtagaataaaataaatccatttcacacacacacacacacacacacacacacacacacaccctctatacaccactaaagcctcccattaaacccatagaagacttaaagagctaaaagaggctataatataaaaaaaaaaaaagaaaagaaaagaaaaagagttcataatataggcacggcactggttagacaacggttgaatcagtctctaaattgggttgacttcacaatggtttgctgtcctgccccttggccatgacttccatccagcatctactcttagaatcagagtgtatactctgaaacagaagcagctctccccaagctggctgtcttctgccaagtctggaggttgcagctctgaaagagggtggtaccaggggccaacgcctggtgcagcctcaggagcaacaggaccataggctcctgaggaaattgtccaagagagccagagcaccagtgttctctgcagtatgacttgggcatttgtttagtctggatttcctgtgtaatcagtgttttcctctgggactgtaatagaaccagtctactctccaagaggcctttagccaaagctcataatgataggactagctattaattgtctactactttctgtctactatactaaacattttacgtatgccatctaatttaacaagcctatctgctaggtactattaatccccttttgatagatgaagactttgagatttagagaggttaagccacttgccctggtcacgcagtgacaggatctgaatctgggcttcctctcttcctctatctatctatctccccctccctccctctctttacccccacggtccaccctattaagcacacatttgaaacatcagccaggccgggcgcggtggctcacgcctgtaatctcaacattttgggaggccagggcaggtggatcacctgagatcaggagtttgagaccagcctggccaacacggtgaaaccccatctctactaaaaatacaaaaattagccagccatggtggtgtgtgcctgtaatcccagctactagcggggctgaagcaggaggatcgcttgaacctggaaggtggaggttgcagtgagccaagatggtgccactgcactccagtctgggcaacagaggaagactccgtctccaatttgaaaaaaaaaaagaaagaaagaaagaaaagagaaacataagctagactgaaacataggggcaacactttcactgtgcttttcaatccaaaataattttcctaagagcccactatgtaccacacactattgagcacttgggattaaaaaaaagttctccagaggctttccagtctagtgccatgtgtctcagtcttggtgctactggtattcggggcttcagaattatttgttggggattggtggggtggggagctttcctgtgcttcgtaggaggttcagcaacacctctggcttctaccaaatagataccagtaagcacatgcaccctcacagccagatgggacaatcagcaatgtcttcagccattgccaggggacagaatcatcctcgattgaaagcatctggtctaaggggaaagaccagtgtggaagtcagacaggaagtcactggcaggctagtatcctttggatgaacagtttacttactataagttgtcctggtcaaggcagctgggcagaaggcactggtggggagggtgaaggggttcttagtaattctgcttctttagtctgtacctgaaacacagtcattgattttacccactgagtggcctttaggggaagtgtatcatttccctctccttcctctctccctctggcatatggctcagcatttcctcacccgtttcacatgagcagatttgacacgttgctctgtccccagacttgcataacagcaaaaagctttatgcagtctggatggattcacaaaattaagccagtgggcagcagagtaataatccgtcagcttaggtgatataaaaggtcttgattagcccaggataatacatagtacatgctgaaggccctcttattccacggtatttatttgccattgcaagtatcttcctactacttcattctagaatagacaagcaatgtttaatgtatgagtctgcatttcacaagatcagtgtaataaacttaaccacattttgtctttttacagatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtcagttctttttgccctttgggaattcggcatggtttcattttactgcactagccaagagactttacttttaagaagtattaaaattctaaaattctattaatctctcattaatagtatttaatataaagattcttaaaattactgacgttatgaattggtttgatgcttttctcatgtacctcaatccttattttaaaataagatcaataacactattttcctaaatgttgtccttacctgccctacacatattcagaattgctatggcagattaagacatgtcaatggaagaggtcagaggagtaatattattggaaacagctgtaataggtgccataaaaagcaaacaaacaaaagtattttggttctttgcgaccacagctgtccccaaatatacagatgattcagcacttattttaaaatgaatctgggtattgctaatacccccaaattagcagtttttaattttaaaatacatgagaaatgggactttgtcttgtctccaaagcagtcatctaaaatctacacccccacgattagatgagttattactgagaagttattgcacccacaaaaaagctgccatttttttccaaagatgtcaaaagctagaaggccaggtcttctcaaagtaaaatacactgtgtattggggaaaaaagggtaagaggcataattaccaagttaggcatagtctgtcaagttgtatttagctattatcatggaatagtgttattccctgataatgaatgttggcatcataaccagaatgattattctcatctccatatcttcgtatttacatctaggaaatataaagcttatttatagtgaacactgagagtggtctctctccaaggagtaaagtaaatatgccctggctaactagtgtaagtttgtattctacataattaaccattataagaagtcactgagtagatcctaacttaagggatatttgtttgtgtttgagtatttctcgtgtggtgtttctaagtttgaaaagtgttttataagcatagagcttatgtgtgctactggggacaaatgtctcattttaaaggaaagagggttttctgagatggcatgaaatgagtgaaatctatttattgcctgaaagctaaagtggaatatgaaggcaagtctttctgaacagagcagtcctgtcactgactaacccagggaaaggacaggaaaaagctagaaagtgttttgaaaactcttctgcttaccttttgaattgggacattaacaaagtaaggaccatttatgtgactggcttcctttggttagttatgattcattcattaattaattcatcagatttatatagagcacctgccatgagccaggcattatactaggtgtttgggaaacattggtaaacaaaagcaaagatccctgcttttatggaacttaagatattctgagacactggatcatacattctagtgcagtcaccttattaaaacttaagattttgtgatgcaaacaaacagccagaagctacaaataatgtaaatgttatatttaaaaaatacaatttcaaagaaatgacatttaaaccagttttaggaaagctgaagacaatactgcttttagagctttttaagatcagtttatattgctcttaaatgataatcctcagcttccaagtttttgtgaactcactttggtttatgtgtttgctacactcactgagaaattaaacaccttgcttgatttattgtaaaaaggaaaaaacaacagagccatacttaagcagtcttaaacttatttattaacgttatcttgagtctacagagaacagaaagctatctaagaggtagaaagctgtcaaatacctattatcaaactctgaattctcctataatatttcataaagctattataacaccttaataccttactgtcagtgtctgtttgcagcctttccacatttcttctacataattgaaacagtcttgatattcttttgccat

SEQ ID NO: 14222 - DNA, 88736 bp, Human
taggttagctttcttatttgttaagtgaactataaagcctttaaacctttaaatatctaaaacaattttcataagaaactcagagaaattaagggagaaactgagaggaaaacagtaactggattgtcagttgctttgtgttgttgagaaaaaagaggcagttaaaattgataactaattgcagctaatatattggacaatattaaagtctgcaagtcattaacaagtcagggttaggcaggggtaatatttgttacctttcctctgaaacttgatgtctctattcctgaatatatcattactttgattcatcaacatttttggacaagtaacattagtaataaaagctatctaagtactttcccattgtcctgcttttttttttttaaataaaaaaggtgactatgttttacacatgatagttttttccatgttcttctggttaaagagcagatagaaaaaaaaaacttaaaacacggcaaggctgtaacatgccaaaggtcacataacctgtaggtacagccagatttcctaattattaatctattgaaatattttacagttcactagattactaaatccggttatcaattaatgatgcacctgacatacacccttctagtttcataaaaatcacctcattaggccgggcgtggtggctcacgcctgtaatcccagcaatttgggaggcccagggggtgcagatccctcgaaaccagcctgggcaacctggcgaaaccccgtctctaccaaaaatacaaaaaaaaaaaaaaaaaaaagcaggtgctggctgaggtgggaggatcaccggggcccctgagttcaaggctgcagtaagccgtgatcgcgccactgcacttcagcctgggcgacagagtgagaccctttctcaaaacgaacacacacaacaacacagtaacaacacaccaacccccaaaacatcttattaaactctgtggatctactccatttaaacctaattgtttcaggaaatagtctaaaaacatttttttgtcctggaatggaatgtgtatgtagcctcagggaataactcagtttatcaggttcttggctgtttttccacaggtccaaaaggataaatggataaagtgatgctgaaataacttagagaacccgtattccaacgcttctattttaaaacagtgaagcagtttttaaaatagaaaagtatctacagttttgctttcaagcaaatagcgttaacggaatcattgctattcaaaactatttttgaagtatcggtgtacatttaaaaaaaataatttttaaaaaagaaagctgtcgtattctggattccgcaacccccccaccccgcctcgccactcgtcgccctccctccacctccaccctcccatggcttaagtcgcatagctgaaaggattttgctcattttttccaaaacacttcacgtctgggtagtagccaatcatggaaagtttcaagcaaatgttacatttgggagagggatgaagcttgtccggggctgctctcggaggagtcgccagacgccctgacctgggggccagatgcgagctgggatcggctgagttccgacagctcggccagactcagccctgccaaacctgctgacctcactgccctcggctgcgggggatctcgcccatgagtctccccaacagctcgaattcccagagtggaggagcccactgcttcataaatgcgagaacccagagcccctagtacccaactaggctagcctcggagttggcacggcgtgcagaaagtggctactgagcagccgggcctggctcacccgcttcacacgtcagtttgactcctctccccgccccccaccaatcccccgccctactctccgcgcacccagagccgagagaaatttgactgccctaatcgccaatcaaaagagaggtcgaggatttgagccaatcgcagcgggcgaaaggggcgggccgtcggcgagcgctgaaggtctctagccctcccctgcgctttagcctcagtgcggagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggcatgatgcggctgcgaggctcggggatgctgcgggacctgctcctgcggtcgcccgccggcgtgagcgcgactctgcggcgggcacagcccttggtcaccctgtgccggcgtccccgaggcgggggacggccggccgcgggcccggctgccgccgcgcgactccacccgtggtggggcgggggcggctggccggcggagcccctcgcgcggggcctgtccagctctccttcggagatcttgcaggagctgggcaaggggagcacgcatccgcagcccggggtgtcgccacccgctgccccggcggcgcccggccccaaggacggccccggggagacggacgcgtttggcaacagcgagggcaaagagctggtggcctcaggtgaaaagtgagtgtctccgcgaggcgcaggaggcctcgttcctttcggggcccgggctcaggctgtgtggggccctgcggtggggcgggataggagccgagggtctagaaaagagaaagaaagaggtgccgggcggcctgcgccgtctgcgccatgtgattaggcccggccccgcccgcgccttccccgcccgcaaccctccgccaggcacccacttcccttctccgcccccggcgggggtcgccctggtggggccgcggtggggcctgatgggctcgcctggcgtccccagcgccagagaggccgctcccctgcccgcgctgcgtgctcagctccctggcttgcggctgcagcgcctggccgcccgccccagccattcgtgggcgatgctgcacgaacatctccaccgagtgacatttaggagttgggcgttcagcagagcctttaccttcctgacttgtcgcttttcctggctcgtttccgctctgcctgccctcccttggtttctgccatcatccggttggaagccagatgtgacagagagctctttatatttcgggagtggctacctcaggcacgtgtagagccatctggggcaccggaaacaatgtttcagaagtgagattaggaggaatccggtcatgtggccgagaagatggggcacgcagtatagaccacctgtttgcataagggaccagctttggcttgtcaggtcttccgtgagatggggagatttttagaaataaaagttaaatagccaagatgaaatgtgacgtaatacactaactcagtgaaaaatctgagttgagtaggttttgtgacttcattgtgataggatgttgactcatcctgtatgtgtacggcacagtagtttagtcttaaagcaaaactggtttttcttaaacaatatgcaaagcagtctcctatatatttttgtcttgtgtaatacaaatggaccactttgttttcccaaaatgggtaaaaatttacggatctgctttcattataccttactctttttctggctttgtacgctgacactctaacctgttttgcttcccttttatttctgctgctatttccagctctagagttccttaagtcaaactgaaagtgagaacattgttataatttcaatctcacgcctgcttgatgttttcctgtaattgaagttgggaccttccagaaacttttctaaagttcttctcccagactgaaaaagattatttgaaaaaaatcacttgatgatgggcgaaatttgtggtattttgtgatgttggttttgtgccacaaaatagcgtcctgaccatggacaggttatttaatatcttgggttagatgacttaaatcctttcaagttctaaaaagctatacttctgttaaatttgtacttctctcatgttttagggactagaatgataatttaatctcatctgggactcacttttactttaacatcatccggtttaccaaggaagtaacgagtttacatgcaagtgcccaaggtacagaattgcaaaatgcagtcacaaccgtttaaaagttcatcttaaaggctacaagatgggaactgcattctagtaaaattatgtcttcaggtctgtgtctctgcagtggctctagtgcctctcttttttttcctcttttgtcaaacaggaaattgagcttcttctgtgattcacttgtccagaagtttctggtttcattgcctttttaataaaaaatcaccttttagcaagggcctcaaggttgtgaagaaagttttttaatttggttaaagtttctatttccttaatgatctggtttccaaatgtagctttccctctttggctcctttcattttgcctttatgtgacaaacatttctcttatcctgggaggtaagctcccagttgatcctgttatcctttctaatgcttagcctgcaaagcataggtcatccctcagtcagcagtccacctggtatgctagcactcactcaggactgtgccagattttatgtagtattattaaaagaaataaccatgagaaaattaaattaacattttgtaaaaggcttagaacaatatttggcgtgtgttaaatgacacataactatttattaaataaatgagaaaacattgcttcttcattattgtaaagcctgttaaagagattggccttggaatttcaggcttgcacatgaaggtttttaatttttttagtttccacaaaaatgtttatcttgagaaattgctatacatctgtcttatatgaaactatgtgagttgcactgtttaccttttgctctgctgataaataagttcagagtaaatttaatgcttaaccacaccaatttcatcagttcacatggctgggatatctgcgtttcctcctttccttggtcctgagtttatattttatttactttatattctggaaggaggcgtgatataagcaagttactttacctttttttcacaaactctttgaactaatgtcactttagactatgctgtttccatcacgcaactttagtgtggtttaggatacgaacgtcttaatatcacatagaaaaatttaatgatctttgctcagttttgtctttagtgatcttatttaattttgttatggttcattctgttatcttgaaaaccaactttgcttgcctctcttcgttttcaaaattgttctctcttctttcctagttctttttgaatttcctcactgggtaaaaaccctgaggctgaggcctttgtccctttcccacttgtctgccttctcaacagcgtatcccttctttcagctttgactctcatctttgtgtaggtaatacttcacctcttaatccaaagctctgttcttaaatttgtcgccacatattcaatgacttcaaattttaagtctgtaccctgatattcattcttttctccaattcaacctattttgcgtactgttatgagagtaattttagagttttaatttgaaaatagcactctcttccagaaaaccagcaggatctggaatgagcattatattaaagtcacaaactatgttatggtttatgccagcacttgcccatatggacatttttatcatacttttctctgttaagctggttatacttatttccataaagtccagaagtatgtatcctatcttagtgaatggtccctaggaagagtcagagggatagaggtaaggggcattattaagtttttttatttggacatttattttttaatgagaaaggaaaagagatacataacagaaattgggctggaaaaataccagcatatgtatgctgttagaaaatagataattcatacaggatgcaatattgaaagtattctgttaaaacaacaatgaggtcactttccccttctcagattggcagatgttaaatcaagtaattgggaaaataggaactctagcattgctagtagaagtataaattattagttcagttactttaggcagtttggtagtttctgttaaaaactgcatagctgtgatgtggtagttggatgtttgcatatctacatgaagtcgtggcattcagaaatatttgtaattacacaaataagcatgctttaaaatatatttatatttaaaagtaaaaatgcaagcaaaaatgatttcagctagctttagttagtatggatttatgttttgatagttcagctttatgttttgatagttatggacaatgaagggcaaagaaaatcatcgaggtgtatactctgaaaattgaattttttttttttgagatggagtctcgctctgtcacacaggctggagtgcagtggtgtgatctcggttcactgcaacctctgcctcccgggttcaagccattctcctgcctcagcctcccgagtagctgggattacaggcacccgccaccatgcgtggctaatttttgtttttagtagagatggggtttcaccatgttggctgggctggtcttgaactcctgacctcagatgatctgcccgctgtggccacccaaagtgctgggattacaggcgtgagccaccgcacctggtctgaacattgaatttcaaagtaagatgaaatgcttatgaatttcagcgaacattgaattgggtagattgaacaatactagtaaggaagttgagttagtatttggcagatataaatattaagttttagaactgaatgacaaaacctctgttaaaatgggggcacatgtttttatgatccttcagtattgcatttggttttaattttaaaagctaacatatttacaattcacttaagctaaaatcaaggtggaaagtatgtttaattttttcctttgggcttctcaggcagccccttagttatttttgatttcttcattattaaaaatttttttctaggtgatgattatcagtgagttttagtttttttttttaaattttatttttatttatttatttatttttgaggtggagtctcactctgtcacccaggttggagtgcagtggtgtgatctcagctcaatgcaacctctgcctcctgggttcaagtcgttctcctgcctcagccccccatgtagctgggacttacaggcacgtgccaccacacctggctaatttttgtatttttagtaagatgggaatttaccatgtcagccaggatggtctcgacctcctgaccttgtgatacgcctgcttcggcctcccaaattgctgggattacaggcgtgagccactgcacccagcccagttttgtttttttaaaagcaagtgaaaaaggtaccaataactatatgtcataacatttttgtgacctaatatttatattgaaatgtgcatcagtcattgataactttgtccatgatctgtaattaacaaactcatgctgttaatttatagttttattaatatttggatgaaattcactgaaagaacaagaattagattctgaggggtttagtctcctggacttttagctgcatatttccagaccttactcttttatagagaagtctacctacctcaaagtcagctaatccatgaaatgactaccaaatagaattcagccttttttatgaggcaatatgtaggccagctaaaagggagggggggcactattttagtccaaagataaatgtcactttgaaagaaatttgctgaagatatttgtgggtttctttgagttttaaaaagttatttaaaagaaatcaggctgggcgtggtggctcatgcccgtaatcccagcactttgggaggccaaagcaggtggatcagttgaggtcaggagcttgagaccagcctggccaacatggtgaaacactgtctctactaaaaatacaaaaattagccaggagtggtggcgggcacctgtaatcccagctactcgggaggctgaggcaggagaatcgcttgaacccaggaggtggaggttgcagtgagccgagatcatgccgctgcactccagcctgggtgacagagcgagactcttgtctcaaaaaaaaaaaaaaaagaaagtaatagtaaaaggctgtactacttccttcttgtgatatttgaaatgaagaaaaattatgaccatataagctgaaagcctaattatagaatttgtgtgagggagctcaatcatgttaaatcctatataaattaaggttatattttatagttgcctgtctgtgccttttcacctttaagtcatttgctagtaagagaaatgcttaagaaaggtgagtaaacagatgtatttataaaaatagttattaattactgatatctctcagtgaggtacatagctttcacatagagatactgttagtacagttttaccctgaaatctactcaggtgcaaaattgctttggttatgaaacacattacttgtgagtcatcactgcacttagtgattttctgaccccctacaacgtagtagaagcaaaatgttaatgtaccttgacttccatttgggagtgtcctctgcttgatatgttaaattcattataaagaaatgtttatagtaaaagcattactttcgaaacatagaactgtagatgttgcataatgaataaaactgatagctttcaggattaagaaatatatttttgcctatttatttctggtacaggcttctaaaaaagatttttaaaattgtcttcttgatgaggatattttgagtgacatagacacgtccttcaattcttgatggtaaactttctgaagagcaatttttaagctctatgaggaacttacaaagtattcatacctttttaggaatctaagttcacaaaataaactgaagtgttagaaagatttatttcctattatttttggtacagtgttatgcatactagagaaaaatggagaaaaacgcatgttcaacattagtgggatagttaagtaaattgtggtacattcatatgagggtctcttatttagtcatttaaaatgtttgcaggtactttttaggatataaggtaatgttataacggccaaaagttagaatacagaattttctatgcagtatgatctcaagctatttaaaaagctcagaaaaagtaatagaaggaaataagccaaaatgacattagcagttgtggtttatgagaacgagcattgtttttcctgcctccttttgttacttttaagatttcccccccattataagtgggaaacgtctaaaacagtaaaaaacattccatagttttgaaaatcaaaggaaccacatctgttaagttttgaacttgtaaatctctactgtctactcttctaatatcctgattctggttgtataagaacagtaagcaccattacattgaaagaaaagtatgaaaataggttatgtatgaatttgcacagctcctgtttatcagcattgtctaatcatattcactggtacccttaaacatcaaactttaaaaatttaaaactatgcttgatatatctccctagtaaatgttacatatttctctgccatattaaaacattgtaatcaatagagtttaacatttcttgttcaacttatgtgtattttaaggatgcattattatactgcactgtaatacagtgatgctgtaagacaagtgctggcacactttccctgaaaggccaaatagtaaatattttcagcttttggggttctctagtcactactacaacttctcagttcagtggtggtagcaaaatagctgcaaacaataggtaaatagatgtggcagtcttccaataaaactttatttacaaaaagaggaggtccctgctgtagtttgcgtagccctacactaaaatatatttattggtaagttctctcatgccttgattggttctgctttaaccagtactcttaagggtgggtttgttcttttgtggatttttgtatcttgtatcagttgactgttcttcatgtctctactttagctatcctccttcactcttaccttctgtatccagttctgcttagctttttcaaaaaattgtggttaaatatacataacataaaaattaccactttaaccatttttaagttccctagttcagtggcattaaatacttctgttagttttagaacccagatgaatatgctaatgtgtaaaataaaagtatgtaagttgtgagtgaataaagtttatgatctcactttagtgtagtgatttggaggacatctatttttagcaactcaaaaactgagaattaagcttggaagtaactttaaagaacatttaattccagctcattttacgtattatataagctgcccgcagatattaaatgacctaaacaagttcagacagtattaggacttgttttgattttttatttttcatctattagcagcaaactaattcaatttatagagttaatttttttagattgaggattataagagatcttacaaacccttctccccagctgctgctttcttctcttctgttacatactccctataggttgttgttattcatctctacctgaatactgccttcacaagggagttcactcccttagaaggcagcccattccgttttcatagctgtttcatttttccttatgtgtggctgaagtttttcattaacttctacctatatatgttagttattctgaacaagttgtctatagtggtatcagagtgattgcagtgacagaattcatatagtatctgtattattccatctagactgatatattaaaggatacttggctgaagaaatgagttattggaaaaactaacagagttggatgttatagacttgatctccccagatcctagtcttcccacccgagacagccagactgccttttgggtcaaacttctgaagttgtgcaaacgtatggacaaattaccatgagctgacaggggcagcctgaccatttcctcacataaagtggcttttgtgctttttactttggtgtgctattaaatgaatttgtgctataaagtccagtcaaaacagcagcactaattgaatataatctcatctttgctttgacaggatgcagttttatcaaggcagaccagtttagttctcttatgtgcattttggttagaaatttattattgtttaagaattacagatattattcctaaaatagagtgctaaccactgagagcatgaggtggcagagcaggaagagtctggaactgggaacaaaggacgagctttgtaggactaattctggtccagccacttaagatttatgtgacattggacattctgcttgacttggatactcttaaaacaaaattttttttaaatttaaaatttaaattaacattttctttctttttttagaaatggaatcttgctgtgtcacccaggctggagtacattggtgccattatagctcactgcagccttgaactcctgggctcaagcagtcctcttgcctcagtctcccaagtagctgggactgtaggtgcatgccaccacactcttctaggactctcttttatctgtacactggggacaattaacccaccttaatttacctcatagggttttaatatgatagaaagtgagagtccttttttagcagtaaagccttaaaagatgtaagtttttatttttaaattcaaccaatgattagccttggggcaaaatcacttggatgataactagaatttgtcaatttgttagacttaacattcattctcatatgctattttactatatggtcagccaccatcaattcaactttctatctaacaggtttattaatctgccagtttgctggtgttgatagacggttgttatcagtcagctcactataaattcaaaatgatacactgattttaaaacaaccctgaattatcatctgaaggatcattattcttaaatgaaggcataaagactagcaaatccttttgtattgtgttattattaggcctcattttttttaatcccacttgaaaagacagtttttcattgtctcataggtttaccatactatactatgtgttttaagagttatgcgaaaaaaaaattaagaaagacttgaccccagccttgaagctttatagtttggggaggttaggtaatatgaaatgttatttaacaaaataagaccatacagttggtttcaattattttcctctgttcattttgtagttcttagtaaggatttttttttttattttcttcctttcatttgatagttttttatttataagatttttgaactgatgaagatgagtttgccttgttgctcctaattacagattagaaactttcttgatttcccctaccgattaaggcaaaattaaatacttcatctgtacttgctaataaaatactttttgaaaaacacttctaccatagtatttgtctcatggctttagtcatatttctcctagaccacaaccttactttagggatctttattgctattgcttggcatataataagtggtacaagaaaaggacaaaacttagtgataccagagaatgctaaagagtatagagaatctggtgggggcaaagtcctgtgaaacaattgaaatgatcattgatagcttaagatttagggagaggaaggttttacacagaaggcatgataggttaaaaaaaaaaaagatgagatagcacttatttacaggtcattgagtctagtcaattacattggggaattataaggattaagttaggaataaatagtgtaaaactaatttatagagaactgcataccagactgaggagtatgaattccccctttggtatggggaaactaatttggtcagtggggtaagcaaagacagttcctcttttcgtgttgcagaagttggccctgcatttaaacttaatgtagattttggaaggtagtctcctcatttacctcagatatatatattcagaatatatatattctcaacactaaaaaattaagtattcatataatagcctataggtagaaacaggcaccttaattcacacattctgtgctctagctgttttttgttctttataaacactaagtgaatgcttactttcatccctttggtctgtttgccagaaatctttttctgttgccatgcttccagctcttacccatctttcaggtttagctcagattccacctcatctaaaaaaaagcttgaccttattagaccacagtgaagtagttttccaaagtctggatgtcatagatctattcttgtaattcctcattttatgtacatgtctcctacttcttctagactgtaaatgatgtctaacatgatgtcatacatggcatgggatttttcttctttttcattaagaaattattttttaagacagttaaaggctaaagtaggggaaggaatgggtaaaagaagaaacaatatgatggtaagatgatcttaaaggcagcatttagaaaggaaacgagagagacagtataagttggagaagaagtaaaaaggtgagaaataaggattttccttcagattatcttctgttatatcctatttgaattgctgaatatcataaccattttatgtttttctcttcaggggaatctggaggattcatttgggttattaataattgttgatgataagatttgaaagattgctataatcctatttgtcattaaaacttaaatacttctctcaaggatttcctagttactatatagttaccaaaagctatagtttttagcttttgaattttaatgaaaaatacattattgtgaagaattaccagaaagaattaatttagggagagaaaaggggggttaaggcatgaatgatcttgagtagtttctgccttgtggaaagtttgaggagaatatttgagtatgtttgttcgccagactgttgaagcgaattcattctcagatcaaaatctgaggtttcaaatgctgaaataggtagtaatttctttttatcagttttgacagcttattttgtgagcttattttttagggctggcttaaattctttcccctatagataaaaattaatttcttgtttaaaagcaagtaaacatttgtctttttttgctagctttggcaataacgtggtcattttaattttttttcactatgtgccataagctaaaaaagtgtatattttacgttatttacatagcttttaggcaaagcaaataccatttacttgtgtgataaatacatagaaagcttattctgcagttttttaaagtgacaaactaccactatctgaagtttatttgaccaaccatttgctgtaaataattggtatgttattatccactgattttttgacagctggttcagttttttctttgaatattaggtggtgagtattgttaagctgtgtttaatggtattaggtcaggataagacctagaaaacttgtttgtaccttataaaagtaataacaagctagtaagttagagagccagtataatgtagcagtagtttggattcagaaaaatccatctttgccattgtgtaaccttggaaagcttcttaacctctgagcctctgtttcctaatctgtgaaatggggacagaggtagtcatttttttgaacaaataacaaatttgttgagcttctaagtatgtaccagaaatcatactatgttttggataacagtagtacctctgtcataaaatccttggaggattaagttagaatgcatgtaaaacacttagcacagtgtgtagaatataagtaagtgatcaatatattgtagttattattactaaaacatcccaaatgtattttttttggagacagagtctcgctctgttacccactctggagtgtggtggcacgatcttggctcactgcaacctccacctcccgggttcaagctattctcctgcctcagcctcccaagtagccgggattcaggcgcctgccacaacgtctggctagtttttctatttttagtagagatggggtttcaccgtgttggccaggctgatctcgaactcctgacctcaagtgatcctcctgcctcagcctcccaaagtgctgggattataggcgtgagctgccacgcccagcttcaaatgcatttttagaagttgtctaagagcaaaaacagtttcagggaataattatgtatcaggatatgtcattaaatattttaatgataaagctatgtgtttttaaaaaacatttgtgtgacattcagtatttaaaagtttggttaatcatagcattttagtgttacactagtttagttaattaagatttttaatgcatacttattggtaacgtttttcttttaatagtctttatgatttgtagaatttgatgtatacagtcttgccttgtccttctgtatatgttaagagattggttccaggtcccccacagctcaagtctcttatgtaaaatggcataatatttgcctataacctacatatatcctcccatatattttaaatcatctctagattacttataatacctaataaaatgtaaatgctatgtaaataagtcttatactatcttttgaatgtacgttttttattttttttctgaatattttttatccgtgttggttgaatctatggatgcaaagggctgactaggatatgtaaacctagatcactttagaaataataactacaactactgtcagtggagtcttactctctgccagacatgttctaaagatattgaatgtattgagtcaactgatcctcaccacaaccctatgagggaggcactgttttattccctttctcagatgaggaaactggatcacagaaaggttaattaatttacccaaggttacacaactatagtattacagccaggattcaagaacttgtgcacttgatcttaactactgtgtagtagttaattgctatctctcccagattttataatcaggttaactatttgaataatatgtaaatatagtcatcatatttagaaaatccccaaaacaactgaacagagtgttgagtcttatcggaacgtttgctgaactctataatttgtattggatgattgtactggggtgtataggaaggcatcaccataacggatggctgggcattagcacaactagagttgatgatcagggtttcaaaacctgggattaaaaaatgtgttaatgatttttttctacttgtttttcagtgtggtttatagtggtactgatttgattttggtaaatcaacatttattatgactgtagtcttgagtatatgagctcagctgtagtctagtttagtggttatttaacaatggatttagttaaaaatccagtagaatgttcatacaaggattaattttgtgttctttctacctctttagtaaaataaaacagggtctgttacctagcttggaagatttgctgttctatacaattgctgaaggacaagagaaaatacctgttcataaatttattacagtaagtttttatatttttctatcttaacttaaaaaaatcaataataataaatatatacagtattattgaaatatagtcttaaaggtcgtctgacatgtagattctgactgacaatatttctcttattatgttttcaaatttttgtcatgctcatttcaaggtaatcagtgaaagaaaaagaaagaaacaatgagaaacttgtccagaaagtgggtaatagtgacactaagatgccatattcatgttcaagtgttgggtagaagtttttatatacaggaataaaatcttatagttggtataagcatatacattatttgcactatatatttacaaactcttatttttttaaaaacaggcactcaaatctacaggattgcgaacgtctgatcccaggttgaaagagtgtatggatatgttaagattaactcttcaaacaacatcagatggtgtcatgctagacaaagatctttttaaaaagtaaaagtttctgccaaacctttaatggtgatttgctatgctatacggtgattctgcttttaaaacaaaattgcatctttgaaggccactgcttcctgtgtaatggaaaaaggggatttataaacatcatttgtttgaagaacttggtacatattaggttctataatacaccgggctaagagtattctttctttaaatctgttctaagcaaatttagccaccgatgtttccagtttacagtacttggagattgcattcagtttgagtagagcacatcctttgtcctgtcattgcttatattgatccccaattcatctgcatgacttgcacgctttctcagcatggtctctagttcttttccacaaggtgatttaggtgacatcataaaatgagagggcttcagacagacctgtgttcctcacatttacatacctgcattgtctgctcctctcctctcttcagacatattgatacataggcttttggctattttcattttcttcaaaacagtaaagaactaaaggcaactttggcgattaaagccttgatttggttgaatgagaatttttactttgatgttcctgtatttgcatatatttattatttatcttcattaatgtgtttctattagtttgattacttaaagatttaatggacatgtgtgtaatggatcccaaagaatcaaatagtattttaaactactactatttaagtagaaactagtataaaactgtaaatactactataagacattggctttttccagacatggatccaaaaaatttctgcatctactttgaaagtttgttatgtatggttgtatttacttttgttttatcttcttttgggggttgggtgatttgttctagatgtctcctggagtatgaagtcatctgaaggtataagtatttaactgtggttctctgaagtttcctggcatgctgtgaagcactgctgacagcttgggtttcttatcttttcacgaggaggttcttgtttctgttaacttagctgaccttaaagtgtagactttaggtccgtgttgcagttggtattaggaattttgacttccagaacctgctttttaagagacagaaaaacatcatttctaaatttatttgtgtctttgcggtaaggattatttttcgtgttcatgaactgtctgcacaatattctgattaaagtgctttctgtgggcattattttgttgtatctgtgaatgaagttgttagagtaatggttggtagatctgttgataatcagtaggggaactgctttggaattttaagtggaagcagtattttacactttttttttttaagagacagagtctcattctgtcgcccaggctggagtgtagtgacatgatcttggctcactacaacctctgcctcccgggttcaagtgattctcccacctaaattcccaagtatctgggattaagggcgcctgccaccatgcctggcttttttgtatttttagtgagacggggtttcaccacgttgtccaggctggtctcgaactcctgacctcaggtaatccatccgcctcggcctcctaaagttacacggttttaatacttgaaaaaatatttatgttttgtaaacatgttgttatgtttaaatatgaaattaaaaacaatttaaatcctctgattattaagccagggaactgcaaacattaaattttctgcctgcaattaagagatagtaattattgttttaaacactaatccaatttttaaaaatctatgcttgtaatacaggcagtttccaacttgacaaatgttttatggtctatatgagcaaccagtagaaaagtacaagtctctagggcataattatttctctttattcttagaatgaggtggttcaaaacctccaactgttaaccttttaatagctttcagtcacctggaaaggtgattgcttcagagatgttcttttctctgttttcaaatataagaagttacctagttagtgttgccagaaataaacttctccctttcatgcagctagggaggagatgttaaaacatgggattcatttttccccagagaaataatttataaaggtgggtaggtttggttgaagcagtgtgttaatattttacctaaaatacattgtagattaatatttttagactttttcggtaatctgagaaaactattatgtgtgactttttttaacttgggaaaatacgttctaagcatactttttggagtaaaacctgttcgaaagttggagactgcctgtacccaggttgatagtcaattgtttttaatgctagtaaatcttaacactaatacaagtaaaaatatttgtgtggaaaactaatcctttctttattcgtgcatttttaactttataggtattaaaactttctttgtatgatcataattttttgatctttttgttttgcaagaaagtgaatggtagcctttcatttgtatgtttgattttcttaaaaatttcatatttattatgttattttacaaatgaaaaattatttgtgagaaatgttttgtcaatcattgtgcattagtttttagttataaacacttaaggaaagaaaatgattattcccggcttacagataagaaaactgaacaaaggacagagatatatataacttgctgaaaagcataagcacctcctcagagttcattttatatgacttctcatttcctagttagactcatggtatctatattaaaataactcccaagaaaaaccttactgtttggaatggtgatcggtatgcagttagatactctcctgagaggcaaaattggctttgtcagcctgttaatattaccagtgaaggctgttggaacagctttaccagcaccttctgctagagcagaacatttgtaaagtttcactgagtgtataattttgttaattataaatcctttttttttgagatggagttttgctcttgttgcccaggctggagtgcaatggcgcgatcttggctcaccgcaacctccgcctcccaggttcaagcaattctcctgcctcagcctcccgactagctgggattacaggcatgcaccaccacgcccggctaattttgtatttttagtagagacagggtttctccatgttgaggctggtctcgaactcctgacctcaggtgatctgcctgcctcagcctcccaaagtgctgggattataggcgtgagccaccgtgcctggctaattataaattcttttaaaggtactgattaaaatagttaaatggtagtaggttaataatttaaatttgttcagcagctctcatttttgcatttataacttcttgaaaaatgaggaagtgcatttgatttgttgtagatataaatactggtttaagatcaggaattctatttttctttcctctgagaaaggtgttctttgatgtacatctcttgcaactctgatacttggaagttggattttagaagctatttgaaacattaaaaatattaaaataatggtaatacttttgagattaatattgaaactatctgaaaatgattgcttattgaagtaaatatttcttagctctggggtgtcaatactatataagttatggaaattaggactgtaatttttttaatgttgtaatagggagatccttatgactgaaacaatagtcatttctattaggattttatttttaaactgttaattttatattgaacaaatgagtatatattattctgaattcttattaatagttaaactgtgaaacctggcttttagctttaatttggtttcatctagaacaacttgaattaaaatattgacatttaaaaatttctcatttattacagactaaacaagaaatactgagagtatcttactcttaagatttattatcgttggtattatggcttaacaccgtgtttagcaagtcttcctttgttaattaaatattaattaaatattctattactgcattacagagacttaagaagctcagaatatacaattggctgtaatccatttgcaaaacgttttaaaggctacgttaatatactgattttctggcttaaattctttttagcaaaaagcagaatacagttcaaattattagatttcagaatatcatgctctcccatccacttggtttactatatttttaaaatacttttttaacagtgaaacatttttattctgcattatatttacatatcttacattaaatagcatattgtaatataacatttttggtgactcaaataatataaaattaattattacactacttcatatgaaattttatttcaaattagagattatttttacaagcatatcaagacatttcatttaagacataaattaatctgactaaacaaagttgatataattaaggaaaatatgttataatgcaaaatgtttaatttttgaatgaaatgctagtaatagttatataagaactaagagatgtatttctgagattacttggtaaataaacaagatctcaaccttggcagtctgaattttgttaaccagatgtcgtcatgctgaatgttaccaactctgattgagtaagaagcttgtttcagatggtcttaatacttaaacctggtggaacgccttgtcttaatttgtgacacaattttaggcacatccagattaatctcttacacgttcaacagcttacaagcaactacttgaaagactgctagaaggaaagataatgtagaaagcataatttatagaatttagttgtataaaatgataaatttatctattatttaaatagtgtcctaattattactgttattaccaagttctgatatttgaaatgtacccagtttattaattatctttttacattctacagatgtgttcagagcaacattgttttgttgacacaagcatttagaagaaagtttgtgattcctgactttatgtcttttacctcacacattgatgagttatatgaaagtgctaaaaagcagtctggaggaaaggtaatgcttttgatgtacatattttcataaccgaatcacttaataaattcagcttaatttgaggtctagagagtaaattgtgtagttgtgttttgctaaagaaaacactttagcttcgcttaagaaatttaagtgaagccactggatttagtgtttttacggtattttaaatatttaactttgttattctggttaaagagaaatctaagggtaagaattttttattttcagatgatggtgatggattttaaatttttaagttaaaaaatcttattcagaatttctgcagatctgatatccttcagtattaaacgaaatgtttctagtttttaaaatcctgtaaataatactaggaactatttgattttcatatagaaagttttcattttcttttgttttaactttgggtagctttagtataatccagttggcccttgaacaaagcaggggttagggatgccaaacccacacgcagtcaaaaatctgagtataacttttgactcccttaaaacttaactacttataactactgttataagcgttaccgataacataaatagtctattaacacattttgtatatttattatataccgaattcttacaataaagaggataaaaaatggtattgagatcataaggaaaatatatttactgtttattaagtggaagtggatcaccatgaaagttttcattgtcatcatcttcatgtttagactgaagaagaagaggagggattggtcttgtgtcttgggggtggcggaagcagaaaagaatctgcatataattgcactgtttgaagtttaaatccatgttcaagattcaagtgtataacaacttcagtgtaaatacttactacttacttttaaatacttgattcctaatgttttagtgaaaccctactagcacccatgaccctgattaaataaatttacttttttcctgcttaaaaaaaaaaaaagttcaagttcctctgctagactctcctgctaaacatgagaaagaaagaatgcattggaaaataagaaataatagagactgagaaaagtcactttagatctcataattctcaagtctgttttgcctttagttttcatgagcattgttacagaagatagactatgaagccactgagtgttgtagaataactagtcattggtagaaggtaaaatgagataagaaatttgttggtggaagaaaatacattatttgtcaatattatatctattcatttctttccaatcttttggataggttgcagattatattcctcaactggccaaattcagtcccgatttgtggggtgtgtctgtttgtacagtagatggacagaggtaagtttatttcaaattcatgaaaaccaactctaagccttaacttttgtataatggtgagaatgacatggagaagatcatcttttataatggaaattagtcctaacaggatataatttcaaaaggtaaataaatttaaattttaatgtaatttttaaaaactcaaacagtaacattatattaagttttatgagacatctattttattcacagttgtagtcttgttttttgagtattattcaaatacctgcagttaccaatttgtttcagaaaagcaggcttgtcaaaacatgacactattctctaatgaactgactactaataaaattagtccctatttctcaacttaacattggtaacccatctgtcgttgtctttgttccttgtgttcctgataaaattagcatgagaattaagacagtgcaacataacgtatcccaaagttaaaagtcagttgcaaaacatgtaggatttcatgaagtccatgaaagcagcatttgggaattgcttacattgcaggcacagctgctgacagatgaggaacttgcagaattataaaaaggatagtgatgtgagggcgctttagaaagaatgatttgatttaaaaatcaaagaattaagagaggcccttggaaaatggtaaagttctagaatattttttcaagaatgaccgtgttcattgtgctgggaattagacataaagattgttatcatcttataatttggttttattagaaaattacgccaaagagaaaaatcaatattcttttttcactcatttttaaagacttagctcagagatatattcctttgttttttgtttttttattaaagtatttctgttttatcaaaatagaacttacataagatgtacaacttgtaagtgaacacagcttgaaaagtttatatcagagttgtaattttacctaaatttcgttaaaactactaaaagccgtttaacctagtaattttagattttacttttcaagataatgttgcaattaaaaaccttttttccttttatgaaaatttgatcttttatgttgcccaggttagttttgaactcttggcctcaagtgatcttcctgccttggcatcccaaagtgctgggattataggcatgagcccctgccccccagccaaaaatctgtgactcgtaaggaccttcattttaggtgattttaatttttttttactaattatcctcaagtacttacagtaaaaaatatatgggttagcccattcattttgaaagtaaggaatctgaggaccatagttgacatgatattggcaaaggtgaaatgaacacctaggtctcttaacttctagtctattttttctttcattattatatgcctttatcctcatttgggtcagtaaaatgtactgagcagtcaccatgtgttgaattaaatgttgtgtgctatgaagggacacaatgaaatgaaaaggcatggtgactttatcccttgaagcaaattccggtagggaatggtattcctgtttttgcattttaggaaataatttatcaagtaatggaagtctttgaatttgaagaaaattattatcatgtaatattgaatatgatttttctcttcttaaacattctctatgtctcttagtttttttatctagagaattcagaaagttgacttcagaactagaacatatgtatttttaaatccaaaggtagtaagacaagctcttaatcattttttagaatgattgtcaagtttgaagtaacaatcttatatagtataactatatagtttaagattatagttacacatgaataaatttgataggaaaaaaatatagtgcccagtttcattatgaatgactttcactatgaatgaatgctttgtgatgtgttgggacattgttcagggaacctgggaggtatcagtaagtaaatcaaagatctctgcctttgtgaagcttacattataattgggttggccagaactttttcattcccaaatcttttctctacttcatgtacttctcagtttggtggtaatataaagctttctttttgctctgttatttatctgcatggtaatgatgactgcctactgaacttagtgccagctctgtcatgtttataaaactggatgcttttttttttaatggggcccaggattgtgagtggatgtggcttgcaatatgaggcatttgtagacagggtcccagagaatagtattgaatctaaactgagttctgtttaactttttaaccatggtttagtcacagcttacagctctgagttgaaaaaaaggtgaataatttctaaaagggctagtttattttatgtgattgaatacacgtgggagtaaggaggagcatgctcttactctcttgccctcagaggaaaatttccacattacatatttattatctactttaaaaccattattctgttacgtgaatactttcatgcttttgctttttttcacagtatttctcttaaaataaacataggtcaattctgtatccatggggtctgcacccatggattccaccaaccacagatcgaaaatatttgagccaaaaaagatggatagttgtggctgtagtaaacatgtacagacattttttccttgtcattattccctaaataatacagtacacctatttatatggcatttacattgtatttggtattataagtaatctagagatgatttaaaacacatgggaagatgtgtgtaggttatatgcaaatgctatatcattgtatataagggacttgagtgtccatggagtttggtatcacagggattcctggaatccacctcccacagatatcaaaggatgactgtacttaaatttattctgtaattttgacataaacttgtggttgaattatgggaaaatttttgttggaattgttaacatgtaaaaagaataattccaactatgcagttacatttttttcccagttgatgttattttttaaaaatctccttttaaataggcattctactggagataccaaagttcccttctgtcttcagtcctgtgtaaaacctttgaaatatgccattgctgttaatgatcttggaactgaatatgtgcatcgatatgttggaaaagagccgagtggactaagattcaacaaactatttttgaatgaagatggtaagaattacataaacattggttgaaaaaagaaatgtctcattttcctatgtaaatctaagtcgttttaaacattttttgattaaaattaaaagtatttgtcatgtgatttctatataatccattgagagagtttcatcacctacttttaaaaatgattattttaggcatctcataccactgggaagtgggctagggagaacatgaacttctctcttcataaccacctttagggaaatatagcgaaatctcaaaatacatgagatttgctttaaaataatttagttaaggcagctgggagtgctgggtatgattattactatatgttggtaattattgcagctaaatgataggtgcatgggtgtttgtatattattctatctattatattgtatatagtagttgaaagttttattgtggccctggttgagatagtgaggattattatttttcagtgagtgtttttactttttatccttataacattaaaaaatttgaaagaaatgctttgtgtttaatgcttggttaacaaatctttttacaggaattcaaaagaaaaggggaggacaaaagtagttagtttgatctgatagagattttaagtctaaacatcatttagctgagtgcaaactaagttaaactagtcccatggtttggtttctgttttttaatcttctaagcatatgctgtgtttctgattgatgagttaagatatagaattgaagaaagtgagagcgaagtttgtagtaatggctgtgagagatacacttttgtactttttttttctgctgtataaaaaatgaaatgtgccttatactcattattttattagtttgtaagatgaagtcataagactggtattttcttatgcttctcatcctatttattttgagagcagttacattttctttcccattttaccgtaacctttttattctgatgctacgtttggttttatggacattactgtaaattaacaacttcaataaggacatcatatgcagaagcactttatttactaagctcattgacatctagatttaatattgaaagaattaatactgttattctaaaaataccaaatattttaaaagaaaaatttaatacttttccatgaacagcaaaggagaatagacatgtctagtgaattgatggatttcgagggagatatttaagaaaaaacaaatatagtaatttgaatgtttagaggatttcagaaacaaaaaaacaaaatgggcttggagcaaatgaaattaacagtataagtaatgaatttttttgccatatatatttatggttttaggaatcatgaattattgatactgtattctatataagaaaaaatgacaaatcagagatttagaattgtttataataagaataaaacataaagtttaacaagagattttgcctcgatattcatagacgttttctaagcctgagccaacaccctgagtcttgaaagtaacagtaaatacaggcttcactatattacaccttcctgaattctgattagagcctgtgctcttgagtcctgatttagtttagcccagcaaaaacaatttgaagatctcgttcatatttaaaattgcaagggtagatttttggtgaaaccatacactttttgtgtgtgtatgtatatatgtgtgtatctaaaataataaatttttaaaaaataaatatattactgttacaccagctttataagattgtgatgatttattaagactaatagggatatggtaaatagagaaattgtagtagttttttttttttttttgagatggtgtctggctctgtcccccaggctggagtgcagtggcatgatctcggcttactgcaagctctgccccccgggttcacgccattcccctgcctcagcgagtagctgggactacaggcacccgccagcacgcctggctaattttttgtatttttagtagagatggggtttcactgtgttagccaggatggtctcgatctcctgacctcgtgatctgcccgcctcggcctcccaaagtgctgggattacaggcttgagccactgcacccggcagtagtttttaataacagtagttttttttttttttttgagacggagtttcactcttgttgcccaggctggagtgcaatggcgcaatctcggctcggcgcaatctcggctcaccgcaacctccgcctcccgggttcaagcgattctcctgcctcagcctcccgagtagctgggattacaggcatgtgccaccaccctggctaattttgtattttcagtagagacggggtttctccatgttggtcaggctggtcgcgaactcccaacctcaggtgatctgcctgcctcagcctcccaaagtgctgggattacaggcgtgagccaccacacctggcaataacagtagttttaaaatgtttgcaacatagaaagttttggtaggaggtggctgatattttttatcattattaataagtgagcaaacaagttactttatggagatgtcagttttgcaaactaccatctcccagggaagtctttttctaccttgtagtgatcgggttaatcaacaaattatttatatagctttccttgtctgtattgttaacagctctggagggtacatgggccttgcttcttggaataacttttctgactacaggatacagaaggcaattacatatttctaatacataatgggagaagacatacttaagcattgaatactgttagttgtattatcttacaagtatgtaattgacaggtgccaaaatgtatgtgctgattatatgtgtggaggattgagaaaaaagaggagttgagttaatttacatgaggatgacaggactgaattgataggatgaattgtggatggttgggaagaatgtgagagggcactgcacattttttccaaccatcctcaatgggcactgcacattcttcgtaaccatatatatcccaaccagatggagaatattttctctatatctagagaatatattgtaaatgtgtgtaatgtcagataattgagtttccttaactccagtttttatttggcactgtaaaattccaatataataccgaaaatataaatatccaaattaaattggaaatcctttttaatatttttcgttctttagtatatgtattagcaaactttgcctcagcctcacctgtgaacaaaacccttgtaaggttcatatgcttagcagcttgaaaagcttcttttgatataatatgaaagaatgctgtgtattttattgcctttggggaaaataaatacttgttaaaattgatctttttttgcattatagtttaaagcatgttcataaatttcagatgtcacccatgtccattttgtcagtataacacgctctgatatttcgttactttaaatgatagcctttattagtgttgtaggttatttctgccattcaaaacttttttaaattaaaaattctaaattaaacccatcaactccatcttaccttaagacagagcagggaagcaagaaaatttcacggtcataggtcttaggccgaggttttatactgcagttaggctggtggtgtgttacattctctctggcgggtttccggatgttcagatgtctggcttttgagccaaaggcagaatgagcaattacatacatctgaaaattgggctgtcatgccttaaaatgatttagtgttctttaagacatcttgagtgtagtatatgtagcatttgcagagtatttatcatttggaaaatatttaatactcacatttatgtgataccatttggagtacatagattagcagtcttctaggactgtagagtctaagcctgataatgtcaaaagctctgaaatgacagataataaacatccatacaaataaaagtataaactaatttatactaatttaaactaatttaaactaatttgggataggcaaatcttgattgtaataatcagatataacacaaagattttattttaacttttgaaacttggcattatgaatacacccaaaatgtaggatatttttctttttatttatttatttttaattgacagataaaaattgtgtatatggtatacaacatagtgatttgaaatatatatgcattgtggaatggctaaatcaaagtaacatacattacttcatatatttatttgtaatgagaagacaaagtatgctttcttaacaattttcaagtacatataatacttgttattaattatatcatgttataaaatagatctcttgaacttattccccctgtgtaactgaaattatgtgtcctttgaccaacatctggcaatcccttctcccccctcccccacttctggtaaccaccaggtagataaattaagatgttgaggttcgcttgtaaatagatgttttcactgtccccaagattttatttttggtgcttgtgtcatgcagtgaatgagaatataatcagttgagttttgaaattcttatttattgtaagaattaggagaagaaataggagtttggattaatgtaaagttttaagtaactttaaaattatataagaaatacaaatatacctttattgtcaggaaatacagaaagcctaaaaatatcccctataggctgtgcatggtggctcatgcctataatcccagcactttgggaggccaaggcgggaggattgcttgagtcctggagtttgagtccagcctgggcaacatagggagatcctgtctctacagaaaataaaacattagccaggtgtggtatgtgcctgtggtcccagcttctttggagtctgaggctggaggatcacttaagcctgggaggtcaaggcttcagtgagccatgattgtgccactgcacttcagcctgggcgacagtctgaaactttggctcttaaaaaaaaaatcccttataattttattattctatgtaaatcacttgtttgtgttttgaaatccttctgtgtatgtgcttgtatataaagataaaaataaagcactaagaaaaaagcaaaattgagtacgttagctgtgctttttccaaggtcatttttagtatagtaatattactcaagtgtttaagtatttgaaataatggtattgcttttatattttacagataaaccacataatcctatggtaaatgctggagcaattgttgtgacttcactaataaaggtaaaatgttgatgtttcattttaacctagtaaaactttttttttttaacagctaaggcataaagatgaatctgggattatttatgtagaattatgaaaaattttctcttggtgttaagaaatttgtcttatggtatagtgttaggatctttatttcaaaataaatgatgtagtcatttcaaggcaaaattaaaacagatgactcattgtaaattccaacagtcatttactcttgacttgaagatctggaaaatatttaaagtctgctgaagaaaggcatagaggctttttttttttttttaaagttttgatatttttcctttcgtttccttttggttcttccagaatgaacagttataaatagaattaaaggcattttactgtatatttgttattagtatatgtgggaacaaatgttctggtacttaagacaaagtacatttaccctcaaatattctcaagtctttgatactctcatgagctgaaatcacagtttttattggaacttgtttcatttggttttacttaaatcatgccataattaaaataaataaggcttattccaattatggagttatattttcttatgctttgaaatttgcattgtaagggttttttttttttttagtgtttggtttgcgttaataattggaagatctagtattttaaaataagtatttgaaaatggttcctgtgtgatagatttttaaatctaccacacgattttagatgtttcagatttttaatttctaattataaattttatttatatttaaataaattttatttatgtttggaacatttgtatacttctttggtaaatctgtgcctatctattccaagttagaggaaagcataactacatggccttgtaaatgcattactgtggataaggtaccctggttacatgaaggatatttgagtataaatgatacccttggcccagttcacaaaatttcatctaacttgtatactagaaagcctttcttaacttttaagagttttatatctgtgagaaaaagcttttaaaatagaaggctggtatcttaagaatctatatgtttacttgttacttcaaggcaaattctttgaaagtattggcccatttaattcttataactctaatgaagtagatgttatagccaagtgtttttaaaatgtaactaattgtaataggatatggagaaagctgtcagtttgagctgaaagaaacttgaaaatgcgattatttgcaaggcacagtcctagctttaggtagcttactttgtagtgtgggatatgcaaaagtaaatgggtccttataagaaaattcaataaatgctgtgatgagagaaaagcctcattaataattgcttagatttgaacaagtaacttaaagtagaaataaggaaacacatactataatgtatgtgttaatgcttgatgacaaaaacaccaaaagtgtttcttcccagaaaaatatccacataccataattttacataaactttcaggtgttcactactcttcgaggctgatccatgggtcctagtttaagaacttttaaactgaagagagattaacatacactacgcatagtctcaaaagggcttatgtaaataattaatagaagacttccttcactgcacacagttaaaaatctttcatttaatgattcatgggtttaacagactacaccgaaatgctgcatgtgggaattgcatgtctggttatcatatcacactatcatttcattagtttcacttgccatgtttagtcatgagtcataaactatacattgagctgcattttagtatgagtgattataaacaaagttaaaagatacatacaacataagtgtggttcagtgttcaacagtgcaaaaatttaattgagtcatcttgtacctacaaatttgatcagtgattttcataaaaatttaaatttacaggcaaagttggaaatgaggcttcaggatatggtttatatttaaggtcactttctcctgagtttttgttttgtttttagcatgtgtttcacaagtgctttttttttttttttttttttatgaagttcatacaaatcttggagagcaaagcctgatataaccctatgtaaaattgaatgccccagaatatgtaatatttttcttaggatcttttagggaaaggattaaattcatataaatatctataatgtgatctctgcaaattgtatgatcacataatatttataaattggtattggtttgaaatttaggtaataaaaccatagccaaaaggccttaaaagttgtcaaacccagttctcttactttatataacggaggaaactgagaacctggcaaggttgtaacagcagtagaattggacttgaactaaatctcctgatactcaatgtgctgttcattacaattcactctgccatatttaacgtaggtgtttgccatttctcttgatgacatctttaattttagttagcatagttatattgccccaaatgcagaagtactatttccttaatttgaactggttcaaacgataacaatttattggtttaaaagttgtatctcatttgatagcaagtgttacgtagtcattcttcggacattagtcagtaaagaaacaggcccttttccaagatgcttgcatctgagtacccaaagccacggatatttcaccatggctactagaggtgaattctgtttttagctcttttaattgatgaccttaaggctatttgtgattttttttttctttcaaaattcaggaatttatcatggtgccattaaaatcattttcttcatgttaatccccccaccccaaaattaagtagagtctttagtaagactcttgatttcataattttgtagtattgatattttttccttgtaggattggtggtgatcctcaggaaatgggggaagaggcagagcaaatgttcaaaaggattagcagattgtggaaaaaaggagaatttggacagaaggagcctgttgcataaattcttaactactaagcttataggaaaactccaatatttaaaattttaaacaaagctatataggtaaatacctttttaaaaacaaatgtaattttatacttaaaatgcacataatttttaaaaatcataagggtattatacttcctctctttttctctgtggtagctactaactttaaaggaatactttttgttgtaatctgttttatttgggattgtgataatgtgtgattgcttgattaaaaggaaagaacaaaaataaatttgaaaggaacagttatttttatatgatgtagcagtatccttacgtatttgttttcttttcactggtaaaaatttcacgtagttttagtttaaaagttaagatctggtgataacttaagggttaggataggaaaatgaggacaacatactgcaaaataattgccacacttaatgctttttcatgttagaaatagtaaaagttacactgtcttctatgtttttacctctcagagttttttgttttttgttttttagagacaaggtctctctctgttgcccagtctaagtgcagtggtacagtcataacccactgcagcctcaaactcctgtgctcaagtgatcctgccacctcagactccagagtagctgagaccacaggcacaggctaccatgcagggctaattctttataaagctagggtcttgccatattgcccaggctggtcccaaactcctggcctaaagtgatcctccaagtttggcctcccaaaatgctgggatgacaggcattagccactctacttggcatgcctcattctagtggtagtttccagtttttgtcatttaaagaagttcaattttctttttaatcaaaagtatttttgaattttaaaaattagggttttttttctttctctttaaacaatttgtaatcatactcattgaaaatcaagacaagcttagttaatgtatatgtgatgttcagtttggttatgttagcaataacctgttaggcatgcttataagacaggtttttaaagtagtttgtgactctcagagtaatgcatgatgccttggacttgcaacattcagaagacaggattatattggtttatttacttcttgtttatatcagtttatgctttagttttttttttttaatgaaaggtagagcatttattgtcaactgaaaattgttctgttactttatttttagggttgatctatgaaaatactagatctagaaaaacattcttttttacctggagtgtcttattttttattttcctaatactctttagctttaaaccattttctatcataagactaaattaagagtatttcacaaaatcgtttttagttacctctttttgcctttttcctctatgatctctaatttttaattggcttgcacctccatactttatgaatggaatcaagtgcgatacttacaaaataactctgatgcattgattttaaatgagccattttattattaaatttattggcagatgtccttgttaacagtgtttttcacctgttataaagtataatacatgaatcaattcataaatatgttgtaaaaactataaaacattgcaatatagttacattaattttttaatagataatgttaaaactcagtgcctctatcaaattttcattcatacagtattcttcaaaggaatgtaaattctgtaacttgacaggcatatttacagaaaaattttataatttactttttttttttgagacgaagtcttgcttgtcgcccaggctggagtgcagttctgcctcccaggttcacgccattctcctgcctcagcctcccgagtagctgggactacaggcgcccgccactgtgcctggctaattttttttttttttttgtatttttagtagagacagggtttcaccatgttagccaggatggtctccatctcctgacctcatgatctgcctccctcagcctcccaaagtgctgggattacagacgtgagccaccgcgcccggcctaaatttgtataattttctggtaccagaatctgattacccttttcaaacaacccatatgggtttgttttttaaaaatcatttggtgagtggattagaaattttgataagtatatttcttccaatttggtttattttaaaaatgtttctactgtatttactacaaatgattatagctttttcaaaaataatacagtatctaataatgcttgtacagtgatcttcaaactgggataaatatatctttggattccatacttggaattctttccaaggaataaaggggcattgacagttttaagataagtcagtttcaaaatctgtttctagatgcgccttttaaaaaattaatctgcctttagtccaggtgtcctcctattttccaaaagaaagacatagtctcatgtctttcaaattttagtacagtgcactgcttcacattgtaaaaacctcagcccaccagcaaaagaggacattttgaaatattagagtcagtgttattaagggtgtgaaccattgtaataactggtaataagtcctgttatatactaggttgtttccagttctttggtttcagcaaaatcgaaagggaatcttaagttgtcagtcaataggagcattagcataatttttgaggctagagtactgtatgacttttggcatgtaatgagctggaggcatataaagaactgagtaacattgctataataaaacttttaaaatttcaatctacttgtctattataagcaattcacacctctgtaaaaattaaaaatcggaagagaattagtcctgagttcattctagcaatagaagatatccactgatatatgaactaaaaatcaattactgtttcaaatgggaaagaaaaatactcaaaaggaaaatcttacaaattagtatgggaaattattagcaaataaatatttttcctttaattttttattgtgaaaaaattcaaacatacaaaatacacgagtatgaccagctctcatttatgcatgcctagcttttatttttgttaacatctgtttctccacccagctcaccccactactccataatgataaagataatggattttttatcatttttagttttgattttgcattgggggtggtttactctcttttgtatatgtaggcatgtgcttttcctaagagctttgcaaataaactttttactgtaactttttcagaattaatatgacatgttaatgattattagatctcatctatccttggggtacatggagtcgttccaagagatacacaagcagatatagtttattgacttaagttaaatgccatttccagggtaaataatatgaacaaacaataatcaaatgcctttacatttaaatgaggaagtatgggggagaaacattctttagtcaatgcaattattcaatacaggcatacctcagagatattgcagatcacctaactaaagtgaagattgcaaaaaagcaagtcataccaattttttcgttaaccaatgcatacggaagttgtgtttatactatagtaagtgtgcagtagtattgcatctaaaaaaaaacagtgtgaataccttaattaaaaaatattttataggtaagaaatgctaaggatcatcggagccttcagtgagttctaatctttttgctggtggaaggtcttgtcttgatgttgatgactactgactgataatggtggtggttgctgaagattgcggtggctgtggcaatttcttaaaataagacgacaatgaagttgccacatcaattgactcttacttttatgaaagatttctctgtagcatgcaatgctgtttgacagcattttactcagagtagaacttctttaaaaattggagtcagtcctccaaaactctgccactgctttatgaactaagtttatggaatgttctaactcctttgttgtatttcaatgatcttcagagcatctttaccagaagtagttttcatctcaagaaaccactttcttagttcactcatgagaagcaactcctcatccgttgaagttttatcatgagattgcagcaattcagtcatatcttcaggctctacttttaattctagttctcttgatatttccatcacatgtgtggttacttcctccacttggacccctcagtcatccatgaggattggaatcaacttcatttgaactcctgttaatattgatatttcgaccacctatgatcatgaaagttcttaatgatatttagaatggtgaatcttttccagaagattttcagtttactttgcccagatccattagacaaatcactattattgcagctattgccttatgaactgtgtttcttaaatagtaagacttgaaagttgaagttactccttgatccatgggctgcagaatggatgttgtgttagcaggcatgaaaacaacattatgctccttgtacgtctctatcagaactcttgggtgactggtgtgttgttagtgaacagtagtattttgaaagaaatattttttttttttctggctggtcatggtggctcacacctgtaatctcagcactttgggaggttgaggtaagaggattgcttgagcccaggagttcaaaccagtctgctcaatatagtgagactcccatctctattaaaaaacaaaatctttttgagccgtaggtttcaacagtgggcttaaaatattcaataaacaaggttgtaaaccgatgtggtcttatctaggcttgttataagcccaggcagggtagatttagcataattcttaaggactctagggtttttggaatgatgaatgagcattggcttcaacttaaggttacaagctgccttagcccctaacaggtcaggctgtcctctgaaaccagacattaacttcttttggctatgaaagtcatagatgtcatctttcaataaaaggctgtttcatctacatttaaaacctgttgttagtgtagtcaccttcatcactgaagttaggtagatcttctgggtaacttgctgcaccttctgcatcagcccttgccattgtttcaccttgtacttttatgttatggagacggcttctttccttaaacctcatgaatcaacctctgctagctgcaaacccttttccgcagcttcctcaattccctcagcctttatagaattgaagagagttagggccttgttctgaattaggccttggcctaagggaaattgtagctagtttcattttttttttatctagaccacacaaattttctccatgttaccggttatgctgttttgttttccatcatttgcgtgttcattgaagttccatttttaatttccttcaagaacttcaagaaatgcaaaggaaacttcatttacaacttggctaactttggtgcaagaggctcaacttttggtctgttttggctttcaacatgcctttcttactaagcttaataatcattctagctttttaaaagtgagagatatacaactcttcctttcacttgaacatttagaggccatagtagggttattaattggcctgttttcaatattgttgtgtctcagggaataggggtccccaaggagagggagagagatgggaatgaacaatcagtgaagcagtcagaacatatacaacatttataggttaagttggccatcttatatggacatggcttgtggtaccccaaaacaagtgtaatagagcaaaaatgactgatcacagatccccataagacatctaataattatcaaaatgtgacacagagacacaaaatgagcacatactgttggaaaaatggtgccagtagacttacttgatgcagggttatcacaaaccttcaatttcttaaaaaatgcactatctgtgaaacacaatgaagtgaagctcaataaaatgaggtgtgcctgtattttcttttgctctatttacataatctgtctagagaatgttgagtacccaaaatgttatactgtataatgctagacattggtaaataccagttgtttcttaaaaacaacgttaagagcaaaacttaattgtgctttaatttagtaagtcacaaaatagaccaattatgtgaccatagtctagagttgaatggtttttatttttgtgtattaaacatgacagcccaatgaagaaaacttgtaagagttttatagggtacagtttaggtcacagaatgaagttcaacataacttgtttattttacattgattgtttaaccagtaattatccatatgacatcccaatgcaaatgctgacatccatttccaaaagagttgtttttttgtgctttttctaaggttacaaaggtttttgtggtttaaatgttgttacatattttacagcattaggatctatggaatattttgacaactgcaacagttcaatgaagttggtaatttcttcttttaattatttttcattgaacagctttggagttacatttctacattttgatttctggtatattataaggaaagaaaaaattatgtcaaaggatactttagagaaaatacatagatagtgattacaatatggctgtaattaaattatccttaatcttgttgaagttttgttagtgcctaattttgatgaaatagtatggtgttccttccagctactgattgtatatatgtgattgcacatctttcttaaaaaagtggatttgtaggttttcacatattgtcagccacactctaatcctcttgtaaagaatgaacctggctttattcaattaaataattctctggtacaggttttcctcccgtaatattttaaagtacaatgttttgggttttttgagggtaaagtaaaagaaaatatgttttaaaaactttagttgtcaaattattttattttaagcctattttagaaattagagatgtattgtttcttttgggtgcatatcaccaattaatacgtttgatttcagatctacaacttactgctttgtaaacttcgccgaggtaaaatgaaaccatttggctacttgaactgatctacattacatagatttttcctattgacatttgcagtagataacatgtcagaaatgaaagtgatgaaacaatacatcttccatattctgaattggcataatgctaaatacaacagaagctaattttttagagactgtgaaatataattttttttagttcaagtatattatagcaagtgagagctattaagaatagagctttctctgcagtagtaaaatgcaaccagaatgtttgcatatactggaattaaaagattagttttgcaacataattcatttttctaactctgatattagtttaaggatttaataaaatataagtagattgttcttaattgaaatattttatatatacttaattcttttcgaagggtgaaactttattttaagtttttttaaatataagattaaataaataacacattttagcaaattatgtgctgtcatgaaagataagggaattcatggtaacttgtatttaaaattctgtaactttgggttgggtaaagatatacttaaaataaagcattccctttgtaattctaatgcattctcaacatatgggtattaaataacatgaaaaaaagtttatataaatgttaaattactttagaactatttcctagatttaaaaatactaatgcagtatattataatagtagctttgaaattttgatattggcttgaaacttaactgtagtggtacctatattaacgtatttatgtctcttatttttttgcagcaaggagtaaataatgctgaaaaatttgactatgtaagtgcaacatgtcattcagttttcatgccacattctctatatatttgttttttgattactaatattccctacttttggtttctaggtcatgcagtttttgaataagatggctggtaatgaatatgttggattcagtaatgcaacgtgagtgttttaaatactgttttgttacgtaaaaacacacaactgtatttagaattgatccactctcttttcattggagggaaatgaatgatttctaaattacctgacagaaacacttaaaaatactttaaatagttttgacaaatttcttacaggtaatcatacaatcagaagagaccccaagtttatctcaaattactggtgcttattcagttttatctttgcttgtaatacctgtcttacctctcttctatttctgttccaggctatctggatttttaccccaattttttattttaaaatttgtgagtctatagaaaagttgaaaaaataaatatctggaatcttttacttatattttctaatattttgtcttacttgctttttctcaatctctgtctctttagatagataaaaaatatgtatgtatacctctaaacacaaatatgtaaatatatatgtacatagattttttttccctaaaccatttcaaattaagttgcaggcatcatacttcacccttagataagaaagcacatacagtctaagaataaggacattctcctacataaccacaataccattaacacatgtaagaacgttaacgttaattttaaaatatcatgacattaatcaatatgtaaatgtccccatctcttccccaaatgtcttttacaacttttattattattttttagattcaggaacaaatcaaggttcttacattgtatttattacgatgtctgttttgtctctttacttagaacagtccccgtgcccttgctttcacaaattttattaaatggcttttatttttaaagagtgcaggctgcttgttttatagaccaggggttgctgactttttctttgaaggaccagacagtaaatattttaagcttgtgtaccatacggtctgtgttgtaacttctcagttctgccgtttagtagaaaacagccatagacaatatgagggtgtgttataaaaaactttataaaaacaggcagcaggccgtatagtggatgtttcccattttgtatttgtctggttccttgtcattagaaacactataatgttaaacgttatcgtaatattattatgttaaacagttttagcatgtatactactattttattcttattttgcacttcctgcttcgcatttcaggggtaaacattttcaggttgcatggcttcccaacattaattcatcagcttaagtatcttttccaggaagtattccatgaatctcaacttgcctcttttctgtgctcttctgttaccatattttatcaaacttattacatgtctctctttgccccataaccaccattagactctgccctccttaagacctagatggaatgttgtgtcttccagttcatttctgtatccctgttatctggcagataataggcacttgagatagtgttgaagaactatgtgtcagtcactgtgataactgctgactagttagtcatttatctaaactatgttgatgttttttttaaaagtacggcaaattgataagaatttgaaatgttaaaatgtgcaattagaaggggctgtccacctcagtgatataaagaacattaaccacagttcctctaatatcagcagcccttttagacttgtagggcaattctcaaatataccgcaaattaaatctgtctaaatcaaaactcattctctttctttccaaactgctctttgctctagagatagatccctgtatcagttaatattattatcctctcaggctatgttagaaattcaggctttgtatcagtctttactctgcctctcctttttctcatcaggttggaagattatccaactacttgcatatttgatcatacctctccttccattcctatcacagctgcctaaattcaggcttttgtagctctcattacagtattctcttaatagatcagtcatcacttctttttcccctttttcaaactgatgtcagagttatctttccaaaatgcagatctgattaggtaacttctttgtaagccctcaggcttttgttttgtgggtagtcaggagctattaattatttggcatctattggttttgataatttggtcccagtctcctttgtttgtttgatgttttcccactcctctccatgtgccattccccagttacatcagaatatttgccattcttcagtggagccctgtctatatacttttctaacccgttcatgatgcatggaatttgccagtgcctaggcctcaccctgaaatctattagtccattgagtcctgcaagatccattttgtgtttcccactctcagtgaaagttccatgattatgtcaagttccctgattatgtcaattaaaatggactcttattgtacttttgggtagccagaggattctgcagtttttcagtgtattttaatggtagaagatttgagaattttaaaattagcatttttgtttacaaaatatgaagactagaaaggacctgaattcgtttcagtcattttatagccaagaaaatgaagattgaaagaattaccacttaaatgacttgtccaaagtcacacaaatagcctattgacagaattgattggaactctgtagtcctgaatcttagttcagtgttctttatgctgtacattgctatgcaaatgaaattatgaacaatcacacttttaaagaaagtacatagagcaaatgtttttttttcttcttccaggtttcagtctgaaagagaaagtggagatcgaaattttgcaataggatattacttaaaagaaaagaaggtttttaaatttttgtttctatttcaaattattctttcatttaataaaatacatgaagatgtatgctaagaattcaacaatagcctttaagcaactacctattactatttaaggtgcagaagtttttgcagagtgctcgtgagtcagtgttatcaaattgttaatgttattgttaatttgatttgtatctggcagcatttaaatatttgactcatattatttattaatacaaattttgtttgaggtttagtctattttttcaaaagcatgatgcctgattactgttaactactcttgatttttttaagtggctggtctagtaacttgatttataaatcatgaatcattttatcattgtcagttaaactagtatctagaaacttacatgatgtgataaaattttgcttttttatttcatgtttatactcttttagaagttacatgctattttattaattaaaatgaaacacttgtgtacatttgaaatttttcatatatttctctacttatgtgcattcctgtgtgcctgaatttttaattgcctttctggtttttttagtgttttccagaaggcacagacatggttggtatattagacttctacttccaggtaatctaattatgtaaatcgtatatataaatggatgtgtcggctgggcacggtggctcacgcctgtaatcccagcactttgggaggccagggcaggtggatcatgaggtcaagagatagaggtcatcctggccaacatggtgaaaccccatctctactaaaaatacaaaaattattcgggtgtggtagtgtgtgcctgtagtcccagttacttgtgaggctgaggcaggagaatcccttgaacctggaaggccgaggttgcagtgagccgagatcacgccactgcattccagcctggcgacacagtgagactccgtctcaaaataaataaatggatgtgtcacattatgcaaaatatagatgtctcagaaatcttggttctaggccatgagaaaatacattttccattgactttcaaaaatgtcttcataaaaggcagtctcatgtccatgcatgttgcctaaaaattcatgcctcaaaatgtaatggggacaattttttctgtaaacatatttaagaattgtcaaaaataatgaacactcccagaaattggcactcttaattataaactgggctctaaatttttcgtagcttttacattttgtttgggaaaagctttattttttatttttttattttttaaatcagagggctcttattcagcatttaaaagtgtcagtgtctcagctgacttggtatcttgtaatttctttgttactactctatcctggcttaactggtgctagttcatttctgcagtgtcatatgtcgggctttcttgtaagttagagtagctctcaatattgagggggtggggttgagcgagagggaccgtgttacgcacaatgggctatggtatagaactcaatttagaatagccttcctggagatctcttctttcacccacattttcagctcaatttattcttacagatttaacacagttggtgccactgatggggctgtaatgtgaagccacataggaggctacattattgttaatttctagttcaccttacatttgcctgtctttactattaaaggttccttaattttaacctttcagtaatcttagagaatatataagggaggttgataatgagttagattttgatagatgtccaggttgcagcttttcatcggcccaatgtgaaaaaccgtaaattgggaatccagaccatcaatataaaatttaaggtctagcctggccacttattagccatgtgacctaattttagttactgatccctagtttccttatgtgtagtatatgcgtcacctgccttgccatattatgtggaagataacatgagatgatatgtgaaattcctttgaaactagccttttttttccccctggtctgtatgaattttttccgtaagtttcttttcctttggaatacatatttaaatttggctgttatagaatctactgtaatgtgacatttctatacttcattgcaaaaatcaagaaacagccatagaagtggtactgacttttttggagaagggctgcatcaaattgaacggccattgagattagcaggagagtacccgagttggcatttggcaaattaagaatgtgctgccttatgacaaacaaaattccaattaatgttaagtataaattaggaaatgatcattggaattcagaaagccttgcatgattaagtcgaccttatcacaaatctttgctatctggggcagtattgcaagtcgattctgtcgtttttgagaaatagggaagagattttttatataaataggcaatgtagtcaaagttaaacacacaatgttctaattcactgtacttagttttcctccttgctatttccaaacccctttgtgcctcttgtagatcttggagtatggctgaggaaaatttataagttgaactcattcttctcctatccactttattttttgaccccgtctcatcccaattttgcttactattagctaaaaataaaatgtggaaaaatttattttcattttatgggtaaatttgggtttggtacggtgaactattttcattattttgattgtatttaaatgcaaaaattttatcctagagggtattcttagcacccatagtaaatatcaaataaatattaataaatggtctaaaggataacattttggtttaggcttacagagcatctgagacagatctgctttatatttttcttcccctttttcctttgcctgttaccatatagatggggatgccgaactttgttatgggtgaaatgtcaggcactgtagcatttttttctaaaatggtgatttctcatgtagacactatcataatcttcatgtatggtgctttatcttaaaaatatttcatggctctttttttttctgttgagttaaaagtaattatgcttgtgtattccacagaaagtattaatatttaagcaaatttgaatatcacatgggataataacaaatcttagtgtttagaggctggcacttcctagtctagttctgccattaaaagactgagtatctttggccaaatcagggtaaatcttaaaagtgggtaggacttcggtcaactaaaatcttcagaatgtcctcaagtttatattaaagtaatctctttggaagaaatatttcagatctgtatgaaataccaaataaaatagattatcttaaaagtgaacagtaatattaaaagtagtatgagaattctgctttttctttgtgttagctgtgctccattgaagtgacttgtgaatcagccagtgtgatggctgcgacactggctaatggtggtttctgcccaattactggtgaaagagtactgagccctgaagcagttcgaaatacattgagtttgatgcattcctgtggcatgtatgacttctcagggcagtttgctttccatgtaagtaattgtttaatcttattttctctggcaagaaactagtctgaactggttcttttaaaaatgcagtttgaactttgcttctaaagctgtatattaatttttgagagagaggcttgttttcaaggttaatttgttacaagattagtaaggaatagagataaggtctaccagatgttcttaagaacttggaagtttgatttatagaacctcatcccttctgcttttaaggcaatccagtgtacaaggttagtacagtctttctttactttttgtttttaatgtttagcattatgattatgtatcttaagaattctctaagttcagaaagattgcaaagatgtgacgtttcacatctttggttacggccatagctgttttaaggactaaaagtgtattaaagttaaaacttaacaaaaatgtactgctttaagctctgttgtgcatttgccacttgtaaagtatatagactttttttatttcattctgctcatgtcaagtcataatgcccttctaaaagctttttttattttggaaattttcaaacatgtaaaacgagagagagagagagatacatttaatgttatccatcactcagcttcattaattatgaatacattactaatcttgtttcatctgtatgtgcatctgtttcccctatccttgtcatatttcagtatgtaattctaaataaggatccttaacaaaacataacaataatacagtttttacatataaaaattaaatattacatatcaaaactttaatatcattattaatatcaatattaaattgaatatcaaaatatttagttagtgtttagatttcctggattatcttgtaaattattatttctttttttttttttttgagacggagtttcactttgttgcccagactggagtgcagtggcacgatcttggctcactgcaacctctgcctcctgagttccagcgattctcctgcctcagcctcccgagtagctgggattacaggcgcctgccactgcacctggctaatttttgtatttttagtagagatggggttttgccatgttggccaggctgttctcgaactcctgacctcaaataatgcacctgcctcagcctcccaaattgctgggattacaggtgtgagccattgcacctggcctattatattattttatagtttgtttgacttaggatacagatgaggtgcatacattatgattgggttttgtctcctttttttttttttttaaatctattggtcttcttttgacctgtctctctttttttcttgttatttttggttggaaaaactgggtaatttagtctatacagttttccactgtctctacattgctgattacctctgttccattgtcccttgtatttcctataaatttgtagatccaattcaggtgtgttttttttttttttttttttttttttggtctgcttgttttgtttagttttgtgtaaaagtactttattggtatacttcttttatttttgtttgtttatttatttatttattttgagacagagtctcactgtgtcgcccaggctggagtgcagtggcgtgatctcggctcactgcaacctccatcgcctgggttctagcaattctcctatccagaggtactgactgactgaatgttagtaagcaattaatgaacactgctctaatgacattaatttttttttttatcatttgtcaagttttgctaatgtaacttaaattttttgaggaggagtaatttaaattaccattttagaaaatcttttaagaatatataactttttattgttttctagttgtaaaatatttttaaaaaataatttgttatatttaaaaacaatacgtttatcttagaacaattagaaaatatagtcaggaagaataaaagcatccatagcctcacaatttagatgtaactgctataattccttagaatgtatctttaaacaatttttctatattcatatctatcccaaactgtttcataatttttttttttttgagatggagtcttgcttcgtcacccaggctggagtgcagtggtgcgatcttggctcactgcaacctctgcctcccaggttcaagcgattctcctgccgcagcctcccgagtagctgggattacaggtgcctgccaccacacgcggctaagttttgtattttttgtggagacggagttttgccatgttgcccagggtggtcttgaactcctgacctcaggtgatctgcccacctcggcctcccagagtgctgggattacaggcatgagccaccgcacccggccttataactttatttataaacatgttgataaaaatttatctacaatatttttaatgttgaaattctatggtatgtatatatatatattttttttttcgagagggagtctcactctgttgcccaggctggagtgcagtggcatgatctcagctcattgcaatctctgcctcccgggttcacctttctcctgcctcagcctcccgagtagttgggactacaggcgtgcactttgggaggctgaggcgggcggatcacaaggtcaggagataatttttaatttttaaaccaatttcccaattgtgttttttttttttttgaaactggatcttgctctgtcatccaggctggagtgcagtggtgcgatcatggctcactgtagccttgacctcctgaggtcatgtaatcctcccacatcatcctccagagtagctgtgactactggtgtgcacttccatgtctcactgttttttgtagagacgagatctccctgtgttacccagcctagcctccaactcctgggctcaagtgatctgcttgccttggcctcccaaagtgctgagattacaggagtgagccatggtgcccagccccagtttccctattgttgaacataacatttcttattttaaaatgtttacctgaatactcttttactgaattatttttaggttggtcttcctgcaaaatctggagttgctgggggcattcttttagttgtccccaatgttatgggtatgatgtgctggtctcctcctctggataagatgggcaacagtgttaagggaattcacttttgtcacgtaagcatattttcttaatgtaaataatggtgttacaagttgagccatccaatgattcttttttttaacccattttccatagttcattaactcttggccctccgcctatagtgtgccagttactagggagccgtggaaatactcccagaggagcttcaagttgtctctgtcagacagctcccatttaattattcccacagattatatttgttagatgctaatattttaattttcatggttataattagtatcaattttcaaaagctcaacaaaaggtattaaacttggagaagtaatttaaaagccagtatatcttaagaattattttggtttattatatctttaatctgcatggttaaatatctttatccattgactacctttaaacatttttttgaggaaataagcactgaaaattaaaaaaagattaaaccatttttaaactgttactgctcttgatagttctgtattttgttgttacccagttcctgctaatgtttgagcttctagttttagttacattgattacttgcttgagttcatattaagtaccatactcaattaaaattgttttattttccagtcttttatattttacaaaaactagagtatgaccttggagtgcatataaaatatagtagattgtaaccagagtacttatttatattttaatgtggctttacacttatttgatagaagaattctttcatggggccggttataaaccctattttgtagaagatgaaagatgatttgattggctgagccctaggatcatgttagtaagcagtgttcttaaaacttatatccatatcttactctgattttagttctcttcttgatgcattatactactttattagcatgtagtgatgatttctaggctggacgatataagcagagtttgttaaaatatggatatatataaccaatgaatagccaatttcttatacctgctctgtataactgtttacaggatcttgtttctctgtgtaatttccataactatgataatttgagacactttgcaaaaaaacttgatcctcgaagagaaggtggtgatcaaagggtaagcaaaattcttatttagataagtatataaaatttttaagaagagaaaaagtgagatttgcctgtataaataaaatcttagtttgttagtggcctcgggtctttgctaatcataaatgagtgtaaacaaattgttgacatataaatccgggatcaccagtattaaatacttaaagattgtttaatagatagttaatagatacagatatttaaatattgctgttttgttatttaaattgaaactagttagcctagtgtcagggatttccccttccattttctgctattttaagcaagatttttagaattgattctgttaaaaaaagaacaaaacaaaacattggaatgtgctgcatgctataaagaaagcatcgttttaatatttgttcgtcctaaattgaagtttaacttcttgcatactgtgtagatggatatgtaaatggaaaaggattatcatattagtgagagaccgtatgaagcctcaaaagttttataagtcactgtagatgaaatatttttttccaccgtgtttaatgcaatattcctaataatcttacggtcctatttgtttgttacgagtttatttggcttcatactattgtacacatatattcctttttttagaagtagtattaagagtcaggacttaacttttttggtctatatagtttttcactgtaccaaggggcttgtgctgagaattttgattcagtttctttgcgtaccatattgaaaatgtttgtagtaaaattacctaattagacctcaagataatatgaagaacttctaagtagaaaatatttttaatacatactaagtacattttctgtagtgctaaactaaatttttgttagtttttatcaaattaatttctgttactatgtaagaattatgcaaaaccaacagaatagaaacttccatgggagtcgacctgagtaacatgaagcaaaatgtcagaggtggtggtttaaaatgttaacattttaataatgctcattgaaaaataccattttatagcttggacctttcttcactcaagtgcactaataaattatgtatgttgcttgaacaactagcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgattttattgttttttttgttttgttttgttttgtttttataaaagcaacttcaacattttaagtacaaatacagttgggattttaacttagaaaaaattattctttatgaagatactgttaaagtgtttgctattctgaagctgcctcaaagtaaactagaaatattcaaaagggctttatttgattttttaaaatgcaatatagcattagtggtttttttgggaggaggacttttcttattggttgtactagaagtatttgaataaaaacttttctctcaatttttttggtggtttttccatttggtaactttaaaaaaagtgcaaccctatttgtaggttatttctgctttctgaggaggaatattgttgttattcactatgtaactctcattttatctgttgttgcctaaataataggaaaaacattgctaaaccaaatgaagagtatcatcatattgctttagaataaaactgttaatctcagtagaatttatattaaacagaatgacagtgatacagaaattcaccttaactggtttctgaggggattacattttcagaaggaattttgtatatttccacagcatgatccaaattatagtacaaattatagaggctccatgtattgtaggtcaaatatagtactttacatttttatgtttaattaaatctgccattcatattctggagattcctgaatatattgtagaagttttaaaactatttgaaaggggaaatactgttgtttacatgaatttgtattaatctgtgggatttttaaatgaagttcttttagaattagttaataaggagttccagtataatgatatattcaatatatgtaacagtttatgattacttgcttttaaagatttttttaaaaaatttatttgaagtaaagagagaggagacttaaaatacctggtgatcttgatctgacagtgtatatttaataggcatatatttatgtggaaagaactgctgaaatatactgatatgtcagcctatatcctgataatttatatataatgtgtgggttgcatatgtttgtgcatatgtatatacgtttgtgcatacatatatatgatttccttatctatgtaccttaatctacccattcatattctgaaaatgatgagcagttcttttcacattgtgtactatgtataaattattcattgatctattcctgttccaagctttgacacaaaagaacccctaaaatttttgctgccctagaattggtaaagtataacatactttacttcttcaatttgactttaaagatttgtggtttctgttaccattcccattcactaccaggactgccagggtaagagagtaactaacaatattgggggaactctggaaaagtgaaaccaagaatattagatttcatgtggaatttaaagcactttccaaaatgtattataaggaaggattgtattttttaaattgtttttgacttaaaagaagtaatgcacttatattgagcagtttatggaacagttttatttagttactgtggtacagtttttagttttaagaatctgttttactattcatctgtaaaaagtttggtttttctcctacatggccttgaaaatgctagaaagcattttttaaaggtatacgatcagaatacttaacgtgtgatttcttctcaattacttctctaccattttatatttaatgttgtatttgcattgtgtaataaaaccaaaaccagatgttggagatgtagcataaatggaaatttgttaccatgcatgatggccttatgctcagattttcatttagacttactgagaatggactttaccttactcggtcttttctctgtcatgtagttcaagggcaaaattatacataaacatacactcaagtatatccaagttcaactatttttcttttatttcaaattgtaacaaagttaaaaacctttgtttgttaacattgcttagaaatggaaggaatttaattagaaatggaaggaatttaattgggttgggggaagttcttttattttataccccaacctccagctagtagtttattaatctgaataccataaaatgcacatgactttgagaaatttagaaaactactctaagaggatctgaggcaatatttatccaacatgaaacagcgggcaaaatgtgatgtttcgtagagttcttaactttttaaatagtaatagaaaaggtacttatttttaaaatagtatgttaagtagactgattataaatgcttatttaacaaagtgattctgttactatggtcttaaaatgttttctattttatgaacataggagaggaagagaatttaagttgactttgtttgccatttctattttgtagattgtagatctactttagtaatttttgtaagttgtagctaatagagattttttaaatatgccatgtatagaaaacctgttttcataaaaaactttataatggcttcctgatccattaacccttaaccaaaatgaataggatactaattagcacttggattgcattgcttttttggcggaatctgtgggtttttttttttttttttgtaaatttcattcaccagtaaattacagaatacttattattgaaaaccatcatgtattgctttaaaacaaaagttataatcttgccctcaaaaggcaagcgttagaaacaggtgagctggtgccaactgcttctgtcggttaatcttgtaacatttttactatacatttaactctaaatctcatttactaattatggaatttttttaaagaaaaattatataccacatctcaatggcaaagaataattcattgtatttatttttaagccatatttcaatatctgaggatatgatttttctgtacatagtatgattaaaaataatggtattttttcattaggtatttaccttgctgaaacactttcaggccttaaaaccacagataattaaaattatctatttggaaggcttagcttttgaaagaaaaaattcttacccaaagtagtttttaaatttctattttcatattatgtttctggtgatttatgtttatataatgaaaatctcctctgcacagcaattatatttggaatcctgagctataattaaatttatattctgtaaaacagccgaaggctttcttttgtttttaaaacatagtccaacctttctagaattttgatgtacttttatttaccataatcttatatattttttagaatcacagatttgaatttgaaagtaatcttaaatgttacctggtacagactcccaccccactcagcccccttttccaggtttcctagcactttgctttttctattagcatatttagatttttttctcttgagggggttggtctgttttgtgttttgttaggatggactttctgtttgtagatgtttctgtttgtggtttagttttaatgagagaagcataattggcagtagttaatgtgactataagttatttggcagatggtaccatcagcatttattaaaactaattgtatttttctagtaagcagtcttatgtcccagttgttaaaaattagtaaagttagaagtaaatgttaaagttacacagtagttctaaaaataaaacattaccctgcaatctttgaaagaaaactgtagcagaaatgtaaatctaaaaataaatgttacatcactggctttttaaaataaattcctttgaggttagattaaatatataagtaaaacgattttaaataaatagaagactagtcaagttctaaacaaatggtttcttaagaaaaatttgttttctttgcatgttagctcttggaaaacatgcaaaatatctagctacttcccttgtttattttagacatttggatctgtgagtggcccccaagtttcctaatttgtctgtttatttactctgtctatagtacatgttgtcttcagtatcaatctccatttcatagttctggagttttaatatttatgaaggactgtgtgtattgagttcttgaaatatgttaacttttgaaaggctttgttgacttacaaaatgttaaaacttaaatattgttgctctcaaaatattatagtattggtttcttaattctgaaaatttaaactgcctgagtagctcttctccctacaagtttcagtataaactcattcaatataaagtctgcttgcttttatattatgcattccaaaataaaaatgatgaaatattagtatcagttacacaaatgtaactactcacatttgaaccattttattgtaaaattcaactttcaattatgataatcagtctcttgctgaactttttagatctagatgagaattataaatttttgttattttatatgtgttatatgtgtttatatatgttttatattgtgttatttcacaaatcatcacaaaagggcaatttcaaagattcttttgagaggacagcttaaagcttaatccttaaggcttgactttcttctattaaatgagattgatacctaaaatcatggtataaattattaattgaattccacccaagttctgttgttttgttctttctcacagtcattccaaattaaagattttagttgaaaaactcagaatatattatctaaatttcaaatattctattttttattgtttcatattataatttattttgggccaaaatgaggtaatttaaaaaattatatcaaagttactcaggaaatgggttttcagttccgtatctttatatatgttcacttccaaatcttttgatgttgacatttgccattgtagtttaattttctttaaaaagttcgaaagaaaaccacacatgaaatgtaaaagtccaaatttctcttcttcagtataatatagcttattctttatttattattttacttagatccttgaagtatatgcatcattgatccaggtctatgcacaagatttataatgtaaataaagaatgaactaaataatactgtttgagatgaatatttgaattgagatgaataaacgttgcatctaatgcacaatgaaacttcattgacatctgatgaaattacagtacaagtgattttgttaacattctatggtgactaatactattaatcctttttaatcataccaataaaatatttctgccttaatgtctctttttactggactatgaagaaacaattctgctgttaaaggataaccaaaaaaataacttccacctatctgaatgcccttattctggcaaattagcagttttattgtagacgtacccactttaagttgctctgcttctcttctagaattgcttttgtaataagtgtaaatttgtagtcagataactcattgcttttatgaagttgctttcccacttgtgtgaccttaagaaagtggctgaagtccaggattcttctggcttcctggtttccatttcaatattttcaatccctgttttacttagttagcaaacttttttttttttttaatgccttctaaataggaattttgttctcctcatgttgttttcttctcttcatttctggtacccaaccaatatccaagattagatccctctatataaatgaaaatgtataacctttaaaattattttcttttggtctttttttctaccaagtaagaactaaaaaagattaccatccccctcagcatttcactagtttttgttcaaacagcacacaaacagaattatttcaagatatttagctaattaaatttgattgtgcaattcagatctatataaattaaccttagcattattcctgtgctttattattcactgataggttcttattcaactaatgtttatttcttgcctaatatgtgccagaaaccgtgaagtgtttaggatatgcagtgagtggttaatgagacaagtatgatccaacttgtgtttgcaattaagcagggatacaggtactgaataaatactgaaaataattaaaatggtaataagtgatttgttaatactgatgcatgtagatctaattcattttaaatgttacaaaataagttacaaaatggtatatgccatatgatgctatttttgtacatctataataaactttatgagacacaaatatgcaatgtagttactaataaaactataagaacatgaacaccaatctttagataaagcttactgccaggagggaatggaatggatgcagagagcatggttagctgtatctttaatgtttcatttctttaaaaaatatttcagcaaatataatgataatgatagaaaagtaaaaaaatgctaggagagggtacaataagaagaccttgttttgtctgggtggttaaatatggttggttttcactggaaggtaatacagtgtgtaagttttgaaggagtcagaggaaatatggaatagtgttaataggctagtctgacttgaaggccccagaacaggaaggagtttagcacatttgagaaggggaaagaaggcaaatgcgctgaagaagagtgaggtgaggtggatggagattggctgtggatgactcctaagagatggggccatattatgtagagtgggccttctcatatttcgatgtacatcagaattgttagagtgtcttaattttaaaatacagctagcttcctggggcccattcctacagttggattcaaaaatctaaatgtttaatgtgcaccccaggtgcttctgctgtaggttgtcctcaggacacagtttgggagacatttctgaaaggtcttatatgctatattaagaattttggactttattcagagtttagtgtgaaactttgaagacttttttttttttttttttttttttttttttgagacggagtcttgctctgtctcccaggctggagtgcagtggagtgatcttggctcactgcaagctccgcctcccgggttcacaccattctcctgcctcagcctcccgagtagctgggattacaggggcctgcctccacgcctggctaattttttgtattttttagtagagacggggtttcaccatgttagccaagatggtctcgatctcctgacctcgtgatccgcccgcctcggtctcccaaaatgctgggattacaggcgtgagccaccacacccggctgaaactttgaagactttaaaaaaggggagagaatgatttggtttttaaatactgctctgcggagaatggattaaagagagagaaagttgaagttttggactcgagatgtgttggtggcttggactagaggtgagagaaataggtaaataagagatgtgtttaagaaataggattggcagcacttggtgatcgtttttggtgggtgaaaaggaatgcgatatcaagctgactaccaggtttatagtatgagcaacagggccaaagctgctgcattaactaagatggagaacactggaaaagcaaaccttgggagtatgggaagaaattagtttaactttggctattgtgacaatgaaggatctgtttgattgtggatatcaggaggttgattgacagtgctttaaacatatgggggttatttttctaatataacagaaagtctcagggactatcagggaaaccaaccagggctagtgccattagtaaggtaaacttctgttacacaagccttaagtgtgttgatcttagaaatcacgcctatcaacttagagttgcaaggtggctgtttcatctttagcctcacctgtatggccaaagtgggagaaaaagaaaagagtgatatctaaatctaaagaaagaagctttactggaaactcacctgacgctcattgaccagactaactgcaagggaatctgggaaagtgtttttaattggacacaatactacctttaacaaatagaggttctgttagtatggaaggggtgggtagtggataatggttagacaactatcagtatgtagaagctagctaatgtttgagatatttgtgagatatctaagtagtgatgttgagtaagcagtcagatttaggcctaaaacttagagcagtgtaagttggagctataattttgtgagtggtcagtatgaagagtagtatttgaagctggggtggtgtgtgagattgcttaaggtgatagtataaagtgataaggaaagtgtatcaaagacagaaccctaagaaaccatcattttaaaggtaagatagagtaggagaggcttccactagggaaaggtggccagagaagagaaaatccagcatagtgcaatatcagcagtcaaggaaagagtattttaaggagtttggagcattgaactgtatgaaagcatagataatttagtaagatgagggttttatatttacatgatgtcctttctaaattttttttagatagaacaattgctttattttttagtgtcttaaaatatgcttttctccagcaattttctgtattatatgttggaggagcctgctatgtaatttgaataataaagtggctatgaaagtgctttgaaaagttacagcattagagaaacatactgttattacacctcttctgtgagtatgctccataaagcacacatgttgaacgtttcacaatagaaatgtgaaataaacattgaagaatatagggagttaagtaaggctctggagaccagtgaaaatgagggatttcttttctaacattaaagcaattagtaaagattgtgttagtattgtgggttggaataactatagaaaactcaagtccatgtgcctggcttcgttatagtagcaggatttgaggcatgctaagagaaataggaccttaaactctgaattgaaaccataattcttcctgtatgaatgctaaaaccgtgttgtttcacagcaggaagagaacctcatctattttcagggaccttgtttgtatttatttatttttaatttacacaaaatggtgtctttgtaagaatagtttgattccaatggcctggattttttttttttgtttaatatgtgtatttggtgatgaatgtcttctcttcctgtcttaaattcgcttttaagttctttgacttttgggttttatgtacttgttttttaaatatagcactttatcattccagaaatgtggaaccttgtcctctatcctaacacactaatgtaatattcactaatgttcatgaacttttacaaaaacttgtttgtataatagtgggagaagaccagaaagatagtgaatgagaaactttgatagttgtctgtgcaatacagatatgcttaaggtctgcagttttgttctttggaggagtagctgtctttgtctttgctcattgctatttttcttctcttctgctttctggcttattgattaggagtgctgtttttcagaccacacaaagatatattgttagctacttttataattggatatataaagagggatgcttatgacctcattggtatctttttagaccattcattggtgtttactggaataatatgccactgagaaaagaagttatttatttgctgccagtagcgtaacagtcatatttgcttttattcacattcacccaactcacatttcatttttaaagttttaaatgcaaagaataaaggtaataactttttctatttgtcgtttgtgatattatcaaattgaattatttcttttgttcttttattttcccttcatttaaaaaacacctttgggtagcacctcaatataaaattaatatctctgatttttctataaattgtttctttgttgctattttctgatttcctatcacaacatatttctgtcttggtattgtattattgaggaagtcccaggttttgttaggaaattgcttgacccagtagatagttagagttgcaagcactggccctggcatcttccagactgggtttgagcccttgttcttccacttaccagctctgataccttgctgaagttgtttaaatgtttcctgtcctttaataacagaaataacatttggagcacttagctgagtcgagagagtaggtgcttcatattaactattttgttgtaagtaatatataatctttaattttttgtcttcataggttgtcagattttttgacatgattatgactttttagtttacaaatgagtgaaattatttcagattaaactggtcattgaaaaattttgaggctaggcatggtggctcacacatgtaatcccagcactttgggagggtgtcaggaggattgcttgagcccagtagtttgagaccagcctgggcaacatagtgagaccccgtctctacaaaaaaataacaaagaaatcatccaggtttggtggcacatgcttgtggtcccagctgttcaggaggctgagttgggaggatcagttgagcttgggaggtcaaggctgcagtgagccatgattgcagcacggcactccagtctaggcaacagagcgagagcctgtctcaaaaaaaaaaaagaaaaaaaaattgaaaattgtatgcttttaagggagtttattacttagcaaagtcaagaacagaatgcagttcttggaggtaccattttgaggttgtatttttaaagtgaaatttctgtaaaacagagcttctttcctttatagtaaaatttgctatttgatttattcctctctattgaaattactatatgagaacctcctgcatttgtgtaagtttggaaatatgggcatgaatttattgaattgctattcctataaaagattttttccccaaccctccgaatcatatcagtttggattagttttgtctatatatagtatattaataactgtgtctcagtaaatctttggaaagcttaggaatatgtggcctcatactcagactgtctaattacaaaagtagtataatttttttttacacatccttaaaaatattaaataagctcagtagtaaaggaaagaggaaatatcttcaatcacatacacaatacacaggtttacttttacccttgggcaaggtgattaatttacatatgatggcaacttaaaatttttctttagccacagtataataggtagtatgcctcaatttgaccttaagaaaatataaaagcaggctgaaagcttattttcatttaaagactataatctgccaagttggagtgaagcctttaaaacaaaattggatctggagtcatgatggtttatttaacagttgaagaaaagtatctattccatgacaacagatactgtactgagctggaaatgagagcagcttatctcaaactagaggtggtagaaacagaaggatgttttttcagttacctgcttttttttttcattatagcagttccaaacaggctgaattcatgtttatatgaagacagaaactaaagatgaaaaacagaggaaattttggtttggcagttggtaatggagttagaaattaaatagttgaagtaaagtgtaaaaccagtgaaccaatttttcctccgtctctccctccctccatcttctccctttcttccttttctcccctcccgctttggtcccatctaggcttccttccaatattgagtaaagaacttttatggattagagctaaattgatatttaatccgttggtttccttctgtgctttggataacaatctgagatctattaaggactcacatcatcatggtctagttgtacagaattgggaatccagatacctgagttctactcaagctccatcactaattcatatgctgtgtgaccttgagccagggtccttaatctcagtggtagtaataaataaaatatatctatcaacatattttataaccagcctgtcagggatttttaaaaacaactataactgtttaaaatgttgaatgttttagggtcatccactatataaatacagagtaatgtgagtatataattctaataattgctacttactcataagtacagaattattagggcatttacagaagtcacacaactcaacctttaaacaagctcaaactgagtaggataatgataggattaaagacttaggaatgccatgttttagatgtgtaaaactgatacactccccacctgcttctagctgttttggaaaaaagtgagatttgctatgccaagcatgccagtgttaagtgaactcatgtgaactgtaacattttttgtcccactgttgtcatgactttgtacaaataaactaagataagattgtctggttcgggcagattctgataaagagacttgataagaaaaatgcagtagtgctggaaaatctacaagatgaaggggaaactgttaacagttaatttataaattttaatggctctctgcccaggtgcagtgtctctttgccatggggaggtatacattaaacatcagagcccttaatttaatagctattattgcggctgtgtatagtctgtttctttatagtaaggaattatttatcaaaacatagcttccatgcctctggcatttactgttaacccattattttctggactttggcctccttgacaggtattttaaaatcaatgtaactcaagtatccagtggggaaataggggaatgagctttgatcaatggttagcacacctacatcctttgcaagtattggtgtggaggtggatgactgatcttctagagtgcccctctccttcagtttgtttgctatgataggcattccagagggtgtgtcagcttagttggaaatactcgtggcgctctttaacagaccaggaagcagactgtccctaaatgaaatactccatctgttgtctcaaaagtgttaaactagtttcattttcttttgtggcattctacccacagctcatttcataatttatgtaaacttaaaagtatagggggctgttgatgctagaaagaagaggaatttgtggttttgcttttaaatagtgcctgtgcatgggctgcctcctagtgcttttctgttttggagagaattacactcactttgtgttcaagcacctatcttctggtttggactaaatccagctccatagctagccttttgttttcatgggaagaataccaaacttccatgttagtctttaataattttgttaaggcgagctagtgtttttcccttctgattagttacaaagcctttgtacattaaagtttcctgatttttttttctcatgcttttgaataacaatatactctgaataaaccaagtatattctaaaatcttctattttgggccttattaataagaaatggacttttagaacgtttgaaatgttgaataatgaagtgactaagtgctacacacatactataataaaatctcttcaaacgagcatggtctaaattcaaaattttaaaggggaatgtgtagttcttatatccagtcactgaaacagatgaggctttattgcttagaagtaccaacatagttttaaaaataataactgggtaattaatatattaatggtatatacaggggaatttggatttttcttagtggtgggggaagtaagacacacaaatgctccatgtggtcatgtgttatagtgccatagtgcagcaaaggtagacggagattacttttgatttaagagattggagcagagttcacaggaatgggtaagaataacatatcagtgagaaatgggtggggaaaaatgatttcaggagaatagtatgcactgtgggaggaagcaggaggtagatccagggttgtggtgggagtggaggtatctaattgactctgtccctagcacatgctgtcacagggcactgtgtgggcagctggcaataagctacatagataatgaatgctgggctgggatggcctggggaagactgacagcaaggaagggactttcgggctagtctttgagggaagggaaggatttgattaggaatctgggtgttcttaagagcatagacaccaagacaaaaacaagggcagtaagaccaattttgctctattgaggttgagaagaaaaattaagttagctggactgaagaaccttgaatacaaggctgaagaacttaaatgttatcaggaatgattttgggtttcttgatactccgctgcttagaaacctgtagtgattagagcaatgttttgagaatatgattagaagtatgtggagaggttttggagggtggaagaaggaccagaagcagaggcatcagttaatgattgaataaatcttgtaatgatattcaaagatgtaaaagttaaggtagatgggctgggcacaggggctcacacctgtaatccctacactttgggaggctgaggcaggcagatcgcttgaggtcgggagtttgggaccagcctggccaacctagtgaaaccccgtctctaccaaaaactacaaaaattagattagtggtggcacatgcctgtaatcccagctactccagaggctgaggtgggagaatcacttgaacccgagaggcgaaggttgtatgagccgagatcttgccactgcactccagcctgggtgacagagcgagaccttgtctcaaaaaaaataaaatgcagggttgggggccgatagaggaattaattttgcaatttaatacccaaaattgaatatttgatgccttgagggagaatattcacttagtcaatagatatttaatgagcacctattatgtgtgatagacactgagtttacggtggggaacagaaagacaagtggtctctgcccacatggagcctatatttaatgagagagacaaaaaacaagtatatataaaaatatatatactttatatatagttatatataacaaatatagttaaaaaggatatagttaacaatacaatatatatatatatatgaaggggaaaagcaaggtaagggataaggagtgatgaaaagaggggagtgttttagagtcttgagagaacatttgaatggagacctacccaaagggagggggagagggagcctcctgacagcctggggaaagagcatctctagcagccagttgtaggccttgagtgcctgagaccagccagatgttctgaatggagtagagctggaaagggaagagtggtaggaatgatatgtgcagtgtaaccaggaatagagcctttagggtcctgaaagccatggtaaagagtttgattttcctttagatatgatggaaaggcacgggagttccttgatgtttttaaaagatccctatggcagcagaggtgataaggtggtggttcagatgaggcctaaggcaatagtgatagaggtggtgagaagtgataggattccaaacatattttgcaggaaagaggatttattgatgagctagatgtgggctgtgagagaaagaatagaatcaaggactaccccccatggtctgtatggtgaatttgtctgaattagaaaaagctaattctgtctctggccagaagcagaagcacttctcagcaccactgggtaaagaagctcccttcctcccagcacatgtacctgggtgctaggacaccttggtgggaagagcgtgggctggtaacccgtgttggccctgtggccaggcatccttgtgaaggactcaacctgcataagtgaatgcagcagcactggatgactcctgagtttgtggcctgagcaagtgggtgaattgtagtgtcatccccaaactggggagactagaagaggagctgactgtgagtggcagaagacagggcaaagcaaattccattttgggtataagtctgagatgcccattaaaagtcctggaagcaatgtcaagtaggcagatggctatgaactggagccagggtgagaagccggcaggactgttgctgtttttgagtttgaagtgactatcaagtggagctgtaggactggagcttaggagaaagatttagattaaagatggggaagtcagtgtgcccagaggaatagatgaattctttgagggacattatattgaaaaacaagaagattggactgccttgggagtattatttggcagtggaaagtgggtaatgaatctgcaaagcagcaaacaggaggaagattagggtgatggagcagcatggaaggcaagtcgtgagagggtggagggtgctggggggatctgaaggaatcagggcttaggaagctgctggagctttggagagcgctgtttagaggtaacaatgagtgtgaaggtaattttcagggaattaaaaatatactttcaggaaataagcgctgaagggagaacaatagggtcaagtgttgctttttaaaaataggatgaaattgtgtctgttttaaggtaaactgagagaaccaatgaaagaggaaaagttaaagatgctagaaacaaaggggatcagtgagggaacaagaacagggcatctagaggataagtgtttgaaggaatagataaaaagtagtctcaaaaatgaggaagctttttactttgagcgatgaaaacagtttttatctttttagcaaagttgtagttaggatcttctgtctgtttttaggggtctccactggtattaaaggcctgaagaaagtatggcgggaaccaacaagaaaaaaaaattgtcaagcagtaatgagagaccaggtggaaatatggagaataatctgtaatagccagtcagtattctgtggtccaagagcaaaaagggaattgagaattcagagttgaccccattaaaaaagaaagacattaaggacacctgaaacagtggtttataacccagaaaagtgcatatcaaagtcacctggagactttaaacaaaattatgggctgagcatgttggctcatgcctgtaatcccaacagtttgggaggccaaggcagaaggattgcttaaggcccggagttcaagaccagcctggccaacatagtgagaccccatctctataaaaaacaacaaactctatgcatttacctcctttccctaaaatgtatcggattgaggtgtaggagtaggacaacaagaaatgggagagatgtttatgtatgtttttagaacattctgggtgatgttcttcagttctttgttccacccccattccccattaagaaaactgttctggactctgggcaggaatagaaaaggatggctggaagggaagctaaaggactaagtggaaagttttttgaagtggtatcaacacaaatagtaatagtagtattttgggggtgtgctcagctagttaagttcctgtactgcagacctttacagagtctttcatatgctcatgaatctccaagagggggattgaatattttaagatcatatacaaacacaggatccttattttcatgggccatcttacggactagtttctgcaaattacactttgaaaatgatgaattagagaactgcagcaatgatcagttccagttaatttggaaggttcatgggttttggaagggggaagccatactggaaagggagaatgtccgggttaagatcttgaagcacagttccaggctgtggctttgttggtggagagctgggttactttccattccccagttaaacttgttttctaccattgagtccagtatcagttgagtcatcaatatgaatgttgaagttgcaaagtgtaagacaaaatggggaatttatgaagtatttacaaatattctatggtcaatagtttaatttctcatagatagggatggataaagtctttatgaaagcagaccaaaatccaatggcttttcaaataactagacttttcctcttaactataagaaaaggaaagtgggtaactgtcaaaagtagatacactttgaaatcttggagcacttaatagaggtgacttaatattttggagttgagaaacttttaaacacagcagtgtcataagttctgagaatgacccaatttgtaccacctgggcattgaactgaaggctgtctttccagtgaagtaaagtttaagatgacagttaacactgaatgttctctcttaagatttgcaaagaagccagtgattggtgaggatagtgattcttggcagggattagacatttatatagcatgatttaatttttaataatgtgaattttatcagcatacagacttcctcacaatattgagacatagaaaatgggaaggcttctaaacaattttcagttgccccaactgtatgagtttcacaaaattccattctcttctgccaagtgatattattccattccttccctcgtgtatcttatctttattattgaattttccctcacaatccactgttaaaagaagaaagtatcacacacgtgggttcttttggctatggaagtgtccttgagatcactttttgcacgtgactcagctgaagtgttcaaagcacatggaaatcacttgccagtgacaggtggacgttgtatgtgttttctctctcctaaggatgcctaaactttcttttcttcacaggtaaagtcagtgataaatcttttgtttgctgcatatactggagatgtgtctgcacttcgaaggtatgtttacaggatggattagcatgcactttacagatatttatgaagttgcttctgggcgagcagccattttaaggttaaagtctcacttttctttccctttgataaaaatgaccccaacaaaatttttattaaataggcacttccagtgccttaggcctgctttccaatcttgtccttttctgcctcctataaaaaagaccatatctctgtttccccaagtagtaactgttcagctaatctggctaattagtaccagtggcttactggaattggacagtgccttctcactccctgtctaccctccattcccaatctttgatatgtgtgtgtgtgtgtgtgtgtgtgtgtgtgtgtgtgtgtgtgaagcagctggggggtttggtgtctggcagatcatcaggattagtaaggccatatactgctgtatacctaaggtcttttgtgtagagttgtaacttattttcttttttttttctcccattaatacctcaaataactgattttcaaagtggaaaaatgtctgtgcttcccccccttgttttgaagtctgacaagtactagtagactgtgaaatgtttaagaatgggagtcttagtaaaacatacaactttactatagggattagtttcttgcccttatgagacataaaccttggtacacagttgtgccataattcttaggttgcgaacaataatgtaataaagtttaattctgtgagagatggttaacatttaatcttacctaaaaaaaagcaaagctgaggaagagaggtgaagtggcatctacccaaaacacctgtgtactggttaataaggtcggtagttcccattaatgagcttgatgaaggatggcacctgacagggccttaaatgaactgatggagtgaatgttaccagtgtgaattaaatttgctttatatataataaatagctgtgcttacacattttcagatttgctttgtcagctatggacatggaacagcgggactatgattctagaacagcactccatgtagctgctgcagagggtaatacaggaactactcctatctattttctttccagatttaatttctacttagtactaaaatctgctctttttttgggggtgggacggtataggtcatgttgaagttgttaaatttttgctggaagcctgcaaagtaaaccctttccccaaggacaggtgagcacttatgttaccttctaaatatgtcagtattttattatgcaggactgtaatattcaagtgatgataatatttcaacctactaagacattcttgaacctgctatgatatcttataaaggcaataaaccttgtttctactagataggtaattctgtctcccatatcctgtttcttatctaagaatggtgtcttatttagaaattttcaggttgatttgaccattagtcaatacactgtatgaacaaaacaattttttttttgcatttgggaagaaagaattggaattttatcctcatggattttaaaaaaaaaatttttaaattacactttaagttctgggatacatgtgcagaacatgcaggtttgttacatgggtatataagtgccatggtggtttgctgcacccatcaacccatcatctacattaggtatttcttctaatgcgatccctcccttaccctgacccccaaacaggccctggtgtgtgatgttcccctccctgtgtccatgtgttctcactgttccactcccacttacgagggagaacatgaagtgtttggttttctgttcttgtgttagtttgctgagaatgatggtttccagcttcacccatgtccctgcaaaggacatgaactcatccttttttatgattgcatagtattccatggtgtatatgtgccacattttctttatccagtctattatcgatggtcatttgggttagttccaagtcttttctattgtgaacagtgccacaataaacatacatgtgcatgtgtctttatagtagaatgatttataatcttttgggtatatacccagtaatgggattgctggatcaaatggtatttctggttctagatccttgaggaatcaccacactgtcttccacaatggttgaactaatttacactcccactaacagtgtaaaagcgttcctatttctccacatcctctccagcatctattgtttcctttttagtgatcgccattctaactggtgtgagatggtatctcattgtggttttgatttgcatttctctaatgaccagtgatgatgatatttttttcacatgtttgttggctgcataaatgtcttcttttgagaagtgtctgttcacatccttcacccactttttgatggggtttttttgttgttgtaaatttgcttaacttccttgtagattctggatattagccctttgtcagatggatagatcgcaaaaattttctcccattctgtaggttgcctgttcgccctgatgatagtttcttttgctgtgcagaagctctttagtttaattagatcccatttatcaattttggcttttgttgccattgcttttggtgttttggtcatgaagtctttgcccatgcctatgtcctgaatggtattgcctaggttttcttctagggtttttatggttttaggtcttatgtttaagtctttaatccatcttgagttaatttttgtataaggtgaaaggaaggggtccaggttcagttttctgcatatggctagccagttttcccaatacctttccccattgcttgtttttgtcaggtttgtcaaagatcagatggttgtagatgtgtgctgttatttctgaggcctcagttcttttccattgctctgtgtatctattttggtatcagtaccatactgttttgattactgtagccttgtagtatagtttgaagtcaggtagcgtgatgcctccagctttcttctttttgcttaggatcgtcttggctatgtgggctcttttttggttatatatgaaatttaaggtattttttttctaattctgtgaagaaagtcaatggtagctttatggggatagcatagaacctataaattactttgggttgtatggccattttcatgatattgattctttctagccacgagcatggaatgtttttccatttgtttgtgtcctctctttatttccttcagcagtggtttgtagttctccttgaagaggtccttcacatcccttgtaagttgaattcctaggtattttattctctttgtagcagttgtgaatgggagttcactcatgatttggctctctctttgtctattattggtgtataggaatgcctgtgatttttgcacattgattttgtatcttgagactttgctgaagttgcttatcagcttaaggagattttgggccgagatgatggggttttgtaaatatacaatcatgtcatctgcaaacagagacaatttgacttcctctcttcctatttgaatacctttctttctttcttttctgagacaagagtctcgctctgtcagccaggctggagtgcagtggcaagacctcagctcactgcaacctctgtctcccaggctcaagcaattctcctgcctcagcctcccgagtagctgggattacaggcgtgtgcccaccacagccagctaatttttgtatttttagtagagatggggtttcaccatgttggccaggctgctctcgaactcctgacctcaggtaatctgcctgccttggcctcccaaagtgctgggattacaggcatgagccactgtgcccagcccctttatttctttcccttgcctgattgtcctagccagaactgccaatactatgttgaataggagtggtcacagagggcatccttgtcttgtgccaattttcaaagggaatgcttccagttttttgcccattcagtatgatattggctgtgggtttgtcataaatagctcttattattttgagatacattccatcaatacctagtttattgagagtttttagcatgaaggtgtgttgaattttgtcaaaggccttttctgcatctattgagataattgtggtttttgtcattggttctgtttatgtgatggattacgtgtatcgatttgcatatgttgaaccagccttgcatcccagggatgaagccgacttgatcgtggtggataagctttttgatgtgctgctggattcagtttgccagtagtttattgaggattttcgcatcaatattcatcagggatactggcctgaaattttctttttttgttgtgtctctgccaggttttggtatcaagatgatgctggcctcataaaatgagttagggaggattccttctttttctattgtttggaatagattcagaaggaatggtaccagctcctctttgtacctctggtagaatttggctgtgaatccgtctggtcctagacttttttcggttggtaggctattaattactgcctcaatttcagaggctattaattactgcctcaatttcagaacttgttatcggtctattcagggatttgacttcttcctggtttagacttgggagggtgtatgtgtccaggaatttatcaatttcttctagattttctagtttatttgcatagaggtgtttatagtattctctgatggtagtttgtatttctgtgggatcagtggtgatatcccctttatcattttttattgcacctatttgattcttctcttcttattagtcttgctagtggtctattttgttgatgttttcaaaaaaccagctcctggattcattgattttttgaaaggtttttcatgtctctgtctccttcagttctgctcttagttaattcctgtcttctgctggcttttgaatttgtttgctcttgtttctctagctgttttaattgtgatgttagggtgtcaattttagacctttcctgcttactcttgtgggcatttagtactataaatttccttctaaacactgctttagctgtgtcccagagattctggtacgttttgtcttttgtcttattagtttcaaagaacttatttatttctgctttaattttgttatttacccagtagtcattcaggagcaggttgttcagtttccatgcagttgtacagttttgagtgagtttgttaatcctgagttctaatttgattgcactgtggtctgaaaaactgttatgatttttgttcttttgcatttgctgaggagtgttttacttccaattatgtggttggccaattttagaataagtgcgatgtggtgctgagaaaaatgtatattctattgacttggggtggagagttctgtagatgtctattaggtctgcttggtccagagctgagttcaagtcctgaatatccttgttaattttctgtctcgttgatctgtctaatattgacagtggggtgttaaagtctcccactattattgtgtgggagtctgagtctctttgtaggtctctaagaacttgctttatgaatctgggtgctcctgtattgggtgcatatatatttaggatagttagctcttcttgttgcattgatccctttaccattatgtaatgcccttttctcttttgatctttgtcggtttaaagtctgttttatcagagactagcattgcaacccctgctttttttttttttttgctttccatttgcttggtaaatattcccctatccttttattttgagcctatgtgtgtctttgcacgtgagatggatctcctgaatacagcagaccaatgggtcttgactctatccaatttgccattctgtgtcttttaattggggcttttagcccatttacatttaaggttaatattgttatgtgtgaatttgatcctgtcattatgatgctagctggttattttgtccttcagttgatgcagtttcttcatagtgtcaatggtctttacaattttgtatgtttttgcagttgctggttacccctcgtggagtttttaacaacccagggtagacaagacaaacctttagagaagcataaactttaagatgataattaacactgaatgttctctcttaggatttgcaaagaagccagtgattggtgaggacagtgattgctggcagggattcgacatttatgcagcctgatgttgtttttaataataatgtgaattttatcagcatacaaacttgctcacaatattgagacatacaaaatgggaaggcttctaaacaagctaaaatgtataagaaaactgttaactctaaaatgaatatattggagtttgttgaaatttctgcatttggttggaatcagtttcagaaggcttcatgaagttaaattttaatcagtgctttagggaagagacgagactgaaggcacagaatgaaaagaagggcattctatctatagtgggaaaaatatgcctagaatatattctgctcctctcctctctctcctggtcgacatagcaaactgctattcatcctgcaacaaatgatgtcaacaaagtggtcagggaagggataagaatgcagcttacacatatacatgtacagtaaactctagattcatatccttggacattatgtactggagtagagtatatgagtcaatgagtaatgagaataaaagtttagaatgggaaaaaaacgcatacttgatggtggtttgatatgtattaggagtttggattcatttgagaactgggagctgtattaagtttggagcaagttgattactctttagctgtattgtgtttctgtttattaagcttcaattttttttttttttttttttttgagactgggtcttgccttgccactcaggctgaagtgcaagtggcatgatcatagttcactgcagccttaacttcccaggctcaagcgatcctcccacctcaacctcctgagtagctgcaatcacaggcaaacaccaccatgcctggctaatttatttatttattttttattttttattttttgtagaggcagaatcttactatgttgcccaagctggtctccaactcctgggctcaagcggtcctcccatctcagcctcccaaagtgttgggattacaggtgtgagccattgagcctggccaactatcttttttaaaattagggcttgggttttgttggttcagctgttagcttgcaagaaatgcagaaaagttatgtcagtgtctgacaaatgttagcaattttgtaagtttgctaacactttggttatctaactttattcctatagttgtaaaaaagcactatgattaaaaactcctttattggcagtattctaaaacctcatgttaggttgacagtcttcttccctttccccaaattttaatacccaccccaggtttctaaagcaaaaaattgaagagcattttcctcctgtgtttataatcccaactaaaacactatgtaatacatgttggaaatattactgtgctttgtatatgtattaatttcttttgccctaaattggcctctaggaatgtgaaagtagatgtacccacctgataagaaaaagtgagctaagtaactaacttgataactaggcattcaacaagtctttttctctatttcatagaatcagtgtcaccttaaattataataggtttgcacagaattcgtgaattcttgagatagagtcttgctctgttgcccaggctggagtgcagtggcgtgatctcgttcactgcaacctctgcctcccaggttcaggcaattctcctgcctcagccacctgagtagctgggattacaggtgtgttccaccacgcccagctaatttttgtatttttagtagagaggggtttcgccatgttggtcattctggtcttgaactcctggcctcaagtggtgcacccaccttggcctcccaaagtgataggattacaggcatcactgtatctggctgaaattagtgtattctttaaagttcatatttttcattaattcacagaagaattgtaaaaaaggtaacacgcagttgacattccatttttccagaaagacagataattacatactgtagaggatgactcaaaagtctgtttcaagccactgacttcctaaactagtgaaggcctattcaaagtcacttaattcagctgtttttttttttttttttttgataaatacaaagatacatgtaaagttttacttacctgattttaaaaacaggctaccaaaatttatccaaatatattaaaaaatgagactgttttaaaaacctttcgtttccatattgtgactccactaagcgggtaaaaagttcaggacagagatggaaaggaaagaaggaaacaggaagaagtgaaactaggaaggtggtgccagtggcacatggatgaagaaagagagatcatcagccatggagaattttgtaatgtaagtagagagagagattgggtaggaagacaggcttcacagtttgtaaagtgtaagggaactacccatcgtaccctgtcattgactagggctgtgagttatgtagttctgtctcctcttgcaaaagacttaccacttctggcaagtgattaaccacttctggcaactcttcatttcttcttatccttgaatattcatctacatcactctaaacagcacagccccagaagcatggaaaggggagttattagtatggaaaggggagttactcttctggtgtagtggtccgattgagtccatggcttcccagccttaccagaggtgataaaaatgtcaattcctttggggccaatcttgctcctccagtgtgttttagccctaatgaggtcatggttatttctagacttctgagacttactgtggctttgaattgacacaaacactaattttctgtcaaaggctagagtgatggatgttatatgcctgaattttctttgaacattttattttaaaagagatactttgggcttttcatgaaactaaaattctggaaccctagagcagtctattatatctgtcaccacaaggactttccttaaaaagctccctccataagcacttggatgtgtaaacaagatcctttcacagatctttttctcttcctctccatatcccaacttgtcttggagactactttttgaattataaatccctttctgcatttctattattaatttttatttgtaaaattgctaaaatagctaaatttggccatttaacctgcatttaaaatctaggaatgtggggtgatcatctttgtacataaattacctaatgaccctgtccatgctgtgctacgtgtttaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctctcaccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaagtttatcagtctaaaaagcgaagggatgtgcaactgcagctctttaagaagttttttttttttagcttctagggtaaagataaattcagaaatgctctaagctaccaaagttattctgaaagtatgggaactgctacaactaacaaacatttgtttccaagcctgtcattaagagtctgcatcaagagatttgtcctccttgggggaccactggatcattccagatttcttgtgatttttctattgtgtaattcttggtgggctctgtagtttaataataagaaaaaggccatttcattttaaattgtgacctataattctttgtcttgggttggtaattcaggattcatttggaaagtgggtaaaaggggcttcaaaaaacggatagaacaggattttctaggagttacacatacattttatcctgtcatacctcgagataaagtggcatgttagtgaggagttctgatattaagcacacacacacatgcacacaaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaactgtgtggaaaaaatgaattttcttaaaacaattaagagccaggaactccactgagcatacagaccatctctggttaggttccaatccatttctaatgcctgctataaagctaggtactacacaaggtgtcagatggggttgccacaatgactaggacaagaatcctgtgtagagttcacctttgaaggtgagggatgtgcaggcatgtctctagtcctctagatgcaaacactatccttttacagttaggaagtgctcagtaaatatttgttgaatggaaccagtaaacatacccttgaatgagaagagaggttattttcacaaagccttgaaatttatttagagagttgaagctagtactgccacactagaatctgagtgtcaccagccagtacacctcagctcctaatttattctgcgtgggaatagcattcgcttccaatgccagaaatccctggtcttcagagcactctttcctttcaggccaggggttagtgtatagttttccaaccatagagaaagtacatgaacaccatgactgttacattttcatttatcaaagttatctgtcacaaagtaagttacttggctagaagagtcactgcattactggcattgtagaactgtgatgagccaggtactatgcaaggtgacaagtggggttaccacaatgattagaagagacatcagaaattctctaatctaactcactcttcttttatagatgaagctgagacccaagagtgggctgtgatacagaactcttagtcctgcgctgttgttctacgtcctacaacactgattatgcccagtatggatagaatatacatattagcttattcatatgcactatctcctattagctaaggcctcttctctgctgagttttaggcagaggcctaagtgctacaacagaaagtcctgcaacatatagtcaacttcagctatatatatacatatatatatatacacatatacacatatatatatatatacacatatacacatatatatatatacacacacacacacacacacacacacacacacacacatccatggataggagcaggatatcagtgcaggcacaacaaatgtgtgaataatcctaaatagtgaatagttatttttattcttgatacaagatcattttatttttgtataacttttttaggagttgggataaccttcctaattttacttgctaataatcctcatagtaaaatgagtaaattcataaatcatataccagatggcccagggaagcagcccatgaatgtgttaggtggcacttataaaaaggctttttgggaaaggataatcttttatagttatgcaaggaaatgatgtgattcactagattatatgtgtttggggatgagaaagattagaaaattaaggcagttttttaaaaaggaggcatgagatacagcaaaacaactggatggaaggcattaaaggcagagactggggggttttatttctattctggagaatgaaccagactccaggcctgtgtgcgcccccactgtaccccttgcttcctttccaaatagccaataaaaggctgcaatgaagtgtgtctgacaagcagtcccaatggcaaaagaatatcaagactgtttcaattatgtagaagaaatgtggaaaggctgcaaacagacactgacagtaaggtattaaggtgttataatagctttatgaaatattataggagaattcagagtttgataataggtatttgacagctttctacctcttagatagctttctgttctctgtagactcaagataacgttaataaataagtttaagactgcttaagtatggctctgttgttttttcctttttacaataaatcaagcaaggtgtttaatttctcagtgagtgtagcaaacacataaaccaaagtgagttcacaaaaacttggaagctgaggattatcatttaagagcaatataaactgatcttaaaaagctctaaaagcag

SEQ ID NO: 14223 - DNA, 36016 bp, Human
atagtgtagtttaatatagctctaaacttgggtctgtaactcctgagagctctgtttttgtgagttagtgcccaggtggatgatagattctccctggagtgggaggacaggcagagcctcctttaggtgatttagaagatgcaagaacgtttttatccagaggactgaggtggcatgaatgtgaaggttgacctaaagaattacctgggtcatcacagtacctgtaggagtttgtggtgcccggaggatttattaagtaggaatcttgtgcagtgtgtcatatttgcctaatcatggaagtctcctgagatgcatctcaggcacctgggaaactgtatttttcaaaagcaccccaggtgatttcctgggttttagtagaagctactgggccctaattcagcctttgttgtcttttgggaagtcatcaggtaacctggttatgcccatactagcccttgcaaagaaagagacataaaatttgcggaagtcaaaacagatgtggatgacacagaggttccaggagatgggacttccggtagtcagtgcttagagtggtagggacacccattctcctggcttggagtgactgagactagaattttgtgtagcattctgattggtggcataaaacaaaagtcccaagttcagtgacttcttggctttcagggacgtcccagttaactattgctgcatactgtcagagttgagagtgggtcttccatttttctctgatgcacatattcttttagccttctgttattttctccatagagggctacagggtacttttaatcctaagggtgcatttgattacaacaagtttatttgtttctcttaaatggaagtacttggccaactcctctttgtatgtgggaggtctccaggcaactgtgaacaacttttaaaggctgctaagaggtcaagaagtactttgctgagtcttgttctgtctctttaaaaacagacttctttgtcttgcttgggctcaaaaagtatgtttcttccttggctctgtcttaggctttctgctgctgctttggagtgatcacccaccctccttattttatcctacagccctctccctgatacgtagttagattctagtctattattttgcatgcagggccattctacataagccttctaccctgtgccatgtgcgagtgccatgtgtttgaaagggaatcccatcatcctcatttttctgtgtctccagtgcctgttagaattctgaactctcagatgtaatctcgtagtcacctgtaactcttcccttaaaccacagagtgtcaataaatggtaactgttttcttcatcaataaatgtcaataaagagtaacttccttcctcacttagatctaagtgatcaccaagtcttgtcagttacttgtttgacttttctctacctcttctttcttgattcctaaattaacaccttctatttctcacctccaattcatactgaaatctatcttcctctgcctgccagactcatcttgctcattttttctctataaaatgggaataactgtacctgtgtcacagggccattgtgagaattagacatacgtaatgtaaagtgtttattgtattgcctggcacaaagtaagtattcagcaaatggttagcatactctgcttcttacctcctgctaaatttgactatctttcactccacctgcgtccaaaccttggcagtagcaaagtatatagccaaaaatacgggacatggaacctttggtttgatccttggtttgaacctccagattcctgcttaccatttattctcttttgggaaagtacgtcagtttagttactgacctataaggtttttaggagttcagaatgagataaagtatgtagagagaatgctgccttcacaggcagtcacgatgcagatgcttctcgtttttgttcttaaaacctgtagtgtaacctatttggtgtaaggagtttgaagcaagtatgatgagtttttacttttttttttttttttggcaggttaaacccatccagagtaatggctgcggccttacccaggaccctgggggagttgcagctgtatagaatattacaaaaagccaatctactttcttattttgatgcctttatccaacaaggtggtgatgatgtccagcaactctgtgaagcaggagaagaggagtttttggaaatcatggcactcgtgggcatggctagcaagccccttcatgttagaaggctgcagaaggctttgagagactgggtcacaaaccctgggcttttcaatcagccactgacttcccttcctgtcagtagcatacccatctataaattaccagagggatcaccaacatggctgggaatatcctgcagtagttatgaaaggagtagcaatgcccgggaacctcatttaaaaatccccaaatgtgctgccaccacctgtgtgcagagcttgggacaggggaagtcagatgtggttgggagcctagcactgcagagtgttggtgagtccagactctggcaaggccaccatgccactgagagcgagcacagcctctccccagcagacctgggctcccccgcgtccccaaaggagagcagtgaggcgctggatgctgctgctgcgctctctgtggctgagtgtgtggagcggatggcccccacactgccaaaaagtgacttgaatgaagtgaaagagctgctaaaaaccaacaagaagttggccaaaatgattggtcacatctttgagatgaacgatgatgatccacacaaagaggaggaaattcggaaatacagtgcaatatatggcagatttgactcaaagaggaaggatgggaaacatctcacacttcatgaggtacaaagcccgcgttgttccttctgtgtgtgtatgtggcatgttgctagtcgttagagataaatttggtaatagtttgccacaaatgtgatacactacctgaaagcagtattaaaaacattgaggtgttagcaacatgtagcacttttgtgaaaatagaccatatttattgtgttcagggtatatttgtattgaacttgaacatgtttgagctttggaactacagtacgaggtgacttttagaaaaatgtcagaatttaagcagtgaaagcgtaaagtctttgcatttgtaaggctgtttgttttttaattaaaaaataaaactaggttttaaatataacttttaaaaaacatttttgtaggctttttttaaagaaaaaatttcataaaaatagcaagaacttaaagcaattctcagctagcatagaaaacagttagatgaatgttggaagaattctcactttgaacattgttttggtttgatgtttggcattaaacatttttattttatctttatagtactctagacatagtctgcttaagttcatgtgtgtgtatatgtgtgtatagatataacattttgtccatataacattatacttcacgtgtgtgtataaactttggcatttactccttttcttgtctatctggtcaacacatatctttaaaactcagccaagaataagcttgtgttttctgtaatcttttccttcaagtagaatgaccgttcctttccatttttatccctacatatacttttgtcacaataactttaacttcttattgtacttatttgtatactggtctgtgcttcacagtatactctgggtttcttcaaggcagagataatgtctccttcatctttatatccccagagtcaaatgtacacaataagtgcttggaaaataaatgcgttttcaaaagttaaaaagactatgtcatagctaattttttttttttttttgagatgggggtctcactctgtcacgcaagctagagtgcagtgggtgcagcctggacctccagggttcaagcagtcctccctgctcagcctcttgagtagcttggacaacaggtgtgtgccaccacaccaagttaattttttaagtttttcatagagatgggagtttctccattgttgcccaggctggtctcaagctcctgggctcaactgatagaactgtcttgtcctcccaaagtgctggaattacaggtatgagccactgtacctagcctgatctttttaaataaatgattttagacatgaatgttggagcttgagatcagataattggttagcagaattacttaagtcatagccagcctgtgacttgatctattttgggagtatcctttgaaccagtagaggaatccactaaaagggctatatggctgtcattagtagaaaaacaaaaggcaaaatgtgttggcaattttagtttcatgctttaacctagttttcttataatttttaaaacatagcagatgaaatacaaagttgagtcgaaatacatgtgttttttatcaaagtaaaagtatttctaaaagattaacaaacctagttaacctgacttaaaaaaaaatcataccctacttttaaaaaatgtaaaaagaattattttacacttagcttttgctaaggggctctttgcctctttagataagtaggtacatatgatatttaagtgatgagaccatgaatttcacaaaataaggaaatactcaaaatgaatgccagtaggctgaaatgtgggggtgggggctttggaagttgtggcttgtgtttttgaaacttaacttaggccttcttgttacttgtactccagtatgtgaatctggtccaataatatagtttaggataaatgtttgtgaatcaggaagctttcttaaaactagtaactatccaagatcttggaagaaattacagaatcctgggggaattgaaagaaggtactattaggtatatcttttaggtattatgagaattttgtattttttctcctgattatttaaaattagcagaagtttttttagttctaagttcctgagattaaagaatgttgctagtttgtactcaatttccacataaggaatacatgacttactcttaattcattgttggcttaatctcactgttctgaggattttcttcatataaattgtgtggatactgttctcttaatctttcaagacatagagctgtatgtaggtcactggtggatgaaattcaggaagctatctatacctgtaagtttttttcaactgttcaagtacataagattatttttcttgtaagaagaagaaaatatttgtttatatatttataataacataatttgtttccaaatgtacaccgtaaagaattatggaatgacttattgttaagcccctcttttttttttttttaagctaaagaatcagcaatagtcctacagcctggctaagtacagtctgttttataggtgtcagattgtgaagagagtgagggctgaagcttagaaccacacaccttgctggtgttcggcaggtgccaagggacaaacccagaggcgatatcagaaaaaagccagcaggcaatgttgcatctatcataaggggtgttaatagatagtaggtggtaaactaggcaagcagtgtacccctaatgttaaatcagtgaatggatgaggagagagcaactaaaacttgggaacagcaaggcaatagagaatgtagaaacttgtaatactcagaaatgtaagcaggtagataatttggcattacagaatatttgtcagcagatagcagcttccagtcaaagagctctagaaagataggaaggagaagaggagaatgtagtcagcgggtaactgtaagctgagcagaagaaactctgcaggaattggggtgctgagcaggttaccaagataaggacccaggcctatagaataaacagtgatgccaagcttaggtcagtttccattatagtgctgagaagtcaaggctgagtgtttcagaggaggccagcaatttcacctttgagagaggaggaatgctgaatctgagaaccgcataaacgtggtcacattattaagttagcttgttttattctgaactctcaatctcagaattcatagatttcagcatctaacacttgaaatgctggacttttccttctgatgatttttaaaaatgaattatggtagtctatttcttgagtcaattttggtaagttacatttttctaagaatatccatttcatctgagttttcaaacttagtggcgtaaagttatttatagttttttaagacctaatattgacctaatattgattgtacacttatctctccttagctcctgaccaaccttgccaaaggtttgccaattttattcttttttagagatctgcaaactagggtctgtgtgcccagtctcactcacctcctgtttttataaataaatttttattggcacacagctgggcctatttatttatgtactgtttgtggctgattttgagctacaatggtgagttaagtagttgtgacacaggctgtttggcccgtaaagcctaaaatatttactctctggccttttacagaaaaagcttgccaacctctgatctttttgaagaagccactctgggcttagttgctattcttgcttgtgctgtacacgtgtatatatttgtctcctctcttagttattttattgttcttatctaacttaatttgggtgcttagttcattaatttttagtcattctttttctaatatgagcaattaaagtataaattttcactatgtattgattcagtgttattcccaaagttttgttatgaggttattttattatttttcaattttaattatttttatgatttctgaccatgtgttatttaaaagtgtttctttatttccaaatatgagtaattttttttccttatttttcctaatgatttctgacttaattacattgagggcaagagaacatggtttgtgtgatgccaaccctttaaaatttgttgagagtttagttatgattcattttgtggtctgtgttttttacgtttggaaacgatatcttaagcagttgttagtagagtgttctatatgtgtctgttctaacaagcttattaattctgtcattcaaatcttatattcttaactattattttgtctgcttgctctgtcagtaaaaagagttgtgtactaaaattttactgattgtagtgttgtctgtttctctttgtattacgcagtaatcttattaacctttaataatgtattttgctttagaaagctattttctttaatgttgatataaatacatgagctctctttttgttagtcattgcctattacatctttatatcttttttttttttggagacagggttcactttgtcaccctagctggaatgcagtggtgagatcacagcttactgtatcctcgacctcccaggcttaggtgattctcccactcagcctcctgggtagctgggaccacaggcatgtgccaccacacctagctaatttctttcttttcttttttccttccttccttccttccttccttccttcctttcttcctctctttctttcttctttccttttttttttttttttttttttttttttgtagggacagggtttccacgttgcccaggctggtctcaaactcctgggctcaagcgatctatctgcttcagcctccccaagtgttgggattacagacgtgagccaccacacctggtctattccttattatatctttatatcatccttttattttcagcctttctgaatccatgttttatatatatcttttataaatactgatcagttggattttaaagaacccagtcagacatgctttgttttttaactggaatatttggtccatgtacatttattatatgactaatattttggatttttttccattattttatttgtatctcccctctagccctgatatactttctgtacagatttatcatctgggattagcttccttctatcgaaagctcttttaggattttcttaatgaaggcctactggtggcaaactctgtccttccctacctactggaaaatatctttattttgccctcatttttaattactatttatttggggtattaaattctataatgttagtggttttcccttagtaattaaagatacctttgtgtaaattagcggggcgtggtggcgggcacctgtagtcctagctactcgggaggctgaggcaggagaatggcgtgaacctgggaggcggagcttgcagtgagccaagatcatgccactgcactccagcctgggcgacagagcaagactccatctcaaaaaaaaaaaaaaagttagtggttattctgctatttattgtgtacttttaaaatcttgtttctgtccaattctcctctcctgattctcaagtttcgtggttatttttactgtactgctttttagtcgtattttcaaatccctttgtttcttcaaatgaagtctttgagggtctgattttgctgtctgttgtttctactagtgttcacttttgttgccttgtttcttttgatgttttatgatttatgtgaattcatatttcttggaactttaactgtgagaacatttggagtcccgggaagaaagtgaattccctagaggttatttgctttttctttttactgggcatctggggacattacaaatctaagaccctatgaaaataaattctcagcccacttagtgtgaattatggttgattgggggttatgaaatcttaagagagtatcttctgttctctcccagtcattactagggttcaagacagataattttctttgcattctcctgggggtacagacgtatttctaattcagccttacattgggtgtgtgtggtgaggtttcagctttatggaggaggcatcttagactcttcaattctgatgggctgtgggctttgcctcttttttccttcccattctcctcaaccccatgaggccatgaagattgaaactcaagctcatcaagtttagcgactgtccctaacttaaacttctttgaggtactgtactcattaattttggcctcaatgtccttattctcatcagctcattgagcatttaaaagatgatcccctccctattttatttaacatttttagttttttttttctgagaggggccagtaatggtacctagccctcccagtgctggaaatgaaagtcctgattgccttttgagcctccctatcacacagttgttcacagtgtttttgtgccaacagtacttaaagtcacaatcatttaattgttggagattataattttaacaacctgtaaagaaagtttttttaggaatcagtaaaccactcttcttaaggataaagataactgtagtaagtccagtttttaagtccggttataaaagatagctaactttaagaggccgggcatggtggctcacgcctgtaatcccagcactttgggaggccaaggtgggtggattgcttgaggtcaggagttcgagaccagcctggccaacatgatgaaaccccgtctgtactaaaaatacaaaaaaattggctgggcatggtggcacatgcctgtagtcccagtaacttgggaggctgagacaggagaatcgcttgaacccggggcgctgaggttgcgccactgcattccagcctgggagacagagtgagactccatctcaaaaaaaaaagaaaaaggaagcgaactttaagaaatctttcacataaagatatggtggaattttggtattttgggccacaaaaagaggaaatggaggaaataagtaaaccagtaagggagaatatcttgttactttatccttttaacaaaattagagtattggcattcagaaaaagctaacagtgctgctgcaagtgacgggaatattttcatattttcccaactgcttgggaatattttcatttttcttttgtaattatatcatgatagttattgatgtgttcattattagcagctagggagcatgaaatctaggtaactctgacagaacacgtgtttttaagggagaggcttcatgaatcagctttttattacaacttgggggtgagctagagttacttctccagcctcagttttttaccaggttccctgagggcctggagtttagtctacttttttggtttgtgggagcctgaattcagtgacaatgaatgcattatgtttatttttcttggtttctggaaaggtaagagaaggaatactagaatattgttttcagtttatgttgaaaagttattttctgtgtttgtgcataagctagtacctctgaaatgttgtcagttaaaacatcttactgaaaatcagaggtttccttagtaatttagatttattaatatgaaaaataaatcgctacataaaaagctatttgagaatcctcttcaaggtcatttagctactgccatgctgaaactgatttattttgaatatcattatttaaagtatacatttcacttttaactccaataacattgtgcctttcaaaggcacttaggggaggaatttatctattgatgactctttaggaggagtggagaaggctgaaaataaattcttccttcaattatgctttcatattcagctatgggtttaaaataggagacctgggtttattattataacttgctgtcagtggccaaattaattgtctcagaacaaattaatataaattacagttataaatttggggaggaggatgttaaatatctatatcataccatgtaccataacacattctagatggtttaaatacttaggtgggaaaagtaaaacgattagactaaattatggaacatttatatattattagagtaggaagagattttctttgcctgtcacccaaggcatagaaactgtatggctaatgacaaacttaaaaaaaaatcccattacatatgatgaagagttaatgctgttaataaagaattcctgaagttctaagaacatgaaacattgtaatgagtcaaagatgtaagaaaaacctttagtttcatagtcaaagggatgcaaattacaaccaaatgctgttttagaaatataaaattggtaaagttttaaaaagataataactagtgttggtcaagattgtaggaaatggactcatcatgtaattattgacagcattatgatttagagaaacttttctgagggtagttaggtggaatgtataaatttcttaaaattttagtataccctgtgacctaactggtctatttgtaggaatttattgcaaagaaataattggatatgtgtgcaaaggtacacatttaagaatctcttatgcagcttttttttaaatagtctatggaaaactggaggtagtttgatgtccagagtgaaggtagtttaaataatatatggttgttttctacaatggaatattgtatgtgtgggtagtaaaagtgatattataaaggatttttcaattcattcgtcagtcaacagatatatattgaacttccagcccatgccagatgctaatgtaaacaagccacgtctctgccttaatacatcggtagaaatgaaaaatatagcatatgtaactgaaaaaagtagattacaaatttgtatgtacatatatacttaatgtttatatgtacactgaaatattggaataatgtatattagaatattgtcattctggatggaatgattgcatgctatttatttttgttttcaaaaattttaagtaagaaaaattattctaaataaagatgagatgcctgggtagggagaaagggtgactacagtagtcccctcttatctgtgagggacacattccaagacccccagttggatgcctgaaactgcaaatggtaccaaaccttatatatactgttcgtccctatacatgcatacctatgataaagtttaacttataaattaggcacagcaagagattaacaacaataactattaataataataaagtaggacaattagaacaatatgccagcattactgctcttgcactttggggccattgttgagtcaaataagggtaactggaatatgagcactgagatatcagaagagtccatctgttgactgagatggccaccaagtgactgacagccaggagtatagacagtgtagatacactggacaaagggatgattcatcacttggatgagacagagtgagatggcacacagtttaaaacttatgaattgtttatttgtataatttttcatttaatatttttgggtcccagttgaccacaggtaactgaaacctcagacagcaaaactgtgggtaagggggtactgccgtacctgatttcttatgaaaagaaaacaagaattaacactaaccacaaccttatgccaggtgtgtctcctcatctacatcttgttagagccttttgggatagtgatattatcccattttgcctctcagaataccaagtaccaagcctctcaaaagttttgcatgtccagagtcacagctggtaaatgatgaagcaggactctcctcaggtctgtctgccatcacgtcccattttctttttgctaatcatcatgccttggctaagtacatcttttgcatattaaaaaagtctgatatacctcttgacagtttcctatatctattgacaaaattatgtgaaaaaatttctagtttgttaaacaattacagattttgtgtttagggtaacaaaattttagtacaaagtgtttggtcaactagcaactctgtattggcaatatttaataattactgaattatgaaagggtggtagaattagatggatcttagagattagtccaacaccttgattttccaatatagccctagtatatgataactctgttttttactaagtgatttgataaatgtttaaaatcatatggtcttgattcctttttaagaattttcatgtcagttcataaaaaatctgtcagaccatctacattcatttttggttagagaaatggtgtcagcaaatcctgtattctaatattttgggtttttttataagcgagttgcagaatattttttactttttattttccttgtcgtctataaactctcctatctaaccaaaaaaaggatataaataaataaaatcaagatgactattatgattaatttgggctctgtgagatggcagatgagttggttttcttctgaaattcggcattaggaataattaggaataaataccattctgatttttatgaataatgattccattatataatggtgtaacattcttatattttaagtgaaaccttttgcattttgatgaaattaaaatgttcttaattttgaaactctgttttggatatccagctcactgttaatgaagcggctgctcaactctgtgtgaaggataatgccctgctgacaagaagagatgagctttttgccttggctcgacagatttctcgagaagtcacctataaatatacttacagaaccaccaagtaagtatttaactaatcgtcattatttttgcattgcttgagagaagtagagttcgaaacatcatctattgatagaatataagcatttctgaaaaagtggaagtatgattattgttctatgaaactaaacaatgcagtgattttgaaaacattgccaaggtgatttttgttgtttaattctcactgttctcttttgaaaggcatcattctctagttactatagcattgttctggtagtggttttaaacattcttctctcatacacacactttggttttgagtgtgacgaggggatttagtcagacagcatttatagacgtatttgtacacccgctaactacgtgaacttgttgaactctgaggaaatagaatggtcctttttgcaaggtgtttgaatctgatgagattagctgaatatgtaaaacgactctattgactagtatctaagggaaaattgaaagatacttctattactagcacatgggttatggaacacaagtttgaaataaaacgtgatgttaaaaagcaatggtggtttcaaaatttaatgtaaacacagcatatttttcttcaccctatccttacttgagccataagcattgtctacaggataggaccatttgattttgttcacttgattccacacagaccccgatttccagcccgcattgtgttgtgcctgccactgtttctctggatgcagatgaccactgcattagagtaactctaagtttttgttgaaaattcacattctgagcaccctttccagccctaatcaatcacattctttggggatggaactctggaatctgaactttcacaagcatcccagagcattcttgtgcatcctaagtttgaaaaccagcactataggcatttgccatcattaccattatttttcctaattcacagcagtttcattttctgccctacgtcagtacctacgtatttataactgacaagtaaaatcatgtagactaagtgaacagggtaagaatatacagcaacattctatgggattatttataaggttttttttttggagttggataatcaagagctgattcgctgatttttaattttcttcattgtattatacactattttctttctgagtactttatttaaataattttctttaatcaaagtgatacatgtccacagttcaagaagttgtataacatgtaaggctaacaatgaaactcaacggttcctgtgctctgccttcccgcttctcagttccatgttccagaggcaactgccttcaccgatttttagccatttcctctagtatttaccttcacctttcctttttttttttttttttttttttttgagacggagtcttgctctgtcaccaggctggagtgcaatagctcgatcttggttcactgcaacctccacctcctgggttcaagcgattctcttgcctcagcctcccaagtagctgggactacaggcgtgcaccaccatgcccagctaatttttgtatttttagtagagacgaggtttcaccatgttggccaggatggtctcgatctcttgaccttgtaatccacccaccttggcctcccaaagtgctgggattacaggcgtgagccactgtgcctaggctcacctttcctttaaagttaaatgtaccttaaaatatgttaacacttttacataatttagaagccaccttggactcctaaggtgccctcattatttttttacggctgcatggtattgaattgtgtggatgtgctgtgattcatttagcccctattgatggctactggggttgtgtctagtcttttattgtaaaaccacaataaataacatcatacataatatgttttgttgattctgagatgtactttttcacattttaacaaatcttttatattgaagtataacttgtagttgatggcttgtcatagtttaattaatttcatagtggtacatgaaataattatgtgtcttaccattgatggagcatcattttatatatatatatgtaggtaccactgggataggttttcccagcagagaaattgctgggtcagggtaaatacatctgtagtttctgtagatagacaaaatgcattttaatctcatgtagccataaacatacatcttaagtggtcattttagtcattttatcctaaattattcctactgaaccataaagggatatcctccttgatttttttttcattatgtgatgatcattaaatatttattaagtgctaggctgggcacagtggctcacgcctgtaatcccagcaatttggaaggctgaggtgggaggatcacttgagcctaggagtttgtggctagtctgggttgaacatagtgagaccccatctttaaaaaaaaaaattattgagtggctttcataccaaagccagaggtggtgagttcttaggtagtggccttttaaaatgtataattgtatctataccttcccctagtgttaacttggaaatgatgaaagatcttttcttcattattttaatgatcattatgaatatgtcatttctggtgttggagtttcagggtatatgttttggtggaaggttataggctgagatgcctttggaataaaatcagttactttctcaagtttttttttttttttctctcccctttcccttaggtcaaaatgtggagaaagagatgaattatccccaaagagaattaaagtggaggtatggtcatatgttacattttcttatgctgataatgtttgcttttgttttaagatcaagcaaaatcttaactagttcagacaaaaaagatggtcccataaactagtgaaaaatggctttcaataaatcttttaaaaatatagaattttgttaccttgaaatacaatatttacagtaatttgaattagcagaccaaggaaaatttttttaaacttttttttcatgtagagatgtggtctcgctatgttgcccaggctggtcttgcactcaaactcctgggctcaagtgatcctccctccttggcctcccaaaattctgggattacaggtgtgaaccaccatgcctagtcccaggaaattcttaaaagaaaactgtggtgactagtccagtcaatttatcaaaggttgatttgcaatcggtgtttcttacagatttaaaacttcacgggttaaaccattcctttcatagttgtatttacatcattagtcatcaaatacagaggagctaacttttcgtttctttatattaactatctaagggaaatgataatttagtagctataaattacagagactttactgtaactaaagcctcttttagagtgtcacggttgaggctgctcttttgattttagatttgcaagtggtaaggtgggagttaagaaaaacatacttaggactctccgaactatagaatggtttcagaactattgtttcttacaaatactttttaaaaagtctagtttgcagcagagtggaaatctggtcaggtggctccttcctttctttttgttttaggcaggggatggaggtcagtgttctcttagccatcctattatttaatttcaagttaaagcaaataatctatgcttgaccaccctaaatttctgtcatcagttatatctacagagtatctatatggcagtaatcctttattcatatcaaagccagagttatcttataaaaacataaatccctttcttgcttaactcctttcagtggctttctactgtacctggaataaaatctaaactttttttttaaaggatctaagaccccacatgatctgactgcagcttgcatctcctaccttgtctgctgccacactctccattcttactgtgttccagccgcactgactgactttctgttcctgaacatgccaaactcatttatgcctcaacactcactgttttccccctacctagacttctgtttctttagatggcttcaagtcacagctgagtttcccctgacttccctgcctccctttctaaaggggcaccctctccccaaaatcacactcaggcttattctcctggtttgttttcatagcattcgccagtatttgaaactgttagttacttgttttaaatttattatcagtctgccccattagatgagaataggtctcttatctgtgaatctgctgctgtatacttagagtttgtaacagccttgcacctaataggcacttaataaaatctatagaatgaaataatgaatggctgcagataagcatctttgacttataaacactttatctgaaagcagtggttctcaaggaagagaagtattttgtcaaaaacaaaaagccacattaaaaaaagaaatgtgggctgggtatggtggctcacacctataatcccaacacttcgggaggccaagacagaaggattgcttgagctcaggaggtcgagaccagcctgggcaacatggggagaccctgtctctacccccaaaaaagtacttatatttgtaacctacctcactgttagctctggaataatgtttaagatggttaactcagaaaatgttgaaattatctaaaaggctacattgaaagatgatataactagtgagatgttttatctcttgctcccccagataacaggtaacagagggtccttgtggatttggctgttaatgactcactgccactgaaagggaaaggcaggtgaacatagaaactgctaagaaggcatgtgccattggaggattgagaggaaagaaagcacagaaactacccaggggccaaaaaattagttgctaggctagaaatatgtctctatctatttctcaccattggccctaagtgtgatcatgattcaggctgctcacatttaagccacacttgtctagctttagaggtcactaaatattgaaatttgtgatcatgaatctcatggactgtttgagctgcagttgtttcttgatgagttttattggtaagtctttctgaccctctcagaggccttgtatttcattacagtgctttcagtttcttattagaagcacaaagtgttgggctgtaacattagatatgacctttctgttcctttaaatatactccactagagatacttgagttatagttctatacggttagtttattggtttactggaggtcacaaagccacttgaacagctctggattcaaaattaagataatcagtgttacttttccctgtgaataactcttctaacccttcctaaataagacaagcgacaatcggccccaggcttctttaaatgcttttatagacactagacttttgattttgtttcccagaaataagtagtaactacacctttgaatttaggacagtggctcacttttttgttgttggtttgtttttaattttgttctgttcctctttcttaaaaagcacttgtgtattgcaggtcatcagtatctcttgaacgtgtgtgtgtcttgtgtgtatgtatacctacacatgtagatggtgtaatcctttgcaaaatatatagtattggtatgaatccttgtctgtgctgtactataagtcaaatttgagataccagaactatttccggaagctgttatgaggtagatagtactggctgtataaagttaccactcccttaaaacttttcaccaagtactggtgctttatgtctaccttctatatggcttctggggagagggagaatttctggtatgagaagagatcaggggagactattgggaaggtgtaatttgagctgggtttttaaaagaagggtagaatttcaaaaggtagcgatgtggggaggggattggggtggcattataaagatagactagcatgggcaaagacagaggtaagaaaatactaagcatgttcagagaacaataagtttgtctagggaatgtgattgacacaaaggacctcataaataaaactagaaagaatttagaattcttttaacatactttttctcttatttcatttgagtctttctcttgtgattctcagcttgttattttctatttaaagaaagtaatatacaagactgagcatggtggcttatgactgtaatcccagcactttgtgaggctgaggcagatggattgcttgagtccaggagtttgagaccagcctgggcaacatggcaaaaccccatccttacaaaaattagccaggcatgatggcatgtgcctgtagtcccagctaatcaggaggctgaggtgggagaatcactgccccactgcactccagcccgggcaacagagcacaaccttgtctcaaacaaaggaaaaaaagtttttaagtaacgtacaaataaacttaagcttagcccattttatagtgtaacagatttctaattacaaggcccaaactaatgagacaagtttttctcttttttcaaatctttaagtgttctaaaatcctttataacaataagcatatgtgccacattgctggctttttccatcttaaaaacataatttttacagggaacaaaaagaaatgtaatgttgagcagataaaataaaataacatcaaaataatttgacatgtaaaggaaagagaaacatttttttgcttgtcattattaatgcattagggtacactaatacaagtagtgctgtgttcaagctcagtaagatctttcgttcctaaatactgtgttttcctgatctatacatgaaggcttgggtggaatgaagttataattcattgacttgtctgatttttctacctggaaagctcttatttatgtagtaggttgttcccccttaaaggatagttacttatttgatttaaaaaaaaaatagcagtatacacattgcatagaagtaatcaagataatctgttgtccttaaatagtgttcctccttacagggtatgttaaacattaaaaaacagattttgaactttaattcctagaatatatgagatggacatggagaaaaagatcgcctgctagcttaggtgtgccttaaggaacctaccatttggaatgaaatctctagggaaacgtttcttcagctagttagtaagtgaggttggaatccttctgcttagacggaatgaataacatgtccactggaacacagccctctgtgagtccactttcagctgaaatgaaaatagattttgtttattcttacttatcttttgaattagatctaattaaatcttctcattctggggcaattgtaaaaatcgctactttgtattgcttttattttgtgtcagtccctactagacatttggaattcattatcacaaacattcttgtctaacctatgtggaggctttatgatttccattttacagccaaggagagacccagacaggctcagtatcttcacctgtgttgccaaactgctatccagtagcagagccggggcttcctatctatgtctgattcctgaatgtcaaagcagtaccaccttcctaggtgctaatgattattcacaaagcatcttacctgtgaaaaaaacactattggggttatacctttcctcctagtaccgtgtgaagggcgaaatgtgtgcaggactggtagtctttgaaaagggtggatggtggcagttattattttctaatccaagaaatgttatgtagtaaacagttacaagttttgagtagaaaatttaacaatgtaaattacaaaatatttaaatataagaaattttcatttgatatgctgattgtttatgagtaaaaaccttgtgttgggaagatacacagagtaaatcagaaaaattagtttgatttccttatgtcctacctatgaaagaacatatttaaggtggcttgacagctcattcaaggggatgaaaaatcaagagccaaagtccctggctctcttgtcttctcctaaatttttttaaatgttagttaaaagtgaattcaattggtaacctttctttttcattaagaacacattcagttccatgaacaaatttgttattaactccaatgttataagtaacatcttagaagggaggaaggatatataaagctacagtctcagacctggtgatggcagctgactaactggactgagtgctatttctcatttgagttttcttcattcgctgaaattgctggagactgggcagagatgggaaatgacagcattcttgaccctgtgggagtcagaggtgcaaagcattcagagataagtggatgaaagaaatgaggtttgttaatagagcccaggaagtcagagaactggggcttgaagaagaaagacctaaaggaaacatctgctagcagttccagcaaggtgggggtgggagagcaaggaagggggaggaaagaggttcagaatatccacctacgctgctactaagcttgttgaaaagaaagctggtctaatttgacgtagactcttcccctctggatcagaaaaaacagaagcattacaatatgctattcatacagaaagtgtgattagaaaaaaggaaaatgcacatgtggggttgagaacatctgctgtaacaagtcatctagagacagctaagcagtggctttaaagcagcttgctagtgttcggcagaaaggatgaggaggcatggggatggagaccaatgggatgagagtaattaggtcatgcaccagcctccgtcccatagcttttattttctcagtgatcagacccagagtctcgtcagcaaggaaacactgtgattaatggcatcagccaaaaatatgacatggagatagattgctcatagtatggtgcagctagctggtgcctgggaaacaagcttacgagacataacgaaattgtgcaccacacataatgtgaaagagaccagtttcttgggaatgttcttacttttatttctaagtcatatattttggggaccttaaatctactttatgtgacatgcagtgatagctactcgattttgtagtttttccatccacagtgaactgtcaagactgtaggagtaaataatgactaatgtgctcagttgcagagagatcactgattactttggataattgttatttattacttattttaggcttttatttatctttattaatggtggaatagtgtccattttctagcaactttcacatgtagagtttgaggttcccccatccagctttttcagtattctcatggttgaataatcctgactttagtgccaccaggtatttgtatggcaatgtgtacttttccaaggttcacttatttgcgttactttatttaatccccacaaacttccagtgggcagatacacaggtggtgtaatcctaatttaaaaatttggatcactggaaataatgaggtttacttttttgcctgagatcacacagctggttcctaatgtgaaatgcctagatcatacctttctcctgcaagttcttccagaaacagtattgaggcattggggctcatggggattctgattggtgcactccactcagattctgctgatgaactgataaccctctaatctgggtctccagccttgattttaccccaagctccaaactcactgcccctgcttacctggcttatctacacacggaggtctcactagcaaatgagctcaaccgaattcatcagtgttctggcccctcccagacctcgtgatcttgagttccttattctagagaatgtcataaccaaactctcagttgccttatttctgcggcacctgccactgtccagggctgggccttcaccagcagccctctaaccagtgtccctgtcaccaccctgaactcccctcctccgcgtacattctccccatcacattcacatgtgatgggctttctgaaatgcaaatccgatcagtctcttccctgagactttcaatggcttctctttgtatttaagataagatctaaaattcttaacatagcttacaagggcttacagaatctggccctgtgtttccaccttccctcaccactccctctttttcagtgtatattgaatattttccggcttcccagagtgtgccctgttctttttgcctccaggcatctgtaccagctgctttcttttggaactctcagcctagacaccctggcctctgggatgcctgctctgccacagcgccctctgctgtgctctgggtctccgtccatttccctccctggactgtgttgtcaggagcgcctgaggcatggccatcttgtttgacgttgtattcccatattgagtacagtgtatgaatcagctgggtggatgcgacatttttgttgaatgtataaacacatgtttctagatttccagtgttcttttcactgagatagttccccacgaatgtgcttaatattctctggttgattttagtattaaatgttgagttcttccttctctaagatgtctgtactttgtaattgtccataaaatttctcttttttccccagtatgatgctttactctgattaaatctggtggctttttggatgaacttaacagatatcagtaacaaacatttatcaagtaattcctatgggccaggcactgtgttaagtatttttcatgaattttctgcttccttaaaatgattctgcaagttaagtactattgttatccccattttatagatgagaaaatagacacagagagatgaaataatctacccagtatcacagcaaataagtagtagagttgggttttgaactctgcaagtcatatagttaaagcccgtccagcttatgaaaaacagagctataatttctgtttatagaaatgcctgtgtttttgtgagtttcataaaggtagtaactctgaatttatggactgagcataggctttgaagctagcgttgtagctgtaaaaaaaaggaaacccagtcttgtctgtgatgaagattaaatgaaataatgaacataaaatatagaacatagggactggtatattgtagacccctggaaaatgataaccgcttatattgaagttgttctaactcttctactagcttacctcactgaacttgagaacttaagcagttccagtggggtgggggtttgctaaagagaaagttggatttttcagtctaaataaataagaaaacttatttataagaaaactggaatggctaagaaaaagggaactttggatttagcttggactgtatacacttatatgaagttcattttagcttattttatgattatgttccatacacatctgtgagccaacatggaaacctagaagagtggctattttcaacacttcaaaagtgctaattacatactggcccatgataaagctacataggaccatcttaagacgttaagtttattagctcttggctctatatcatgtctttgaattttaaaaatagcaaattagttattacttggggaatgtattttgatagataaaatatttgaaagaaatctgcagtggagaaataatttattgaaaagaccctgatgggggaaaatttttgaaccactatcttatatcccaaataaggtaaaatattttgttattattacattattccatctttttctgctgtgtattgtaagaactttggtttttaaggatttgccctctgctgcaaatatatagcttatcaaagaaggggagaaataatgttttggagtttaattgtaaatgctaatttctgtgaggagtcctttaggaggtttcactaaagttactaaaaccatgctgtcatgatattttgtagttataatgatcatgagcaataaacagtcaaaaaaagaaaaccttgaaaaaagtaggtggaataccaagtataaaatggaagtaatttaagttgaagttttatccagtgcccccagataggccctatttattatgggaatttagtatgtattgatatacttacttatttagtaattattacatgctgaaggcattatctcacttgctttatctcatttggtcctcacaacaatcctaatagataggttctcctatcctcaattttcctgtgaggaaactgaagttcagaaaggttaagttactcatccggtggtcacatagctagtgagtggtgacaggcctttcgaattccaaagctccatttcctgtcataggttatgataaaggtgaaatcgcaagccaacatgaaggaatccttgagcaattcaggttgggattatcggttagcactttaaagaacatttagtttggatcgttagccacatttcatgtaacaaaattaatttcagataggtcagagggttaaatttaaaaaacaaatcaaacttttagaaaaattagagggtagatttaagtactgaaccaaatttctgaagcagaatttctctaaactttatagcaacagttgaaatcacaaaataaaagtatgtacaactatagcatataaaacaggcatataaaaattaaatgatttttgagtatcaaaagtatagataaattggcataaattaagaaaacaagaattcttagtgctgacaaggaaattgtcatgtattgcttgtggtatgataaactagtaaaggccctctataggtttagcgaaagtacataaggcacaaaaatatcatctctgcagtaattctgcttctgggaatcttttgtagtagataatctaagctatcgaaaatgctatctccatgaaaatatttttgcagtgtttttcataaaaccaaaaattaggaaaagaataaaaaatgtccaatgcgaggatagtggctaatcaaaccccccactaggttaaatgttttttatgtgttttgtttttgtttttgtttttttgagacagaatctcactttatcaccctttgtcacccaggctggagtgcagtggtgcagtctcggctcactgcaacctccgcctcctgggttcaagcgattctcatgcttcagcctcccaagtagctgcccagcctccctagtagctgtgatttctggcgtgtgctaccactcccagctaattttttttttttttttttttttttttttagtagagatggggctttaccatattggacaggctggtctcgaactcctgacctcaggtgatctgcccaccttggcctcccaaagtgctgggattacaggcgtgagccactgcacccagcctaggtgaaatgttatataaccgttattatcaatgatcataaagccttctttccagtgtaaaacaataggaatgatgacatttttcatcttatttatgtttctactgaggttacagctgtagaaaataatgtatgtttcataaaaggctgaaatgaaatattttataaccattaaaatcttaatcatgattattcaggtagtgagattaagagtttgctttattttcaagtttttgataatattttattatttacaaactctaaatataaaggacttcttatttgacccacaggatgggtttccagatttccaggattctgtgcaaacactcttccagcaggctagagctaagagtgaagaacttgcagctcttagttcacaggtaacataaactcccagttattactccatgatagtatctgaaggttaaaaaataaatgactacttcaactagcttcagttttaagtatctgaggcctgactttttatttccgtttgttttttaaaacgtcatctgagccacagctgtatcaacatgagagcaataacaacttggtttgattcagtttatgaacggaatctgatatggtgctacttatttattcttgtagttttgtaggaagtgagacagattctctgctcaagaaaacttaaacagtttgataatcaggaaaaccagccatgttgaccatggctgtgtgtaatgcaactctgagataaaataatactagttctcaataaaatattaatagtcaacattgtaattattgttaaatcttttaaattcatatttattgaaaaactattaaatgaatatgtggcttcaggtgcttttgccattaagttatttaattttgtctgtatactgaaattaaaattttaaaatgctttctgcaaacatcatcttttagaaagcactgtaaacttttattcctattgaacagcttctttgtaataagttgcttttgatcaaatttagtactgctaagttttgtttttttcatgttaggatgaaaaatacattttttacctcagatatgcttatttaaattttgtcaatttagtaacaagttcaaatgaaatgaagttgtagttacttttgatttggtttatatgcactcagaaaaatagtgtgtttatcatgtttattctgtgaattaatatattttacctactgatttttacattgtgaatcagggcattttgtaaccaattttatatagcagctttcttgtcctactctcttatatagcatggtagtgattcatatctgtgcattttgactattatctccttggcaaaataccacaaatacactgctctgaatatcacatataagtaatttagagcagtgcattgaaaaggaacttataaaacacatacagagataaatttatatgtcagttgactaattgtatatttaaaatatgcctttttatgattggttgggaaatactgcagtttcatttcatgatgaaggtaaagatgcttattggcactgatgtttttctgcataatttacattgtttaattttagtgggaagtgtatttgtcttgttcttctagacagccgttttacaccttttctcccccaaacatattgtcatcatatcagagtctgtgtactgccagatcctaaaataaaaatgccaagatttcgccccaagtgttagaagtagtttatagcagatgttgctgttgcttttagatttctgttttaaaaaatcctttaaaggacttagtaccttggaaaacaaagctaaggttatgttgcttttgagctgacatggaattctcttgaaagaattgagaagaaagcttttatcttttgtacaatatccagccttttatgttttaacatgatgatatagacatctatgcatatttatggaatttgtataccacatgaagtgtgaactaattttaatgaatactaaatatatttgctggagtctgaaattggcatctttaaaccattaaaaaatctagaatgtttcagttactgatttgatttttgctttacttactagcagcctgaaaaggtgatggcaaagcagatggagttcctttgcaaccaagctggctatgagagactgcagcatgccgagaggaggttgtctgcagggctttacaggcagagctcagaagagcacagtcctaacggcttgacttccgataactcagatggacaaggtacatctttagaatatcctatgcctttagggccactatgtgcacttcaaagagaaacagaagacagtggctgatttttaaattatgatattttgtagagattattttacaggttctcttatcaaaattattttttgaattcttcatttttctaaaaagataatttatcctgcaaattttaatttgtaaattttttaatctttaagcagttggcacctgagattgacatgtattattttgtaggggttggtgggaatgtgagatgtcaacagtacagattattttccccgaagaagcagattccgggagagatgtttatcctttttaaatgaccaaaacttcatatttttttagacttcaaaaacaagtttgtgaaatttacagcatttggttcttaaaagaatatggtgactgcatctaaagtgttatgacagagtacagctcaggtttagaaagccatgtgattcgtgagtgtttttaccattctaaaaagtacttcattcttttcacatcctcacataaagaaaatcccaagtcattgttattcacccaaccaacaggcattttatttttttagcaattcctatgtgccaggcactctcctaggcactgaagatgcagcagggaacaaatccctgtttacctggagcttacatgtagtggagggagatgtacaggttatatatcctctagtttcaaatagtaataagtgtttgaagaaaaaaaataattttatagtgcctcctttttatatattattgttatacttttctagagagtggttattattgtaaaaaaataaaaggattcctaggtaaggataccatcttaacaaggattctccagccatggactgaaatattacatgtgtcaacacatcagagtactggaagagaagaaagttcttccttttaaaaatattacaggaacctctgagttgaggtcttgtttaacttctccaattatccttaacagttaagaagcaaaggcaattattaaagatttggtgactctaatttgtgacaccaggataattcagtgtggggtgacaatttgctaatgtgatggatttcagtacatgacaacatgattgggtgtataattttttcccatatttgtgctaaatctgttttttcacggattttgctgtagttttttttttttaatctttaattggcttgaagccttctgtgtctttctagtacttgttattatatgattaatgacatgccttggtaaaatggttgttctagtaagaaaatgccttatagaggagatgtattatatgccaaaactggaatgctcacaggaattctcagtcttttgtttagctcttaaaaatatcctggcagaattgtaaaccttgggactggcatgaaatgacttgccattttcctcttaaattattatttaaaatgttttttccaagtcttatttaaattcttcagtgctcgttgactctcctcacttttttcctaaggagtgttcaggcaaaatttatttttaagaaaaaccatggtatgtttttaatattatgcatatttcttttttcttttcattaggagaaagacctttgaatctccgaatgcctaatttacagaacagacaaccccatcattttgtggtggatggggagctgagcagactttaccccagtgaggcaaagtcccactcatcaggtgagaacgtgctatatgatgagagggtaacacttgaataaaagcatctttaaattctgttctatttcctcccccatcaaaaaaaaaaaaaaaaaaaaaaaagttattactgacagtgttcctacaggttgagtatccctaactggaaaattcgaaatgcttcaggatccaaaatgttttgagtgtcagaatgacactcaaaggaaacccgcattagaacatttcagatttgggatgctgaacctttggtgtaatgcaaatagtccaaaatctgaaaaagctcaaaatccatagcacttcctggtcccaggcattttggataagggatgctcaattgtcagtttttctccccttggaagtggtagattgccataacactggctgctctcactagtctttttgcaaacttcatattccgaacaatgacagggaaaactcatgaaagttgagattactttgattagccattatatgaatggtgatgtttatatgaaagtttaataataaatagctggtttgagttgtgttactaccttttttggcaataacataatatgaaattgatggactacatgtttgctttgacagtgagaaaaccttgtgtatcaaaatctagacttttcatgcagatgtattttggaggtgatactcatatttcagaagtaaactgaattccataaaaggatgagcagctccttatcatagttagatatttacatatttttatccaagtaaagtgagttagacctagttaaagcattagagaccagcacaatttgaaagaatctgttatcattcaagtctttgagttaaagtaactttaggagtcacttaatcaacgtcactgattttatagatgaggtagctaaagccaaataaatagctccaaatttgcattgtaagtcagcgggaaatgtagttttacaagcattaggattaaacctgactttacatctgttatctagatagaatgaattatgtatttactagaaaaaaagtgttatcaagagcatttatgtctttcaattttagatcatactcttggtagcagatgctaaaaagacgagttctaaataatgttctggtactgtgactttaaagcatgctattgcatacttgattgtagccattttaataatgtcaaagggaggttgggaaattgaaattatcctaaaaagatgacatcctggtctcatgttttccataacacaaaaaaagtgatctttaaagttttttcaaaaacgaacaaaaaacgactttttaccaatttatattccttagaagactctatgtaacaggaatactccaattacattgatcatgtgtctcatcatggggcatatttacatatttcatggagatatattacatagagatataattgatctaggtttttaggtagaaccgaatgaagaaatgcctgaaaaagcgtctttctttctctttttctttctttcttcctttcctttctttccttcctttctttcctttcttttctttcctttctttcttttcttttcttcctttcttttctttttttgagatggagtctcgctttctcgcccaggctggagtgcagtggctcaatctcggctcactccagctcctcctcccgggtttacgccattctcctgcctcagcctcccgagtagctaggactacaagtgcccgccactgcacctggctaattttttgtatttttagtagagacggggttttaccgtggtctcaatctcctgaccttgtgatccgcccgcctcggccccacaaagtgctgggattacaggtgtgagccactgtgcccggccaccttattctttatttttaactgaataggaataatacaggtttcatacagtgcaagcctgggtccagatcttagcaccgatacttgactgagtgaccctgactgagttacttaagtactcgtccttcagttgcttcattggtaaaagagaagtaatttctacctcgtagggtagttaggaggattaaacaagatagtgtacctgcatcgtacactatctattccagccagcaggaattcaataaatagtagctacttttttttactactcttacgcggaacttaaaatccccttctgtttagatagagaggattcataaattgagctatttaatttcagataagctattagtattgattactttctagaatccaaggtgtgagtgtatgtgatgtggatgtttgcatgtatatgtgtgtgtacatatctcccagtatttgtactttacataaaggttacatttgattgttattctgtagtgtttgtgtatggttgaaataactgtacacatagaactccatggaatgatttctcatgaaaatagtgttcattattttatccctatttcccctaccttaatatgtcattgtcggaagaactttaaaaaatagttccaaggttatgaagatatttttcagtctgattccttcattgatggtaaatattttaaccagtaacagttatttatgaataatcagcttccttttatatatttatcatgttggatcaagcattaaataaaaattaatatattctatatgctaaatgttttatgtgcatttcattatttaactttcgtgccactttatgtagatactattcctattttataaatgaagacattaaggcttagagaggtgtataacttgcccagagatgtatacatctatacatatatgtatactatatgtatacatctagtaattggcagagttgaaatttaaatccagaatccaagctcttaacagctctatgaacaaaaattttgcatggaattacagaatcatgaatagttgatactatttgatatggagtttgggggtttgttttaaaactttgtttgatttttgtagtccattgattaaaatatcaactcactttgtttccatttttatgtagagagccttgggattttaaaagactaccctcattcagcttttaccttagaaaagaaagtcatcaaaacagagcctgaagattcaagatagctgtgatttctctcaccgttctctggaaatggcatcagatttaaggataatactccatcatagaaataagccttaataaccagtgttgcctcattcagctcaaacagatttcatagccaaagcaaaaggactggtacggtagtctgtggaaaccaggaagataaaacaacagccacaaaagagaaaatcaagagtgttgcaatctataacagtaatattgattcattcacattcctgtgttaagtcattttatatggaaaggcttacaaatcaatattgtaagcattcattatttaagaatgtacaatgtatttgtgtaatttatagaagtaaaatctagatgttgagacctgtttggtctaatagatgtggatacagtttattttacttgaaattttgttgtctactttgtgtgtttaacgtaaatatatgtcagagtttagaatctgcctgcagttgtgaaaaagaaagcttaagtgatgcagttattggcaagattgcaatgattatggaaaaatagaaagcgaatactcagtttaagccaaggaaaatattgtggatttaatatttgataaaactgattttgtttaacaggaaatttttagcattcagtcatataacatctggttatcaatgcacgtttacacaataaatacttgagtggaggaaagttaaaaagatgagcaatagagtagaaaatatatcttaaactagttgacctagattgtattaatagctacttaagatgtttcaaagataggaagctattgcttggacagagaacttgaaataagtggacccatgtataaaagctttgacttaaacattgatatttcagaatgtgttaaatagattaagacacagtaagttaaccctacatgttataaagatggcgactgttaacaaaggctgtaacagattactattttatatccagaaagtcttctctatgtagagaagtcagagagactagatgctttcactagggaatgtcttcccacccagccatcacaaatgtggacaatcactgcatccacatctgtaggcatatttctatggaagtttaattgacagctatattcattatttattttacaatttcatttttctacacctttgagatttatgaatgcagttttttcttaaaatttattttaacttgacagtatgtttttagttcccccaatttaattaatggaccatgtgcatatatatgggagtgtgcttacatgttaataatttacttgcatacttatgagaatttcacattggaattcataatggtaaaacaacatacatctgccaatatacgttttttctgttggtttaagagaagataactgacagctttacctacttcctacagatgcatctaaacccagatattactgagaagagtgtattgactctgagtgtaagagagtatgtgtttttttgtttttagttctgctctagatcataattgtaaaaaatattaagtcataatctgttacactaaaatttgtcagccaaatgttagatgaaatgtctgcactgtagtctcagatcactgtcacgtatataaattgcttcttcattttaatttgtagaagtactttacagtaggaaacgccagtaaacaacttttatactgttaaaaggcttttttccccttcctaaatgttttaattgtaccatagtgttttgctcactgaagaagcttcttatggaccttgcaactttgttgctagcttgaggttgattattgtggttgtattgttcactgtgtgtagaaatagtatgagtacgatttcaatagactgttcagtttttaatattagccatagcactggttagtatatctcagtagtttcatgaaacgtttcctgtattctaatctattttgaaacattttgtttttttttaattgtgtcttacagtcaagtttgtagattttcataagccacaattttaaaagatgcagtaatcttccaacttccaatatttatccattcgttgtggacccacagattgcatctttaaattcataataagtttccttaactatcttatgtttctagtctttcaagcttagtgataaggtggaagcacaagaaaaatttcagtagaatacagtttttattttgtaaacactaatgtattaaacttgctatacattaaagcaaataatatatatttttatttgaattgtatatgtgaattggaagttataattagttgattttttcattttgttagaggtattttcactgaacaaggtcaattggttacctcagtattacagccaatatagtccaagggaccatttctccccgagtctcttacactttattgtgcgatgtccacgtttttgtgactcttcaagctgttggtgaggtgggacgaatgcacttgcttcctgtggcaataaagattttctgtgcctcacacatttatgtttatagcattttctacatagaagttttccagtgactaatattaacccactctacctcgcttatctgcttatttaagctgggtttcagtattaagggacaagaacttacgtcttaggttgggactaaatattgtcagctaccgtcatttctaaaaaatgatttggtaaacaggttctcagtagactcttgtctggcagagagaggtcaatttatattctcatttatgtagaagtttatgaagacgtttttaaaacttcaccatttctaaatattaataaaaggaacattaggatttaacatctataatacatatatgtataatattaatgtgatttgggttcagtgttatgggttaattatatgaaattgagctaacctgtagtaaagaaccaggaag

SEQ ID NO: 14224 - DNA, 9113 bp, Human
aggtgcttgctaccatgcccggctaattttcgtttttgttgtagttgttgttttgagacggagtctcactgtcgcccaggctggagtgcagtggcacaatcttggctcactgcaatctccatctcctgggttcaagcgattctcctgcctcagcttcctgagtagctgggattacagacatgtgccaccacgcccagctaatttttgtatttttagtagagactggatttcactttgttggtcaggctggtctcgaactcctgatcttgtgatgtgcccgcctcagcctcccaaagtgttgggattacaggcgtgagccactgcgccaggccttaaacatttgttgattggctggacaataaagaacttgctttagaaggaggagaggacaaaagaaaaaaaatggataggatctctttagttaagtttcagccacagaacctttactgggacaactcttgatcacatgtcaaactgctttcatttggggcaagaggataaggggaagttgcatggtgggaagtgcagagatctggaagacagaagattttactaagtctcttcccccagaaatagcaatgaaaaacaaatttacttgtattctgtctgttttcctttgacttgccagtctgtcagcttatatcttaattatctatctctgctccctgtctctattattgttttttcctctttaataatgatcaagtccaaagaaacgtgagaagccctgttcctagcaccttttcctgagtcaccagggaccccctctttctcccccagggaattactgggaacaagtctttctcattgggtcagactccacacagcactaatatggctaaaagccagagtaaagaaccagggaaagctggagtttggatgagtctggttaaagtccatcctagacagtccaaatgccctgaccccaaaggggaaggcccttctctccagcagagccagattttatgcaagacatttagtatgtcaaagtatcagtctctggccttggaggcaggtcttctgggccccgttttagctcctcccctgggtgatccaggttaactgagctctccactcctttgttcccccaaactttagacctttgacctaagaaagcaaccaagaaaggtcagtgcaggactgggagctcttgaggacacaagaattagagtaaaaggaaggggagagtggcattaaactaatagattcagaactgtagcctttccccagtccaacccttcacagatgggtaacgggggagggtccaggtccctctccaacgcgagttctcaagggcctccggttccagcctggccgaggagcgccatctggcggccaaccccccaacctggatcctctgccccatccgactttctgaagcccgaactagatctgggctggagagtttcacctcctctgcgtcactccggggactccgccctgccaggaacgctcctcctcaagcggggacaggcccaagcgcctcccccgcaggaaaactgcccatcctccctctagggtagactgcttctccagtagagtcggcttaaagctccccccagggatccgccccgcctcgtcgcccacagagcgcccgcctctccccaaggggcatctgcccctcgtcctccagtttccccttgaggagggagagagaacgtgctgcactgcgcccccaggttcaacctccaacccggtccctcccgaagaatggattcctcttctccttctcctcccctgccttatgggagcctcttccagtccacagaacccaaatcgaggttactaatgagctccccttcttcgtgcccaggggacccctctcggcctcaggctctgctcccctgagcttggcccatggccccggcgcccctgggactcggccccagccatctcaccacccgcgccagggggcggggctcccacggcccggccccgggtgggcgggtctatcgtgacgtcacttccgcccgggcctggccgaggttcgggctccgttggccgagggggccgtacggaggtggcagctgtgggaggaggcggcgtggaaggccgaggagctcaagcccggaccaatccccacgttccgggccgcgaccctgaccctgcagcgtaccgggaagcgaaaccggccggatgggccgctgagcccgaatcgggcactggtgaggctcgggcagagctggcagccccggacgggagcgggcccacggggctgcagggtctgggagcccgggatgcggggtggggagaggagaggctcaggcctacctctcctgctcgcctggcggggaggcgggagctagaggagtcgcagacaggcgcggggggcttagtgaggcccgcctgggggaggcctgagtgtaaggagggggcggggtgactggggtcattaatggggcggaggacctgcacttggcattctcatctagaacggtgtcgtcggcgggaggaggggagagtatgctaccggccagagctttgggaagaggatggctctgagtgggggagggaaaaaccgagagggttggaaaaattttccatggccctaattgagaaagaggtttgaagagcccttccctccctagagggttgtgtggaacacctggagtagggtctccctggagtttagggggtcagttacaggatttggaaaggacagtgctctgagagtccccacactgagtgggtgtgcaaaaccctggccacctccaagtatctgagcttccatatctttccagtgtggagccccctggagctgagatcaggatgttccgcttcatgagggacgtggagcctgaggatcccatgttcctgatgtgagtattccctccccctcaagctctcccactccaggtctctgagcagttcaggcagacatcggggttcccattgctaggaatggttggaactggctggatacctagctcctacctagcaggaagtaggcatcggtgccactgttgctctgtgcgtatttttttgcagggtggtggagggattgacagtttggcgcttctgccatccatactatgtgctcactccacagggatccctttgctattcaccgtcagcatatgagccgtatgttgtcaggtggctttggatatagccccttcctcagcatcacagatggcaacatgccagggaccaggcctgccagccgccggatgcagcaggtaatgatgctgagacacacctgagacccaaagaaaggttggaggttagttaggaaagcacttaattttcttgcactacagccaactgagcaagtgaaatgctctaggagttggggaaagggtcaggaaaaagggctttgtgactcccttttgagaggatggaaaaaaattgaggccatgggcctggtttgggattgtaaagagataggatgtggtctctaatttctgttcctcatgtgttcctgtaggctggagctgtctccccctttgggatgctgggaatggtgagtctttatctccctgtgtccttccatctcagacacactctctacccttagatattattcccaaatgtgcctcttaggaatagtttcatgagtaaccccagaatcttctctttttatggcattcacaaagctctgagcctgttgggtactaggagccctgtgggttaaaggtgttaaactcttgttgggaggccgagatgggtgatcacttgcagtcagaagttcgagaccagactggccaacatggtgaaaccccgtctctactaaaaataccaaaaaagccaggcatggtggcacacacctgtagtcccagctactcttgaatccgggaggtggagattgcagtgagccgagactgcgccactgccctccagcctgggcaacagagccagactccatctcaaaaaaaaaaaaaagaaaagatgttattaactgttgtactcctagaagttcatacgcattaggaagatgtaattgtctagcaaaatttgttcttttgaggagggaagtgcagttaaagggccaactagagatgattttttggtaggttttaacaatttcatgccttacctctttagagtttagaatccattactttggcttgcttcctaaagatggggggaatatagcaagcaggagaaggaaaattggatcacagcagtcacagagactgaggaaggggtcagcagttcacaggaggagaaatatgagtattctggttattttaacagaatgagaaagagaacttgctagatgtgaaggaagaagagaaaggaaatgtgcagccatgtgggttgtgggttcctaaacaggatcaactctgaacactgactttgctttcctgactctgttttccatctctttcctccagtcgggtggtttcatggacatgtttgggatgatgaatgacatgattggaaacatggtgagacttgccccatacccttccccggccttgctctcagtgatggctgacaacaccttgcatcctctaaggcaagagggaaacagtatgctagtgaagggtaaagtactggataaagtaattgaaccagagagccttgggaccctgtacctgctgtcatgcctgcctgaagcagccggcagcagctctcttacgtagcatacaattaaggccctgtctcttcaggtccttcttgctcgtggttggactcagaggaatttgggagggtaatgatgaggcctgatgttttttcagttcttgcattttgtgagaaagatacaggctagaacaggcagctgaagggtgaaatcccttcaccaggggtgatgcctccccattcagccctcccctacctaccctgtcctcaggaacacatgacagctggaggcaattgccagaccttctcatcttccactgtcatctcctactccaatacgggtgatggtgcccccaaggtctaccaagagacatcagagatgcgctcggcaccaggcggggtgagttggggagccctcctgtcccagagaaggtaggattgagcggcaccgccagaaaccctggctgcttttttccggattgggttgtgtgtggtgtgtttatcctgagatggtataggcagggctttggaaggggcggctgagtgtgccacgttctgcctcatcccagatccgggagacacggaggactgttcgggattcagacagtggactggagcagatgtccattgggcatcacatccgggacagggctcacatcctccagcgctcccgaaaccatcgcacgggggaccaggaggagcggcaggactatatcaacctggatgagagtgagccttccctcccgcttcctggctggcagcccctaacccggttcccgtggacatccctaacacatagacacttctggggcaaagctctgggtcagccccatattcctttttttttttttttgagatggagtctcgctcttgttgcccaggtgcccaggctggagtgcagtggcgcgatctcagctcactgcaacctccgcctcccgggtttaagcaattctcctgcctcagcctcccgtgtagctggaactacaggcatgtgccaccacgcccagctaatttctgtatttttagtagagacagggtttcaccatgttgggcaggccgttctcgaactcctgaccttgtgatccacccaccgaccgttggcctcccaaagtgccgggattacaggcatgagccactgcacccaactgtcagtcccatattcttaccgcacttggagcctcctccgctcgggcggagtcaggtgctggcggtgtctttgtgaggggcctactttgtccctgaagttccgtattgatagtgttacacccttctccaccttgatccgtttctttctcccctctttatctttttcaaatccgcaattattaagtacctagtgtgcacataggactgtgaacctgaactgaagaataatcccattctgatttcttcctccagtaggccaccttacgcctaccggtggcttcctgggaccgtgcagaaaccaaaagagctaagggaattgccaccccacccatccctgcacgcacactcagccttcgccgctttggcccgaaaagctgtggctcgctcgcacatcggcctccaggagccaggccgcacacaggcctcatgtccgctctgtcctttccaggtgaggccgcagcgtttgatgacgagtggcggcgggagacctcccgattccggcagcagcgtcccctggagtttcggcggcttgagtcctcaggggctgggggacgaagggcggaggggcctccccgcctggccatccagggacctgaggactccccttcccgacagtcccgccgctatgactggtgagggccccgggccctcagcctctcttgtaagtatcaggagtaaggagggtggggtgcacctgcggacggtcctcggctgcaaggcaggctcagttcaggctcccgcaggagctgcctttggtagtacaagttgacatggaaagagaacaatgttctcactgacataggggattaaaccccaactcctggctcttaacgtaagttttttcttccttttgacttgtgctcctctctctttccccctccaggtacaggctgagaggctgagaaatcatcccctgaataactttttcctctcgattcccatccccaatttaatattaaattaacaggcaagccggcccccacctctccctgggggtctcagggagaacctttcacggcaccctttccctaccttttccttctttaatctcctggtttaccattgatgacttcgcctctgcatctactgacttgatttttcattctgccactccatcttcaaaccccctcacctttcccatcctactcctgccatgcattgaagggtcaatgcattttggggtgagctctgggtttaggggccccctccatccctcagctaccctggatctttgcccacctcttcctcagagcccccactgaggggccgtagccctatctagggctgtggaaggagcagactggttcctaactctctccctcctcctgcccacacacatcaaaagaatcttccctacacccttctctgcctttattttttgatttgtgcaacttgtaactaggtgtttatggaataaaggagaatggaaaaaagaccaagtgggattctggctgtacttttgatcttttcctgttcaattcaaccctgctgtctcctctgaagttaccttctcacttttcctcgtctccacctgtagtcttcgtacctcagagttcaagcccacatctccttggtacggacagaccatcagcactgccaggtgcaggccgtgagcacttggctgggctaggctggggcgtgagaacatgagcacctctctcgctggctcttccctcacattctgctgtaactttgctcttcagggatgtgttgggcatctctcatgggtgcctgcggaacttgctgccccttgccccttggacagagtttctttcctgcactctgggtggaaacacttcagataaccctacacaggccttcagaggggaggaactctggtctgcagcgttccacaaaccctccacccacagtagttgagaatttgagcccagggaaggagcctagagaagaaaactaacctggaacctgagcaggactggaagggcatgaggagctcaaatttctcaagacgtttgctcttgctttgcccagccaaatgggtcactctgttcctcttgggaacttacttaatgatgacaaatgtgtaggagagtctgataatggtttcctctttatgaaagtcttgagttcttttcagttggtagggacacaaagacacctaaggctctgggtcctctcagggaagggaggatcttcccctgtgtctcgtggacgagtagattcaagaggataaggaggatttgtccagtgactcaacaagcagagagatgaagttgagctcaacaaccaggcactggtgtcctagtccagtgcagttactaaatctcagtaagtaggctaggctggtgaagatgcatgaccgggtcaagggaacccagtggtgaaagaatccaggaatcccagaagtcaatctagtgtggattattcaccaccacctgggctctgaactgtggatgatggaactcagcagccatggccctcatctttttatcttttttttttttgagatggagtattgctgtgtcacccaagcagtggcgtgatctcagctcactgcaacctccgcctccccagttcaagagattctcctgcctcagcctcctgagtagctgggactacaggcgcacaccaccacgcccggctaatttttgtatttttagtagaggcagggtttcaccatgttggccaggctggtctcgaactcctggactcaagtgatccacctgccttggcctcccaaagtgctgggattaagacgtgagctgctacgcctggcttcacagccctcatctttaagtgtaatcttgccctgtccagataagcacacgactgtttcctctgagaagggagtcgttttcttcactctcctgagaaggcagcaaggtaacctggagttgaaggagcctcagtccttagctcggccactgacagccttgtggtcttgggcaggtcactcacctccctggacctgagttatgtggggcccttctagccacaaaatatcaggcccagcctctcaacccggattttagttccagtgcccacacgcgcatgtgtagtcttgagtgtgactgcggcagagtaaggctgccctgacctcagtccaggtgagtcagtccagtgtttcagggactcccctgttcaggtcccagcctttagacatgtgaactgatttgtactcctgctccctgctgtagggtttggaccacccttcagcccagcacttactcctggggcctgtgactagttctcagcagggatatgttgtgggaagtgaggtgttagcatcagtagagtgagatgctcaagaaccagccccctagcacgtcctgacctgtctgccactggggtaagggccacgggagaggaagaggaaaggaactttcccgagggacacagatactctacttccggtcagctctccatctgggcccagcctcacacaacagccacccctcagccaccggcccagcgagtat

SEQ ID NO: 14225 - DNA, 7853 bp, Human; identical to SEQ ID NO: 12034

SEQ ID NO: 14226 - DNA, 9950 bp, Human; identical to SEQ ID NO: 12075

SEQ ID NO: 14227 - DNA, 8552 bp, Human
gctgattcaaatgagcattccacctggcaacagggtttctattggctatcaggaaaaataggaggaaggtggatggaggttgttggtggcggtgattggaggggggagaggagtggaggtgaccggagtggggggcggttaccagggcaacagggtaagagcccagcagggtgtccgagacagcaggcggggctgggaggtggagtggagggaagaggaaaggaaggcgggagggagaggaaagagcctgatggggagggagcgagactgggagactgggttgttggttggggggggggagtagcaaaggatcgaggagagggagataaatgaagcaagaggagtacagagatggagacggtgagagacggctgaagacatcagccagtgagtcagagaaacagattgagagagggacatggaaagatctcagaaaagatggacagagtccggcaaggaaaaatcctgggtggggccccaagatttttgaggagactgagactgaaatattgatagaaaagtcagaaagagaaactgggaggcgtgtacatcaagggaccaaaagatggtgtatttaagcactcaaacacaaaataatgataatgatcatcaacgtagttttttattaataaaatgaaaataataagatgaggaataatgataatgacagacaaatatgggagtgcacgcacaccaaaggtctttttccaaaccccagccttccactctgtccaccttcctgacctttaatacacaacccagcccctgttcccttctgaaatcccaagcttttcaaaatgactcaaagataccgagattgagggcgaggagctgaggatgtgtggaatagggtggggctggaactccagacctggacctgtattatatttgcaaaggaggcaaatataacccagaaaggctagggaagatggcagcagaggaatgagaaaagctgaaggatggaaaatgtaaaaaatgaggacagaaagaggagttgaggaaagccagccaagaatagagggccaggtgcctgactcagataagacaagagcagggttgtctgggaaagatagggaaagagaccagaggtggaagggcagaagagagtcagtgaggagtggagaagaggtgagagaagaatgggagcgattcgagttataattggttgtgaaggaggggtctaggtacagatgactgaggacggatgaagagaaatagaaggaccaggcgaataaaagtgaggtgagacgggcgaataagagaggtagaagatggaagagagctggaagacagcaaaggagaccagggggcctgactccccccggctcacagcacggggccaggaagggaggcacccggcaagggtcacaagtgtcaatctggcgggacagaaggctgggccgccctttctgccctcccatccctcctcaaggccatccagagaatgtggatggaggatgagagggggaaatccggcgtggtgtggaaggagcgcccgaaccctcttcctcttctttaagcttttggtttctcaaatacctgccctatcttcccatctgctcccctcaccccaccccttggcaaaatcccagggctttttttggggtcagtaggattctggccacctctccagtccgcccccaaaagccagactccacattcgcaggcagtaggttgggatttggaaaggtgcctccccgcaggaaccccaccccttcccacctcctcgccccactctttctccgcggccgtcagtctctccatttccccctcctggtctcgtcctccctcccgactccctagctctccctcccctcgctttcatcctcctatccccacctctccaacctcctctttcatccccctcccctctcctctcctccccgctcccgcctgccccacccctgggaagcccctcccgtcgggcagcgccgccttataagcgggttcccttcccgggggcggcagcggctggtcggcggcagctctgctggtgcgggggcggcgagcccgggatcgagctaccgcggccgagcgcgccggccaccgcctgcaccgcccttccgcccgccctccggacggccgcagccctgcgggtctccgctccagacccacccccgccccaccccgcgcgcctctgccgcctcttccagagacccagcttgccgagcggccgccgctgccgctgtcgccgccgccgccgccaccgcgccaggttccggccgcggccaccctccgccgtccagggcccctccgtctcggccccgggaccccggctccccgccagccccggccccggccccggcaccatgtcggagaaaagcgtggaggcagcggccgagttgagcgccaaggtacgggcgggggcggcggcggcccggacctcgcgcagccctggggcccggcgcggtccttcgccccaggccgcccccgacggccccgcgcggcccttgcgcccgggtcctggcggaccccactgcgccctcccaccgctccccggcccggagctcctttcccggctccgcgcggctagcgccagcgccctctagctgccctgcgcgcaccacggcgcccggcctcgccgctccggtcgcgccggcccccgcagccgtccccacccctcttcggccccacctcgctgaccggatcccgtccggcttcccgtccgaacgccccgagtctcactttgccgcgccccctccctgcgccccgctgccgcgtctttgcttgcaacctgacctcacctttcctcgctaagcggtttgagatcctcaagtgtaaacaggactctccctggaggctgctcctccgggcccctccccgcggcccgaccgtcgctcgcttctctccccggacggcggccgcctctgttttctcgttccctcccctcagctggctttcagctttcttttctcttcatcgtccccttcccgcatacacactgaaagaatctcgaattcctaaaaattagaagcggggcaggactagccttcgaaaaagccgaggctgggcattgcatggcattgcgtcgagctgtcctcgccctcatcagctcccttccccggccccatccgttcgcccttgcctctcttccagccttcctctaatttccccagggaacctgcggagtgtcgctttgggaaattaacgcggccggggtttgggggctgggagccctatcttgtgtgtgtatgtgtatggcggggggggggggcgcggtggttgctgaggggccgtcacacaggtctcccggaggcccgcggagtgaaacggggggagccaatgggattaacggcggtgggagaggggctgtgtgcgatctgccaaggtgcgcccgtgtggccctccggcgggctgtgcggtggcatgtgacttcactgagtaggtgtctttgtatgtctgaaatccagcgagtgtgtgggactgcccgtgtcagttacatgtgtgcatgtggagacgtagatgttctggagccatgttgtcgctttgtgagtgctgagtggctccgctgtgctcccgtgctgtctcaagagtgtggaccagaatggcccaacgctgggccatgtgtctcccatcgcgtgggtgctcctctctaactgtgtctgtgcatggctgtcggccggtgtcggtgtgtgtgcctgtgttgagtaaatgaggccagagggctgcttagcagaagacctagggcccaggtcacatattctcctggaaaagggatcatggaaggacagtgaccagaaggacagaacaggggaggagagggcccggccccttgaactttggtctctggtattctccctccctgcatcagcccagatgggaaagtcaggccagggccatacagacttttggtgctggggcccccagagagaagctgaccagctctttgctctcctggcccaggacgtagggaagagccccctaggtagtggaaatgccatactgaccttgtggcacagaaatgaagacctcacggtggggtggaagggcaccctctctggagtgagagtgaagagttctgagctacccttaaagggagaagggaattgagtgccccccagggcagccgttctgcaccaggctcctctcctatcccctatcctgttccagaaaggacccccccgcccagggtgatctcacacaggagacttccattcacatggaatcagatacacagcgtggcacaccaacaccagatcagatcacacaaggacacctaccgtgttacactgtgcctgccaaggagtgggtggggagagcactggaatctgaattgggaggctagtgtagtgtccagaagggactcagatgtgccatatcagcacaggacgtcaacctatgcctgctaggatcttggggtgaaggagaggggctggctggtgggagggtctcctagactggtccctccctcttctccattcctatcccaccccagtcacagaccttgtttgttgctctctccttgtttcccacgcctgctactcttcccctccttgttttctcttctacttcacctacatttccaccgtaaatggctacttccactacacccatgcatacaccatgggaggcagggatagaggaaactacttgaactgttttggggcggggagggcagaaagtgggaggggtgctgggaatgtgctaaggtgtagtgtttggccaagtaggggcctgaggattagggagacacagatggagagaaacaaagaccttagaagctgaaggggaagctgggagggatgcccaggagagagagtcctcaggaaaaggccccagaggtagacaaaaggcagagctgggcgggcagtggcggggcaggcaagggaggcggagggacacaggagggggcggggcactgaggctgcaagcagatggagaggatttgctttgctgagctgaactcttcagccagtgaggtttgggagaacttgatgggggtggggatcattaccctggttgcccgctcctgcttcttcatccctttcccacctcaccttgggtcttggggaaggaggtgtttggtctcaaccccttcatggccctaatgtaaggaccctagggcccctattctgtctctaagctgtggccaccttattcagttcacacacctctaagctcactacagagggagaactggggctgcagggacttaggggctgcaagccatttgtggtgagaaaggtgacctctttctcctttgcaggacctgaaggagaagaaggagaaggtggaggagaaggcaagccggaaagagcgaaagaaagaagtggtggaggtgtggaggggtgggggagaggaccacatctgccctaccatcttccctcccaatcatctcatccttcctctgctttccttccgagggtgctgggtcctgccgttcccctgagccctgtcacccttgctgccccaccctgtggcccatcccaagcccttttatcacccaggctccagtcccattggtggtgatggtgggcaaggcatgcagccagcctgaggctactccctctcctggtccccacaggaggaggagaacggggctgaggaggaagaagaagaaactgccgaggatggagaggaggaagatgaaggggaagaagaaggtggggaggggcaggggaggctgggctggcaaagtccgggctcaaaggagagcagagtcagggtgggtttgaagacctgaagcagggctgagggcgaccacgggggctctgccggagcttcctgcccttccccaatgacccatttctggctcctcagatgaggaagaagaagaagaggatgatgaagggcccgcgctgaagagagctgccgaagaggaggtttgggctgggttgctgggcctgaggggctgtcagggatgcagccgggctgggcgccctttggatttggacccagatccctgtgtggcaggggtgggggctggaacaggaccgggacagggggaggtctcccctcccattttacagctcccccattctctccctctccacaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaacctgtctcctgctttcccgggggctccagtcagtgcgacaaaagggtagagagggaggagggtggctgacctcccattctgccaggacccttccctttgatacaaaagcagcagcacactcctaccacccacgactcaagaagacaagatcagccctccaggggtggcctggagcccagctcttctgagagctgacttatgtcctgttttggattctcagggatgctcctccccagcaatacacacttccctgctaacccacacaagacctagacactgctgagcccagtggaaagctaccagctctattgtgctgaaccaggcacagagaaacagcccagaaacaggaagtcctgcccctgagctgggagagggctggtagtcctgggtctcagcctgctaggatctggagtgagctgcctggcatcagagatgccctctgcctggcatggaagcgagctccttccagtcaagcagggaaatcctgggtctcgtgtcatccccaggtcggctgtatgtttcgtcacctgccctccaactctccctgggctgggctggggagcgggagttgtatgactcttgtcagtcttgggccttccctagtcccactgcctctgtttcccctgagtttgatctctgttaggagatttctaagatttctgcatttctccatctccgcatggcccttgccttctcctcttagttcggaacctctggactggaggatgcttctgagggcatggggacctgagttggagtggggaggggtgttgactcatcaacagcatcatttctcccaggagacgcccgtaactcatccaaggtcaggactacacactgtcacgcacacaggtacactcacagcttttatcttcacgctccctaaccttggcaaattgtacaatttctttgaagctcagtttcctcatctgtacaatggggaaaagcattagatttcatgaattactataagtaaagtgtccaatacagtgcttagcacgtaatgaagcctcaatacaatgtagttattctccatgccccacaaagctggcatgcctagcctcagacctaccattttttggggtgcagtaaggcttcctgtccaccatgttcccagggacattgtactgatgggtggaaaggcaggtctaaaggggtcacgaagttctgggaggttaagggaacgaggaaggagattgagcaacaaggaaagagcttgccaagaaggaggtgtgaatattgggactgaggaggcagcttagagatgggcaagggggcagttccaggcagaaatggttcgtggaggcagaaggtccctgggagagggagcagtctggagggtggggcaggggcgaggagggggaggtggggagacccaggactgaggaagtaaacaaggggagcgccaccacagaggtggagaggtggagggtgctgctgctgggaatcaaccccctcagactttccactgcgaagcgaaaccgtaagccctggggtgcggggggcgggccgggaggaggggaagtggggaaggtggagggaaggccgggcacaggggtgaaggcccagagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccaggtaaaacggggatggcgggagggttgacctccagcccc

SEQ ID NO: 14228 - DNA, 18471 bp, Human
ttgtgtgtgtgtgtgtgtgtgttatgtgtgtgtattttttctagagatggggttttgccatgttgcctaggctggtcttgaactcctgggctcaagcgatctgaccaccccggccttccaacgtgctgggattacaggcatgagccaccgcacccaggctgggaacaaaatattgagataagagtgagatgggtccgaagcaggaggatagaggcccctttaaggaaccctgagagaatggcttcatggaccctacccaagaataatagatgacagcttcatcagcattccctgggcccaacgcttacctccactgctggtcttcataggtgtccgtgcaataccaagagtaggagagcggggatctgagtcctgggcatgtttaagaccctccagttgctcccctgctggtaggcctggctgtggagagctctccacctgtcaagaccataggctagaacaagtctgggccctgactcttctctcctctcctccccatattccaggaaggaattgccaaggccctcagatatccagcctaccccacacagattgagattgcagaaaataaggctaggataagggtggggtcatgacggctctctcaaaatcaggttaggaagagacccaagaattcagacattctctgcctttcccacgctggcccagagtacctggatgggagtgcgcaggatgccagcactaggtgaacgggggtccgccactcgagccagatgcttgttgtgcggcggaggccgcgctggtgtgactgggacgctcttggctgagcccatctcaaccaggagttgcagggtgggggcaagggccagcccgggacgaggagggaatgcctgtgagaagtgactcaggtctcagcccttatctcttccacgtcggaccttcaaccctaaaccaccctgtcttcccagtttccagtgaagaaacttcctggcgagggaccagaggcctctgcggagttaatgactgctgcagctgacaaaatggctcgttctgggcctgctgagccctctaacttatttattaaattattcaaatcacttaccgggccccaattccacctctggatgcacaacagctcgtggctcaactcccgaagttaccagtttcaaacttcccgccacgccccctgccctgaccctattggctgagccgacgtagttcccataggccctccacgtaagacccgcctcgagccaaaggaagctgttggtctgggagaacgtctatcatggtgactgtaggtgtcaatggactgatgctaggcttgcccaggggtgacgcctccttgataagggtacttctgttcagtatcggcctgcgagccgtccgtggcaggctgaggagtgccagtcttcgctttcgagacgtctagtctcaagaacgaattattaaacaaaatagaatcatgagtgattacactattatgcgcacatccagctggagttgtgatggttttcctgaggcgagcgatagtagctttattggttgacagctgtatcagtcactcgacacaaccccctcaagctccgcctcactggataccccctttacaaataccaagacaactgtccctcgactttccgaccggacaggtccccaggaaactttctggaattgagaggcctaaaacaaccgtcagttcctgctcttcaatagaaggcacgcgaatggactctaagggtcccggagccggagcagctgcggagccgcagcagctgcaaccccgaagcccacctagctgctctacgtgcgctcccgccctggaggagtgggattggttctttcaaccatcaattgccttaggagcgcttctcattggcgtcagtcaagcgcggggcaggggcggagcaccggcaggcaggctccgtccaactgccattctcgcgcgtcgtctccgcggcgcatgcccctaacgagtggcgctcattggacgggaggggcaggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggtaagcccattccccacgcccgcaacgagcacgacttccttccatcgccctggtcattccgctggggcctgcaaggcttgggctaccgcctccctgcgatgcaccatgggacttgtagtctcccacgctccactctgccgttgcctttcattaactgcggctgtcgtgtgactaccgtccccggaagccgccgcgctcacctctccggctccccgcttcgtggagcactgtgggcattgtagtcactcactgccttcgttgccgttctaagctaggggcgcagcccgaccgtcggactacatcccccaagtggacccttgagaaaacctggcagtcggccttgtctgccgcgcacggctctccgggttttgtagtctcgtgtaggagtgatggggacgactccccactgttctcggccggggttggagttggggggtggggaccgcagttcctaggcggttaatagtctgggagtggactctcaagaagtccgattctgagaaaggcagagagcctccaccccgtggttaaaacagacagggggcggggaggggaggaaagaggagaggaaagctctagtcgtttctcctttgaagtgagcaatggccgcagcccccacccttccccccgccccccagcctatcacagacagctgagataaccccttttaaagtattcctagagaggtggtttctttctcggaggatgctaaggcctctttcccatcccgctcccactcttggctagttacacaaagccacctcccacaccatgcttcacgttttgcaggctccacctggtacctcccttcctgcagttctgccttccctatgtcaccctcaagcggaggccctttggggcctgaactgagaaggcagcagcttggttgggatccgcccccctcaccacccctcccctcaagctgctgtgccctgcccagtgtattctgccagaaccagctcatggcctgaaaactgcaagtcagagtggaaagccttcattactgcatcaccagtactgagtagaacagcatgatgtgaggcccagttcaggatcatcactgtgatttgtggtttgcttggtttgctaggctttgatctgggcctcagacaatgtgctgcttctctgaagtctggctttggcagaggtaaaagagcactgcgcggagcagagctccggggttcccaatccttggtgaaatcagcatctttaatttccaacagaggagtttaatcacttcagagctcccacattcttcccaggagggaaaggtttttcttaaattaccagcaggtggtagaagtcagtgggtccctctttacacttttattcactcctgtctctctccttagtaactgctttgaataatccaaaaagggtttttgtaatcttctgaaactttccctttttcaccccaagtcaagagattttcagtgtgccctagttctttgctaaccaacttccagcatatttggttaccttcaaattgggctcatggtagaaagagcttagttgacctccccggtgagaaatgctctatttgttcatgaacttgcagtacacactgttcctaggaagtggtacagagcaatctatgggaccaagaactaccttagacagtgcactatttttcatatcacagcagagaaatgttcaaggccactgagacttttattcctggaagaggatgtctgttgttgctcaaagccttggatctgagggaagacccttattgtctccaatttcctcctccaccttctccatcactctttacaaaggcactggaaaacttggtcagctttgggggaagcccatcctcccttctcagctgtgtttctgggtggacacccgtctgtccctgttttcacgggttatgtgtgttctagctatctcagcaagtgttgcgagattgttgtcagaacgggatggctttgagattggtgatttgttgggacttcagcagggatcttattggtcggaggggaggcagaggagagagggtggtggctatggaatgctggacttcatgaccctgccagactgggtgcatgtttagctgtgagtccctaacaagtcattgttcccctggaagccacacttcagcaggagaggagggagaagactcacagtgtggaccagggttcgactacctggtagaatgtggtaaaagaaaggtctttttcgctggatgtttagtctcaccgctgtaatcccagcactttgggaggccaaggtggaaggattgtttgaggccacacaagttaaagaccagcctaagcaacatagcgagaccccacctctaaaaaaaaaaaaaaaaaaaatctaggcatggtggcatgtgcctgtagtcccagctcctttggagactgaggcagaaggatcacttgagccggggaggttgaggctgcagtgagctatgatcgtgccactgcactccagcctgggtgacagagtgcagtgtctctaaaataaaattttttttttttttaaaggaaaggtaattttgcttgctggcacactcgggtcagatatactgttcaagtgctggaatctctgctcctctggtctggaaggttttctgaatcatggagatgagatagggtttgtcttaggtgtcccctggtttgggttcagtgtctcacatgaaagtctttcctctcccacgaagggaccctttttccctttgaatgtaatctccagcactggaagtccacagtatttgatccccatttactttctggatctgttagccccaggacagaggtgaaggaagtcctctgtgattgattaaagagctccaaagcccaagaaggagcaggtggaaagataaatggtgactggtgttgctgttgaatggcgacgatgagctggtgttcctcagccccctgatgtccttgttggttgttatcaaagtcatgggaggaaatggggagaatcttagctatgtcccaggtcctaaaaggctaaataacttgccaagggccacacagtgttagagaacagaacatttcttctggaacccagcagtttctgactccaggttttggtttcctcacctgaccaggcttcataacatcctcgtgttttcacccttacctcttgtcccacaggagtctgaggggggcctctacatctgtatgaacacgtttctgggctttgggaaacagtatgtggagagacatttcaataagaccggccagcgagtctacttgcacctccggcggacccggcgcccggtaggagcagggctggggcaaggcctgggtacattgtctgttccattctgacctcctattggactcagtttctttttttcacctacttttgtgtcattaaagcttggcacagatgttttttagctttattccgttctgagatgaagcactacctccttccgtccctcctcccgacttgttccttcgctcgtgctcattgctgatccagcccttcctgcttctttacagaaagaggaggaccctgctacaggcactggagacccaccccggaagaagcccacgcggctggctattggtgagcaccgctgcagtcctattcttctccctgagctggtctttctggctctcagcagcaccaggaaagccccaaagagtgggcctgattgatggccctagaactctggatggggcaagtgaggtgctggctcggaggagggacattgacctgttgtcattgctctactctccctcttcttccctatccttccaggtgttgaaggcgggtttgaccttagcgaggagaagtttgaattagacgaggatgtgaagattgtcattttgccagattacctggagattgcccgggatggactggggggactgcctgacattgtcagagatcgggtatgactgccccctatgctacccaagattctagagcaagatgggccagggtagtggtgtcttaggcaagcactgacaaagctgaaggccaaggggaagaggggcatgtggggcagggggttgggtattgcctctgaccctctgcttcccccaggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctggtgaggcctggcccctctgcctcgggcaccacccccagagcaaggacaaggagcccacttttctgggggatctggtgggagagagggtagggagcaggacaggaagggaagcttggaaatgaacacgacatggggatggccagaggagaagagagagagaccttggattggcggggggcctgcagagccctctctctctgccactccctcaaatccccgacccacatttctgctgattctcttctctgtgggttagtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctggtacagcctcccctcctccagccactctcatgcttaaatatatttcatttgttagtaatttcgtgtgacatgtataatacatgaatgcattatcttgataagaaaggaaagtagtcaggtgcggtggctcatgtttgcaatcccaacactttgggaggccaaggcaggagaattgcttgagcctaggagttcgagaccagcctgggcaacatagtgagacctcatctctccaaaaaagaaaaaaaaagaaaaattggctgggtgtggtagctcctgcctgtagtctcacctactcaggaggctgaggcaggaggattgtttgagcacccgggaggttgaggctgcagtgagctatgattgcaccactggactccagcctgggctacagagaccctgtctcaaaaaaggaaaatactgcagatgagactaaatttttgattactccccactcaaatcctcatccctttcctaccaagcctgtcttaccttatcctatacaggtagaatcagaatcacaagtaattccaaccctcacccggtttcatctgtcttccctgaccgtcagccccagaagggccatgaccgcactcatattactcatattcaagggaaccaagagggtggaccttactggctctccttctgtcccctcaagtcccttctgtgcaagggatgggatggtggcctggctagtcctgagccacttcccctgattctcttcctgcctcctgctctagacgtgtactcatatgatgaggatgacatggtcctggaccccagcctggctgagcacctgtcccacttcggcatcgacatgctgaagatgcagaaggtgagacccccttcaacttcagattcttctacttcctgcccctgtgagggcccttcctctttgcctgaggctgaggtagggttttggagaaatcttctagttaaccccatccccaagatacacaggcttcttttaaatatctaaaatcatttattcagtgaatagtactgagtacctactatgtgctagaggctgtgtgaataagacagatgtggtttttgcttacaagagttctactctagaagaaaaggcagacattagtcacattcccagataaataagtgaatagttgcaaactggtgggcactgtgaaagagaggcggagggtactacagtaattgacagcagggtggcctggcctagtttagggatcagggacatttccctgaggaagcgatgcttaactgacaatgtgaaggaggttaggggtaacttaaggatgggaaaaacatttcaggtagaaggaaattttattcctcattcaagcagaggccctgatgactaacgggcctctgggacaattatgtgtggccttccagaacttgaactggacgatactcaacatacctcccatgtttgagcctgtaattccacaaattctaggccacagttgagtatcatcctagactcagtgagagatcgaggtaaaaactacagggttgagtttctcactcagtctgaagtgccccttctcacacagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtgagtagtgccctctccttccccaggccccctcctggtcagcaccctctgggcatactcctccttcagcttccctcagcacctctgtgtttgattctagtcttagagtagttcctatcggctgggtgtgttggcccacacccgtaatcccagtacttcgggaggccaagatgggagaattgcttgagcccaggaggttgagaccagcctgggcaacatagcgagaccctgtcttctcttaaaaaaaaaaaagaataattcctgtcacactctggctgacatgctgtgaggggagcaagttagggagctgcaccaccagcaccccaacacacaaaccccactgatagtgcagagtgccaagtcccagggctctgtggccttctgacagactcaagggttagcaggtggtctttattttagggcagtgacatcagatgagcacctaacatggacatgtagcacttggggaggaggggggcttggcacactaagaataaaggcaggttctcagcagaaatgagtttactttcgaatttggggaacaattagaatgtgaatgctcagaacatgtcaacaggttctgtccaatagaacgtgaactgcacttatcctaatcccaggctaccttccccctccccggctcctctgccgccgagcgtgcttgcacattggacatagctgagaaggggagaacaggcaggttgctggagagaagcgactccaaggttcacccacagcaactccccactcttgaggggagcccgttcacagagttagtaaatgtttgcttccttcccttttcctcggcgctcaggccagagcccctccaactgtccttcccttgacttttaggtatgtggataagctggagaagatcttccagaatgccccgacggaccctacccaggatttcagcacccaggtgtatgtaaccaggtcctatgtaggaaagctgttgacagtcatggccgtataccttcctcctccctgaccgcctggggggcacagcactttaacccctggcctttttttgttttgttttgttttgttttttgagacggagtcttgttctgttgccaggctggagtgcagtggcgcgatctcggctcactacaacctctgcctcctgggttcaagtgattctcctgcctcagtctcctgagtagctaggactacaggcacatgccaccacgcccagctaaattttttttgtatttttagtagagacggggtttcatcatgttggccaggatggtctcgatctcctgacctcgtggtctgcccacctcggcctcccaaagtgctgggattacaggcgtgagccaccgtgcacggccaccactggcctattaggagcattcgggtgactgtcttctggacgtgttgtctgtcttgagctgggttcctgtagaatctaaggtttttcacgttgttgagagttagctagggagagccacgagcagggggttgagctggggacacacagggtcgttagttgactgaagtgaaatgttttcttggatattaatgcagggccaagctgggccatggccttctctccggggagtattccaagccagtaccggagtcgggcgatggggagcgggtgccagaacagaaggtgcgtctaggaccctgtccctttcaggccctgggattgtggggaagctgaggtctgggagatgtctaaagaaggcccctggatggccactgagccccagctgagtccctgccctgactcttcccaggaagttcaagatggcattgcccctcggatgttcaaggccctcatcggcaagggccaccctgaattctccaccaaccggcagcaggatgcccaggagttcttccttcaccttatcaacatggtggaggtaagggctggcaagatggcacacccccatcttcctgcaatttactcgctctccttcctgcccatttctccctctatcagccccaacccagtcccatccctgaaccccaacagtctgtgtccctgtgaacagtgcttgcacctgaggaggacagtgaaggtgatgatccctacccttgatgggcttgaagcccaattcagattatgcccaaagacaatgataagagaatacttgctgcttataaagaaaaatacaagcgtgttctaacacagtccctcagtgcagggatggggccagaaatggggaggggttggtgaattagggaaggtttctgctctgctcttgtgtccctgagttccgagtggtagtctgccttctctccctgactctcccatgaacctttcaggccccattctgttccctggctgcccagacctccctaccctgcctctttcccatagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaaggtaggctgctccatcagcaaggccgtggcacggtgggaggctaaggtctaggaggaatgcttgggcacctcatgggagcacagcccagggaatgccctgcttcaccagccaaggttccagtctgggccaccaggagtaggtagattaacctcgtccagtggacactcagcttgttagcagagctgcatggaaacaggcgagatatattggacatgtgtcaggggtgctttggaagggtagaggaactgaaatacggacacagagccagtagggagaggctaaggaggcaaagaagcagcaccctccgaaggatccaccaacccattctgtcaccagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagtaagtcctctggtcggggcctgaggctgtgggtctatggcagagctatcccagaggatacttctgtctcttccctgttctttcatccctttgtggttggaacctcagggttgaatcagttgggctggtaatctggccctgatggaaccaaggggccctggtaggggggacacgggtactgactctatctgtcaccttgtcctgccccaaccactccctcttctgtggcacagggtctctttgtagtgtagcctctcttcattgcccctcagtcatggctgagcacaggcacttaggatcagctgtgggcagaatttggatttccagcaaatagccacactttgagcctagccattggcacctggcatgggtgtgagacctgaaaaagggctttggtctcggggagtcagctacccagccctttgctgctcctgccagtgaaacagctcttcctctctgtgtgggttttttttttttttctatgtgtgggtcttgctatgtttttttccctacgtgtgggtcttgctatgttgcccaggttggtctcttaactcctgggctcaagcagtcgtcctgccttggcctcccaaagtgctggaattacagatatgagccaccatgcctgggcttttttctttttcttttttttgttgacagccttccttctggcctctactgctcctcgttggccgaggacaggcatcagacacctgcccaggggaagagaagaatatggaggatcttctgggttattgggacttctacccatgaggggctgaaccccaggtgggagtttcaggagaggaaaaccctggggattgtctgggtaccagcacagtctctcttccctaggaccacacgatttgcctcattccctgactacctggtcatccagatcaagaagttcaccttcggcttagactgggtgcccaagaaactgggtatggctgctggaatgagggaggttacacagaaaatgctagaaaaagaaggggctttaacacatataaactagtgtttctcaaagtttcctctgaaagaggaaaaaaaatcaccttcaatgtttcaaaatttatctagtttgaaagcactaactaaaaatattaaaagacttctttgattgttataggtatgatttacaaccaaaagtgatttttgtagttttttaaaataattggtaaaatgttttcattttgataatcttgaaacaattaattctcgtgagtcttacaggtccctgactgtcatttgagaactcgtgatgtaccttcattttctagataaggaagttgagactcacaggaatataaaatcattctgtctcacaagttctaggccccctgccctgtccatagattatttatggtagatctaggaccagcatcctggcctcccaactcccaggcttagtattatttgtcttatactgggacccctaagatgggtgccgtgcttttagcagctcctctttacagagcagttctgacatagggggcaggggattgaggttcccgaatcactttccaggtaggcctccgggagctgctgaggtgacccttttcccacagatgtgtccatcgagatgccagaggagctcgacatctcccagttgaggggcacagggctgcagcccggagaggaggagctgccagacattgccccacccctggtcactccggatgagcccaaaggtagccttggtttctatggcaacgaagacgaagactccttctgctcccctcacttctcctctccgacatgttagtgactcttcttcctgcctgtctctctcccgtgctgatgggggcctctctgccttgcatcccctgcccctgtcctttgtgtttctcctgtcctccctttcaaatttcctctgccctctttgattgacatggggcctccccagcgcactcctagccaccttctgggtgtggatggcagcagtgccagctagtggcctctctgcccttgttacctccctggtttgggtagggtgggggtatcatgctccagaaacagggcccattctgtgagaatgggcagggacccacattacaattgtgtggtcattttggttttgggataaggtgccaatccatgggagaaaaatgcatggaatgggtgattggaagagggctgggtcctgggggagggaggaggagcaaacagtggcccaatcagtcggtccgtgtacccacaattcccattacagcgcccatgctggatgaatcagtcatcatccagctggtggagatgggattccctatggacgcctgccgcaaagctgtctactacacgggcaacagcggggctgaggccgccatgaactgggtcatgtcacacatggatgatccaggtaggctggggtggggagcagggtggggcagggcctccatcctcccccaaacacatcaaccccttcacatccacagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacggtatgggctgccccagctaaggacatggggccagtggggaagaagggggtgggaatgaggggccatccttcttgagcaagaccaaagacaacaggtgtggtctggccgaggttgggcaccactcttttgtggctgcgatgaaggagctgaagcctgcgttcactgctgggttttttgccccagaacttgttaaaaatgtaatgcttctgtttggccgggcgcggtggctcacgcctgtaatcccagcactttgggagggtgaggtgggcggatcacgcggtcagcagatcaagaccatcctggctaacacggtgaaaccccgtctctacgaaaaatacaaaaaattaaccaagcgtggtggtgggcgtctgtagtcccagctacttgggaggctgaggcaggagaaaggcgtgaacccgggaggcggagcttgcagtgagccgagatcgcgccactgcactccagcctgggcgacagagcaagactccgtctcaagaaaaaaagtaatgcttccttcctctccaagaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaagtgagtatccccaggaagcaggacaggcctggtggaatctggtcagtctactacaccagatccctcattcaggcagctctgccctcctcaggagtcaggggcttctttccacctcaacgtggcatctgagggtggggttctctgacatggagacaggctctggcccagtacctgcctcacattccctgaaactcctgtcctgagtctgagctgttgtctggatctttgggccatcactcaagcattcctcttctgtttccttctctgaccccctctctcctttcctagagtatcagctctttgccttcattagtcacatgggcacctctaccatgtgtggtcactacgtctgccacatcaagaaagaaggcaggtgagtgctggccacatgcgttttgaatggagaatggtggtgggaatgaggagggccatttggaagtccttgggatagctatgggagaaggtgaagggactgcctgatggggacataaagtgccagagagtgacagaaggtcttgcagcagtgattggcccaagggttggatctggccaccagctttttttttaaatagagatgggatctcactatgttgcccaggctggtcttgaactcctgagctcaagtgatccttctgcctcggcctcccaaagtgctaggattacaggcatgagctaccgtgcctggccaggccccctgcctttgtaaataaattttcactggaacctggacacacttgtttatgtgttgtttgtgcctgttttcacgctgcggcaggaaagttgagtcgttgtgtcagagaccagagagagagcctgcagaacctcaaatactatctggcccttgccagaaaaagtttaccaaccccctgcctccctggaatgggtggagggtggttgtaaaggtactggaggatctgaagacataatagggtccgtgacccttgtgaggttgtgaagctcccttaaggcacatggtggctgggctgtggatttggggtatgggcagagagtgtggagagcacttccaggggccatgtctgagagactacatgatgccactttgaatgcccagtttgttcatccttttctgttttccccacttccccagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaattgtgtcctgtttgataccttgggggagaggcttaccttcctggggttagcaggagggcgcttaagaaaactcctaactctggccgcctccctgccaaagtcaagtctccacttttcactggttctagagctctaggaaaattggggttgggtggggaggtggagtagagtgactaaatgccgacacaaagccaaggaaagatggagtgaagaacccttccctctctttattcacacaggagtggaggatttcccaaatgtccctaactggctagctggcttcaggctgggactcagtccctgcagttcctgccaggccttgccagccggggcgagggttgggatgatcctggcggcctatgcctgtgtgggctgcccctcccgctgtgaaccctgcatttgtcccgcaagttttcactcaggtagactccctgggtacaagggtgcctgctcagcagtcgggcatgagctgctccgatgggcgaaggaggttgtctattccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccctcctcgccggcgtccgcgtccccgcgccgagctgctcgggctccctgagcccccagatctgaccccttcccttcggcaacctgagcgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcag

SEQ ID NO: 14229 - DNA, 7301 bp, Human
ctaggattacaggcatgagctaccgtgcctggccaggccccctgcctttgtaaataaattttcactggaacctggacacacttgtttatgtgttgtttgtgcctgttttcacgctgcggcaggaaagttgagtcgttgtgtcagagaccagagagagagcctgcagaacctcaaatactatctggcccttgccagaaaaagtttaccaaccccctgcctccctggaatgggtggagggtggttgtaaaggtactggaggatctgaagacataatagggtccgtgacccttgtgaggttgtgaagctcccttaaggcacatggtggctgggctgtggatttggggtatgggcagagagtgtggagagcacttccaggggccatgtctgagagactacatgatgccactttgaatgcccagtttgttcatccttttctgttttccccacttccccagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaattgtgtcctgtttgataccttgggggagaggcttaccttcctggggttagcaggagggcgcttaagaaaactcctaactctggccgcctccctgccaaagtcaagtctccacttttcactggttctagagctctaggaaaattggggttgggtggggaggtggagtagagtgactaaatgccgacacaaagccaaggaaagatggagtgaagaacccttccctctctttattcacacaggagtggaggatttcccaaatgtccctaactggctagctggcttcaggctgggactcagtccctgcagttcctgccaggccttgccagccggggcgagggttgggatgatcctggcggcctatgcctgtgtgggctgcccctcccgctgtgaaccctgcatttgtcccgcaagttttcactcaggtagactccctgggtacaagggtgcctgctcagcagtcgggcatgagctgctccgatgggcgaaggaggttgtctattccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccctcctcgccggcgtccgcgtccccgcgccgagctgctcgggctccctgagcccccagatctgaccccttcccttcggcaacctgagcgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcagagggcagggtgagggccgtggcctctcaggggtatctggaaggctcttcgagttgagtgcagacccagcctgggctggaaaatggacaaaggtcatcttgctggggtgaaaagggggagagcagaaccaagaagaagagggtgagggctggggggctccagggcactggttaggaattgtggggaatgaaggctttctttagtctcatccccctgtggtaccatcttgtcctcagaggtggtttgtgctccccctactgcctatatcgacttcgcccggcagaagctagatcccaagattgctgtggctgcgcagaactgctacaaagtgactaatggggcttttactggggagatcaggtgagatcgaggtggagaggggtgtgtgggacccttccctcactttcctcgttgaggggaaagccacagggtgggctccctgctgaaccttggcttcatctcttcctttagccctggcatgatcaaagactgcggagccacgtgggtggtcctggggcactcagagagaaggcatgtctttggggagtcagatgaggttagtagccaagagagaagataagggatgtctttttccaagaaggatgtctcaccaagtctgtttctcaacagctgattgggcagaaagtggcccatgctctggcagagggactcggagtaatcgcctgcattggggagaagctagatgaaagggaagctggcatcactgagaaggttgttttcgagcagacaaaggtcatcgcaggtatctctggagaaagggacctttgagcctatccagggccacagagactcagagggtagggtcaggccctggagcctgtcttggtccccatgctgatccagaaaaggaaaaaggggagggggagtgacaatctttgcttggggcctatgacttctccagccccaaggtagatgccacctggaaatcccccaatgtccactagggggcagtaggccaccgttcttcgtactccggagaacctggctggagagctctttcttgttcacccttccctccatctgtatctctgccctgcagataacgtgaaggactggagcaaggtcgtcctggcctatgagcctgtgtgggccattggtactggcaagactgcaacaccccaacaggtaaccgggcccaggagccctgccctcatcccagcctgcctcaataggtttggacagacacagcccacatggggcaaccccttatttcaaagacacagagaccttgaacccagagacagtgacttgtccaagggcatccagtccagggcctggcttggatcagagccctggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggctttggttcccggctgaggtggagtgggctgaggactagactgagccctcggacatggaggtggggatggggcagactcatcccattcttgaccaagcccttgttctgctcccttcccaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttactatttttacttgaaaaaatgttttgcgtagcagactgtcatagccttgaacgccggctccctttcttcctccctccaagtggctctggggctgttgatttccgcagagcttgggttggggtaggggctcagcctcaccagctttcagcagctggtctaggccagcagtgcctccccacctccccaaggggaggggtggtggcaagacctcagcacagtctgtggtatcacagggctcactggtagagcaggtagcgcttcatggcagggggcaagggcagggcagacacctggccgagccgggtatcccccaggttgtggcgcacacacaggcggctcaggtgcagaagggagtgtggctccgctgggagagagaaggaggggaatgtaagtatgggtgcagccaccagccagatgtcctcaaactacggggtcctactcagatgcctttctgctttcctgcttcgagtgtgcccacctggctgaaaggggaatttgagatacccggaagttctgcctcccagataagatttcacacatccctagtcagagctgggggtgaagagctggctaaggccctctaaacaacaggccaaggtggctctgacagtggtggagctggcccaggctttgactccagaggcttgggagctggggctgaggtgaggagggatggccctccactctacagcccacacaactgcagagagcagctccaagccctggacccagtcagttcctggggaggctcctcccctgctgccccaccctaaggccctgcctcctccactgctctcctccctggtgcccagggccccagtgtctccatcctgaggtgtggctgaggaaggaagtaggtatgtggcacagagacaggttagagcccagggaatccggtatacagcctgggtacctggctctgcccatccttcttttggacctgtacatcaaacccagtacctaacgctttgcacctcttgctcaggggttgatatctcctgaattctctcatccctgcagttcctccctccattctgaaggttcaccatttactggccaagagaacttgagaaagttgctttctcaagcctgtttcacctctattgctgttgggttaaattaaataacagctgtgaagacccctagcctttcccagcactgaacagaggttgaggcaggctggatgaaggtccatcccctctgctcttgtcagaagagtttccatcccaaaccactgccaccagggacagaaagttctccccacgtctgccccaggcctcacctctcctttcgcccaggtagcggatgcggacctggcactggccccagacagcgcttactgccggatagagggtcctgcccttcagtccgcggaatgctggccccaggtaggtgcccccaatagcgtagcccagagttccctcctccatgtccagaaccaccagcagtctctctggcacctccagctgctcaccctgagttcccgctggatactggggggctccgggccccttgctctgatggtacagcttcccccgcccgatgtcccagccccacgactcgctgttgctgcccagcagcgccgcgtagtggtcagtctgcagcggggcgagggccgtggccacgcccaccacggcatgcgtgcccctctgctctaggggccagctgatctcccaggcgtgcaggccccttgaatagcccctcttaccccgggccccatcagtgctctgggccacgggccgccgctcaaagtacaaccctccttccttgacctcgatgttctctgaacagtctttggggttccaaccgtggcgccgctgggcccccaggtcaggagggggtgcagacagcagctcttccaagccctcgggac

SEQ ID NO: 14230 - DNA, 13248 bp, Human; identical to SEQ ID NO: 12024

SEQ ID NO: 14231 - DNA, 13945 bp, Human
tctgaacactccgagatgagcgagagcgccagcgggtgtcccgcgctgcagccagctttgcatgtgctcttcttgctccttggcgttgggcgtgggggttccgcggatttccggggctctggggtggtgtccaagctgaaggggtagtcaaagctggaccatgcaataaacccaccaggcagattccccagggcaccagtgagagaagaaaaccagaaacaaatagaacaaaaagaaagaaagaaaagtggaaaagccttttttgggggaaaacattgatgtttgatgtttctaaaaatgataatgtagttatcatgggaaaattagacttgttgggcttaaaactttttcttcttttacctgaagcagaacatgcataatgttcataaatattaagcacacaacctggctccatttttttttttttttttgaaatagagtcttactgtgttgccaggctggagtgcagtggtgtgatcttggctcgctgcaacctccgcttcctgggttcaagtgattctcctgcttcaacctcccgagtagctgggattacaggcgcccaccaccatgcccagctaatttttttgtatttttagtagagagggggtttcaccatgttggccaggatggtctcgatctcctgacctcgtgatccgccagccttggcctcccaaagtgctgggattacaggcgtgagccactgcgcccggccaacttcacgtttatacacacccatgcaaacagcatccagatagagacaaagagccttccctgtaccctaaaagtttcccagaaattgttcccagttagcatatttatttttataaaggtaatgcatgcccatcatataacattcaaaaaggtatgtagagaaccaagtgtctcccccagccctgtcctccagccacccagtttccctccctaggggaagccaccaatatgtgtttcttatgtatcccctgttgagctgcttttcctcgttttggtttggcggtgttgatgtttgtatttggaattacaggtaggcagcatcatataccttagtgtttagggcctctaagatcaaccagccctgagaaaatcagccatggtgaggaccttgtcccccagcccccaggagataggccccctggtgggagtgctggggcagggcagaggcctagggacaagaattagaaaggacccatgttgacagggctgctcagggtcatgttgtccatccctctgccacagtggcatggacaaactgcatatgttggttagaggagggcacccttctctcttgcaagcattggcaaggtcttaactattagtctcctgctcccatggcagcccctttggacaaggaggctcttaatctctgttctttgaagccctgagggctggtgtataggagttcaaagcactggctttggaaccggactgtctgggtttgaatcctggcactgcagctgactcactgatggactcaggcaatgccttaaactccctgagcctcaggttccttgtctgtaaaatgataaagatagcccctgtttcatagggctgtggtgagaaaccaatcagacaaggcatgtgaacgccattatagcacagcgcccggcatccagcaggactcactcgatgacagttgtcaccgccatcattgttattagcgtgggccagggagggctgcgtaaaagcagctggtggaggagggagagatgccgtgggaccgtctgggttcgcatgcgtgaagtattatctgggcctggagtgtgcaaggcacacatgtgtccttactgcatgtgttgtcacatatgtgcaatgccatgctcctgagcctttgattgcagacgtgtgggaagtgggccccgtccccacccccagtgccaccctgctctgcttctcttcccttgctgtgctctaaaacgagaagtacaagtgagttcccccaaggggtcggccgcgcctcttcctgtccccgccctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggatggtgaggtaagggcctgccacccacggtagacaggaggcaagggtgcctggtgcccacgggacccctcctcactgccctgcctgggccgcccaggtggtttcaccgagacctcagtgggctggatgcagagaccctgctcaagggccgaggtgtccacggtagcttcctggctcggcccagtcgcaagaaccagggtgacttctcgctctccgtcaggtaggtgggccccccgcaaccccgggcattttggccactctcttgtgccatccaggccctgaaccactcattcctggttccccgtggcagtgctgactccccgtctgttcccttgcccccaacccccacactccccatccctgtctgtgcccacccatgcccatgtgtgcccccacccaggacctcagccgatccctgccctcctgcctctactcctgcaccgactggcctcaccgcctggtgccctgcagggtgggggatcaggtgacccatattcggatccagaactcaggggatttctatgacctgtatggaggggagaagtttgcgactctgacagagctggtggagtactacactcagcagcagggtgtcctgcaggaccgcgacggcaccatcatccacctcaagtacccgctgaactgctccgatcccactagtgagaggtgagggctccgcacccccgccattcccaagcagggatgagccggctcccaccctgaacagccagggaggcagggagactggcagccggcgctgcctaccctccatcccctcccctccctgcaccggctggggctctcaatgtccctcctccctgctgtcctgggacctggtgtctcagagcctaacctaccaccctttccacctaaccccgaggaagccacagaaagctgcctcgccctactccgggagccctggccgctgcaacccaggtcccactggagacagggaggccactgctggtggccagcatgtcgtgcaggccagctctgttgttagaaagctcttcttcctctggaatcgagcctgccttcctccgtctgcccctcaccccagcacatgttaggacagtgaggagctgacactggggtgaagatggggatgaatgcttgccaagacacttgatgccttgtcccagccgccccgtggggatgggtctgtcctgtggggtcaaataggtctccggcccaaacagagatcattgagagcacgatgtgaagtgttcacctgtgtaaagtgtctcacgctgtcccgggcacagagtaatactccaggcatttccttcctgtggcctccccgactcctcctgtggtctcccaaaggcatgggctgggggctgggggctctgaatgctcctcatgacaccatggctcctttcagcagccgcatctcaatgccagatccccttagagtaaagggcagcggaataacgctagggggttttcacatgcacccctgggccaagccgacttgcccttgccgtggatccctgcattcatggatcggttattgaaatgatcgggaaccttgctcctgccagcttgcagcctctctgagattcgggcctccaaactgcatcaatatttttggtcaaggcactgattgaaacttagagctggattcggtcacggtgcagccctgtggcccacctgggaggcctcctttcctggatcggcctccttcaaggccttccctctctctgtgagcctcacgtggctggctccgtgtctgccccctgcccttcctcttccccaccgcaacactcagggggcttttggcaccgagaccctctaaagctcatgtcctctctttctccttgcctccagccaggagaggaggacgggctgaccagtgcctggaggtggaagagaggagcagggccccaggaggcccctgcagaggaggctgaggcctgggttcaaggagaagagagaagagagagaaggaagggagggcagtgccggggcgggaggttaagaccagggaagccgcactggaggcccttttgggtgacccgtcccaggagccagtgtcacccctgagcctgggagtgtgtgagaggctctttctcccaggttctgctgtgtcctctgccttgtctgtgcgcctcctcctctgcgagaatttgcatctgtccctcggtggctctgcgcttcctgtggtcagcctgacatttgcatggagacttcctcatcctggggcctgagggaaggggctcagccccctccccgctacctggggtcctagcctgtccccaggcggtgggctgaagtagcccagtggggttaggaggctctgggggtctctcggctggagtcacctccgggcaggggtgagatgggttgggacagactggtcctcccctccttccccccatccctgcggttggaaaatttgcccgccctcccctcgtccctgggctgaggaaacctcacaacctcacttctcactctctccccagaaggagttttgtgttttttccatcacgtggtttcctgtggggctgggctttgtggggctacagtttcctcctgggaaaggggtgtgcttcggggaaagggcttagttctgctttctgccctgacagccccttcaaatccgtttgaaccctgggctccccttcagtgacatcatccagggcaccccagaaccccctacaccactctttccccagtggggttgtcttccccgcctccctggcggagcgcaccccatccgccttccttgtgacttgagtctgtgtgtccatctcccaccactccctgtggtgtggcctcggtctgcgtttctctttgcctctggtctctgctggggcacagtcccatccttcacggagattcatccttagcttctctcctccaaatattttgaatattgccagcctttctgcctttcagaggtgggctctgggttcgaagcccggttagaactctggaggctaggatggcttgaacctgggaggtcgaggctgcagagagctgtaaccgcgccactgcactccagcctgggcaacagagctctggaagcttgccctagagtcagtcaagggccctaggccagtgagtaacagctcagcgtcagtttcctcatctataaaatgggggtaatatcatacctagctctcagcatgtttgtgagagacctaaatgaggtggtggatttggaagcatgtagcgcagtgcctggcacacagtaggtgcttgatttccggcccctctctgtgaatgtctctgctcagcgccttcccctgtggcctgggtcttaccttccctgacgctgccttctctaggtggtaccatggccacatgtctggcgggcaggcagagacgctgctgcaggccaagggcgagccctggacgtttcttgtgcgtgagagcctcagccagcctggagacttcgtgctttctgtgctcagtgaccagcccaaggctggcccaggctccccgctcagggtcacccacatcaaggtcatgtgcgaggtaaggcagccaggcggcgggggagcctctgctgaggctcctgtctgtgaccacagtgtgggtggcagggagggtctgcctgggcttgaattcaaggctggggacccagggagggagactcaagtcctgtgaatggcctaatttggctccccccagggtggacgctacacagtgggtggtttggagaccttcgacagcctcacggacctggtggagcatttcaagaagacggggattgaggaggcctcaggcgcctttgtctacctgcggcaggtcaggggtgggcccagctgcctccccacttcccctgagctgtcccccagatgtgagcttctgggatctctgagttgctgacttctcgctcttccccaccccagccgtactatgccacgagggtgaatgcggctgacattgagaaccgagtgttggaactgaacaagaagcaggagtccgaggatacagccaaggctggcttctgggaggagtttgaggtgcatggtggggaccggcagggctggggcagctgaggtggtggcagcggcctggggccccaggcggacaccttcccctccttgcccacctctgctcctgacccaccccacgtgagctcccccgatggatgccctctttgggagctgatgctcatttccccacccacatctcagagtttgcagaagcaggaggtgaagaacttgcaccagcgtctggaagggcagcggccagagaacaagggcaagaaccgctacaagaacattctcccctgtgagcacccaggctgccccattcacccaggataccgcccctgccccagctgcctcccctcatctcacaggtctccaccctccacgccaggaggggccatctccccacaccccccacagagcctcccccttctccaaaaggcctctactcctcccagaagtgcctccccaccaccagcaggcaggttgccccctgctcccaacctccttgtgaactccctcactccctccatacagatgatcccccacccctgctgcccacagtcccccgcaagcctcatggcttctgagaccagaatggcctgttagctcaggagggtctgacccaggtgtggtgagtccctggctaacccagaccatcttgcctcctctccgcccactcccagttgaccacagccgagtgatcctgcagggacgggacagtaacatccccgggtccgactacatcaatgccaactacatcaaggtcagcagtgtgggccacgtgagaggagaggctgggccctgggaattccctgtctggtggggggaccctagatccagagacagctgggcaaagccgaagctggcttcttgcatgggtgagggtggcagtggttcagggcctgtgctgggccaaggggctcactgtcttggggtgcgtctctccacgcttgcatccagaaccagctgctaggccctgatgagaacgctaagacctacatcgccagccagggctgtctggaggccacggtcaatgacttctggcagatggcgtggcaggagaacagccgtgtcatcgtcatgaccacccgagaggtggagaaaggccgggtagggcgcccccccttccccgcatccgcccccgtgcttgtggtcatgccattaagtcgaagagcagtcagatgccagggcagaaagggatctcaggggtgagggtccggcccttgttgggaaactgagggctagtgacaaagtctcgactacacaacgtgacccccagatccctgcatgcatccctgggctcttctgagctccagacccaggttccaggctgtcctccttcctcctacccctgccccacctgtctgcatccaggcccctcctgtcctccctgccccatagatctctctggagtctgccccttaccctgcaggctccccctacacagcaccctctgtgctgccattgaagtgatcccatccgtgacacaaactgggtcaagttccttcctttctgaaatctcttccatggctcctggtcacctttgggataaagtcgcactctaaggcctggcattcaaggtctggtggcttccctctgacccgcacgcttctcttgaaggctcaccgcccccagcagccccagctctttcaggttcccagcctttctttgcacaagctcattttctgctaggaaatgactctctccacactatctctgcctggcagatgcctcgtttttgaagacacagccggagcgctgcctcctctgtgaatccaggtcttgtttcctccaggacctagagggagaattacgtctttcccagccacgctcctcagcgcggtgtctcccccggtcacctgtctctgtgagctcctcgaggcacaggggcacagactgggtgttatttgtgtctgtgaagctgtgtggtttgcacagcttcggggacaatgcctgccctggcaacgtttgttgaatgacaaacggatgtaccggtgaagtggctggccaggcctcaccacctgttggtggttgatctgagacgagagcccaggtctcctgcctctctgccagcccatccgtccatccaacaaatgtttgggccggtgccaggcactcagaacatagagcaggacctgggatgggccacagtgccctgctctgtgcctcatccccacccgaccctccctttccagaacaaatgcgtcccatactggcccgaggtgggcatgcagcgtgcttatgggccctactctgtgaccaactgcggggagcatgacacaaccgaatacaaactccgtaccttacaggtctccccgctggacaatgtgagtggcccccacgccctgccccattccgggagtccctccctggacttgttctcctctctggtcgggtagggtgagatggatgaggtgttccgagagaggagggggcactgaccctatgtcctcggcttagggagacctgattcgggagatctggcattaccagtacctgagctggcccgaccatggggtccccagtgagcctgggggtgtcctcagcttcctggaccagatcaaccagcggcaggaaagtctgcctcacgcagggcccatcatcgtgcactgcaggtgaggatgataatcctgatggtagtagtgacagctgagaagtaaatactgctaagtgccatgagctgttataagcaatataaacgttagctcgcacattgagtgccctccgctcacccccggcttctcctgggtcccctcatggctccagaaccctgggtggatcgtggctggaaccagccccactttggccctctgcctgtgggtatcttcctcagagccctctccggatgtaccatctcgcccaaccctgccaaatacagaggaggagcccgggacccagttgctggccaggcccaagctagtcagggcaaggccaggcaggcacccacagtaggcctgtgtcccggctgctccgctttctctcgaggtcccattctgttggtttcttctcccaggaacatctatgaggcatgtgctccccattcctcctctttttccatcggtagccgcagggcttcggcttcttcctgactctgccctctctcccagcttccccaggcagtgccccatcctggcccccagggctgtgtggggatgggtgatgcttctttggggctgcacataactcctctgtctatctacccgcatgtttgtgatcaggagacctctggtaaggtgcagaggtgggggctgcaaggaggagcaggggttccacaggtgagcccactgagctggcctggcctgggtggatgagaggcagtgggtgcagggcccctccgcttaccagctgtgtggtcttggacaaattacttaacttttctaaccctcagcttcctcatctgtaaaatcaggatctcagggttgtcgtgagaactcaatgagaccctatcgttgtggctggaattccgtcagccctcaaaaactgggcgctgttactagtttagtaactcacatcaggcagagaataggggaatgggaacctgccttgccccggtcccttcccactccctccgtggaccccaggcctgcgacggcctctggcttcctcctcttcccccagcagctgtttgtcctgggacagggcaagtcggctgaatctagaggtgcccccgatgggctgtccggggacgcggctctgtcctgtgctctctcagggacaggcccatccccgagagctaccctcctgctcacccgccacacacacattcacacacttcttgaaagccccatggcctttatttagacgttacaggaaggaagtgggtgtggggggttatttttgacaatctgggtttgaaattagacagcgcgactcagggcatcagcttgctgggctcagctgagggtgggcctggggtctccctgaggtctgtttgcccagggctgggaaaggagagaaacttcctactgcactgctcccctgagtcccctgaccctgtgcccccgcaccctgctgtctcagggctatcctttccctgacgtcagggtttgaaggaaaagggaagtgaagccatgctgagagacgctccataactccttcagggagaggcggggagggctcagggtacctgggagccggcaggacagtggtgggatttgggggtcccaggtcttccggggtgggggcagccactcactaggagtgaggagtcggcgcgaggagtggaggagggaaggatggtggcagctggggagccagcgtcagcaccgcagagcccgaggtggagcgtgtccatgcagagctgggcaaacctccatcatcacttgcccggtgaccctgggcacattccctcccatcactggaggctcaggctgctcctgtggtgcctggggctggagctgagcgctgggtaccccccttcccggggagggcttgactggcctctgatggcacccccgtctttccccagcgccggcatcggccgcacaggcaccatcattgtcatcgacatgctcatggagaacatctccaccaagggtgaggggcacctgggggtttgggggtggggggtgagcagcccctcggtgtccgcctatgcctggacctgaggtttgactgccccccacccaggcctggactgtgacattgacatccagaagaccatccagatggtgcgggcgcagcgctcgggcatggtgcagacggaggcgcagtacaagttcatctacgtggccatcgcccagttcattgaaaccactaagaagaagctggaggtcctgcaggtgcgtgcagagcagggcctggcgggggggggggctgcagtgcaggatgggtgccacctggccctgctgggaccaccaccttcccactgtccctctgcccacagtcgcagaagggccaggagtcggagtacgggaacatcacctatcccccagccatgaagaatgcccatgccaaggcctcccgcacctcgtccaagtgagtggccctgactgccaccgcccggcatccacccctttgtcctgcccagcccaatcctcactttctggagaggacaagtgttgcagctggggggacctggcttcaagttcaggcttggttctcaccccttctgttcataagcatttcctgagtgcccacacgtgtgggcctctgctaggtaccagcagcgcactcgtgtatgagatgtagcctctgtcctctaggagcttggagtctagtgcagggaccgtggctgcgtcacctgtgagacggggtggccagaggggactgccagtgccgggtccccctgtgctgtctcctgacctgcaccaactgcctgtacttgcccccctgcacccggctgcagacacaaggaggatgtgtatgagaacctgcacactaagaacaagagggaggagaaagtgaagaagcagcggtcagcagacaaggagaagagcaagggttccctcaagaggaagtgagcggtgctgtcctcaggtggccatggtacagctcttctgcctgggtgtcctccctgccctgccctgtgtccttggctccactgccttccctgggtggatggggtggccgcagcctcattctgtgcttcccagctgccccagaccctcttgttccacctccaggttccagctaccctctcactccctcactcccttctcttggcagcctcagccctgaccctgtggaagcatttcgcgatggacagactcacaacctgaacctaggagtgccccattcttttgtaatttaaatggctgcatcccccccacctctccctgaccctgtatatagcccagccaggccccaggcagggccaacccttctcctcttgtaaataaagccctgggatcactgtgtgtcgcctctgagccctttgcttgcccagtgagtgggcggccagagggcagggcaggatgggtaactgtgtgtgcctccgtgcgtgcctcgcgtgaaagctccgccttccgtcagacggacgtgggtcgggactccgcctcgcacgtgggagggtgaccgtgggtgaagctccccagtctccttctttaaaatggagggcgatcataacagggtggttgtgaaaagcaccgagatgacggctgacgataagacgggcacagtgactcatcacacgcttgccatgtgcccaggcactaaaagactacacacgttagttcagtctaggcacttctgtcattctcattttaccgtggcggaaactgagggacagaaaaactaagtaacttggtcacttgcccaaggtcacagggctatggaacagtgaggctgggattcgaacccaggctgtctgaccccagagcccacactccttaccctggagttgcagctggggccaccctcaggggggccctgatcacactcccctgatgctgagttccagatctgaactaagaagagtagttaacagccggaagcgcagacctgaggccagcccggctgcgtcccctctggcgggaacagggacaggctcctcagagcacccgggcacgcccagctcctcccctcatccaggccgctgctgcccttatcctcttgggcagagtttgaagagctggctgacgtgaagagtgctttgttttttgtcccctcttccttcccccatgtcaggagtggggtttcttctttatttgaaacactggtgtcctggggagtaaagccggtgggagtcatccctcaggaagtgctggcgcccactcctggaaaggctgagacagcacaggtcccaaagcccagaggctgggcgtgcattactcagcaaatccttacagagcccccggcgtcacaggcattcacagtcccccgacctcctggaacttaggaggctggtcagggagacagattcacaaaccgatcacaagcatcaaataattgcaggcgggtattaagaaggaagcaaacaaagcctgggagagagaacagcgagggattgagcaacccaatagctccctggggctgtggccctccagggcacgggtggggcaatcacctgtcgggcccaggtcccctctcccagcaacgccctttctatacaagccgcagctgcacaaaggcaagtcccacctcctctaaccgcccttgggctacctgcccttggggtgggacttggactccactgagggctgtgctgtgaggtgggtccgggagcagctcggtccggagagtggagcgcgatcgttccctctgcaggcctcaatcgaggggcaaggctgatgctccgggccagctggggtctctgggtagcggtgggtaacttcacactagcgacaccttgctgggacccgcctgcccttcacaggcctggcggggccttctccctcccctttccctcaggggatcccagcacaggctgggcactgcggggcggcacagcccaactcctgcccagctgacccctcgctgacctcagggatctctctggcctgccagctccgctgtgggcagggtctgaggccacagaggaatgggctagtcctgggggcagcatctgctgtggggaggggacccaaggacagcccccgctttttgtacctctggagacaggggtgagactaggcaggttggagaaaagaggcccctgggagagggtgggaggcctagaggagtggccaagccttagaggaggtgcccgtggctggcgctgggagggaaggggttaaggcagtgggggggcagcctatggcaggaggacacacctgtgcgcagggtggcaggcggggcccaggtaaggagcctgcgctggctgcccggcaggcggagaaggaaggaggaagagcggaggccagggcgggctctaggccgtggaatctggggccttaaagccccttcgtctccccag

SEQ ID NO: 14232 - DNA, 25441 bp, Human
tatctgtaaagtgggtctactaatatctatttaataggggtattaagaagattaaaaacattgagatacataaagtgttttacacaacacctggattttagtaaacatcagttattattattagcattcttccaagatctgcacacaaagtgagttacggctaatcagttgataaactcctagcagagcagaaggttatgtgtgttgtgatgtttaagtggtactgggaaactctggttgccttgaggttctgaaattctactgtatcagatgggttcctttaaacattgctctctctagggggtcctctttttaaaagtatgcaccttctggagggcatctcttcatccttgtgtggtttagtttatcaggtattttcctcacgatggcagcctgagaacaggggacgcccaagggctgggatttgtgtgctccggaagaaaacggggtgtagaagtggggcctctgaaagagggcgaaaaggcaaggaaaaggagaaatgttgcacagtcttatggtctgtcccctgccattctgttcccctgaggtgtcagagcagcttctctgtcttcccagggatgagtttacacagacattccctgtggccccctgaggcctccacctctgaaatctgcagaacagccaggaaacaagcccggcccatggcgccacctgctgcctgcctgcctccgctcatgcaccctgggctgggatggtacttctgttcgtctggcattattgcccttggtcatttaccggcagccctgggcccctccttgctcttctccatgacactaggactcccttggtcttgaagctgggtgagattatcagggtttgtttctcaatgactttgaggtttgacagcagagcacactctttggcagatgagggggcttgaggcttagtcttattccgtgattaaaagcatttcttgtatgtttgtcctttcccagcctggagtggtgggaataaggccactatgttgacttagcggaaggaagggctgactcactgttcaccttccctgtacgttaccagctcgaggtctcaggatgcgttggaccctattttggtctccggaatttgtcatcatgcagtgctattttccccattatgcagaggtggagagggattaaggcgggggcgggcccctgtctccatggagacagtgacgctaccccgctaggggttatttggaagcggggcaggcctaggaggctgaagaaggcttcggactggactccccagcccctggtgttagggcttttctctttcttgggcttgggaacattagccagccccattttagaggggaaaactgaggctcagaaagggcactgaatccccttaggtcacaatgcgcccaagggaagaggcaggatcgactgagcctaggatctcgcgtcttcggctttcccccagagcctgggaagcccttcttagctccactcttctttgagctttccgtcaaacaaatcctagggcccgtggccttttcgagcgctcctaaaggcgactctccaagacccgctctctaaggtgctcttcccctttaagactcacggctcttcccgtcaggctgcgtcgcagtcttaaggccccgccttttcagacagcttccgctgggcctgggccgctgcggggcggtcacggcccctttaagcctgagccccgccccctggctccccgccccctcttctcccctcccccaagccagcacctggtgccccggcgggtcgtgcggcgcggcgctccgcggtgagcgcctgaccccgagggggcccggggccgcgtccctgggccctccccacccttgcggtggcctcgcgggtcccaggggcggggctggagcggcagcagggccggggagatgggcggtggggagcgcgggagggaccgggccgagccgggggaagggctccggtgacttaaggggagggaatgctcctctgccgtgctcaccgcgtgctggggctgcgcggggctaggtatggtcgggctgttttcccactgtcccttcttcgggcagtgtcgccgtccagcctggttgttgaagcgtccccgtggtcccccggggtccaggcccctttgtggaggcagctgctggcccccagcccatgggaccgtagtcgcggaggcctctgcagaggcgcaggctggaagcggtggcctttgaggggggcggcaggagagagtaccgacctccctcgaactcctggcagaggtgggggtcgcagcaaaagcactggggtggagggcggccagtgtggggcagacgcctgtgtgccttcctcagatacgggcagagttgtggatgtgagaagggtctggcttgggtacctcagttccaaacctcctgtgtccatcagagagctggcggtcaccatggcaatgcgggagctggtggaggccgaatgcgggggtgccaacccgctcatgaagctcgccgggcacttcacccaggacaaggcccttcggcaggagggattgaggcctggcccctggccccccggagccccggcctctgaggcagtgagtgttcttgaggtggaaagcccaggtgcagcctctgaggcagtgagtgttcttgaggtggaaagcccaggtggtggtggtctgaggtggaggggctgtttgcacatcttggtataactgctttctctattgtgttgcaaatcatagtagttaccacttactgagcgtttataaacactagaaaaccctgtgcacctttaaataaatgcaaccattttatagatgaagaagccgaggctcagatgcctatgggcttcatcaacccctgattttagaggaactgcgtcattgtacatctctgtctttctctcttaggcctccaagcctttgggagtagcttctgaagatgaggtaaatagaccagtctcttttctgtcccatttttctcttgcccactgtgtttttacctttaaacttagttcacccgtatttcaatttttgggctttcctgaccgaatgagaatgcctgcttgtttttaaatgtattttttcgtccttctaaatctatggaaagacagtttctctttatgtgtctccagtttctgtgttttcctttccttgtatctaacattgggatccccctccagtgggtcctgcctcttgctggggcctcccaagcctatgggttcatttcatcatttcccttctggcagttggtggctgaattcctgcaggaccagaatgcaccccttgtgtcccgtgcccctcagaccttcaagatggatgacctcctggctgagatgcagcagattgagcagtcaaacttccgccaggctccccagagaggtgagtccagagtctagtgggaggggagatcgttttccatgtagccagggccaaggaagggggttccattggatgctgctggcattggggacctgagatgcagaaggagacaaaagtaacagagtgttttcacgtggattcagggttctttaggcatgatggaatggtatgtatgtattctttcttagttttctctctctctcttttaagcccctggtgtggcagacttggccttgtctgagaactgggcccaggagtttcttgcagctggagatgctgtggatgtaactcaggattataatgagactgactggtcccaagaattcatctctgaagttacaggtgaaacttgttatgggaaaatctatattggcttctatgggacagaattctatacccttcccctgttcacgttatagtgtgattacgatttttctggtctcatgactcatttctagaggggtagggtactgaactcaatttcccttaggtgataacggaatgtaatgtatattaaagagaggactgggtttgtactggataagagattttggatagagagaacgaagagtttggttggcctttttactttatcactgtggtttagtggagaggatctacagattggatggatggcagtgttgccgaggaagagagtattcactacagcacctgggattctggccttaagttatttggaacagaattggggccttcagagtgttattgtgaagttccagtgcctgaagtgtatggctttagaaggtaaagaccataccatgatgatgataataaaaattaataacaatagttacgttctaggccttgtgttacatgctttgaatgcgttatctacttactctccatgagaaccctagaggtagttactgtttttagacctagtttaaagataagaaaattgaggcttagaggtgaagtgtgcccaaggttacacagctttgtcagtggtagagttgggatttgatcctggatttgaatgattcctgaccctgtggccttaactgtgatgctatactgtcaggcctgcaatttatcttctttcttgctttgctacagacttaaaggtttcagcctaatttttcctctttgaaagcatccattgctcctgcatcttttatgattgattcttcttgccctaagcctatctaatcaggtacatggtgggaagggcagtctcttcagctttcctcttcctgattgctctcaaaagttagcctttttcctgtttaagaaatcaagaataacaagagatacacatagagaaagttaccaagttccaggatctcggggagtcacatcatcatggttcctgaatttttctgagatgattaaagggactgaattggtttctacccccaccattttaatttatgttctttcttcgtttgctacagatttcaaggtctcaagtctaattttccttgagagcatccattgctcctcgcatcctttaggattgattcttcttacccgaagcctatctgatcagggacaaatgtgtgtgaaggaggcccatgtttaggatgggcttctccgcacacaagagaaaaatcccaaatctaaaaactaaaactcacctttaataagatctgtgggtctcttttatcacgtgtctctttcccacccataagttggagttaaggtagaacagtaggtgctcttggctttaagagtgctaatcactttatcttcttaagctcattagaacttcacagtaacagtaacacaaggtggatatcccacccccattttatagatgaggagactgagatttggaaaagttaaatactttgtgcaaaatcattgaataatagagatgatattcaaactcatgtctgtgtggctcttgagattcttttttttttttttttttgagacagggtcttgctctcacccagggtggagtgcagcggtgcaatctgtacgcactgcaacctctgcctcctggcttcaagggattctcccgtttcagcctcctgagtagctgggactacaggcgtgtgccaccatgcccggctaattttggtatttttagtagagacagggtttcaccatgttggccaggctggtcttgaactcctgaccttaagtaatccaccacagcctcccaaagtgctgggattacaagcgtgagccaccgcacgcgccctcacgttgagattctttgtgaaattgccgcaagttaaaatctgaaccatagcaaagaccctctccaagacagaaactcagtttttcacataaaccttagacttaagtgctatctcttatcacagagaggcttctgttgtaatgtgggcattagtcatttttgataattcagaaaaatcattgctactatgagcgttgagatggatgaaatttttgctgtaattacctgaattgcatgcagccattgaaatcttccttaacttgaaatgaaaaagaactttagaaaaacatgttttatctgtctcaccagttaaatgctcttagtagagctcttctagtattttgtagattcttttggaatcgtgcctgtttcacagaggcagagacatgcaaaccttagaatggaagttgagctgtttgaagtctgccttcataaaaatgtcttattgcagcagtatattgctttgcatgtagtaggcctctggtattgaatgaatgaattgagatctgggagaaaaagctaaaggaaaggagttcattttgtcgtaactgacttttttttattatccttcatttttaattacagcatttgtggttgatacaattgtatgggttagctatggctttatagataagtagattttgagatgaaagaaggttatactttttaagttcttattttaaaatctccactgttaagagtcaaaatcaagtttaaaaagaatgttgcagctcaattatttaaatttaaattttttatttggaagtacttagtttcactggaagttgaaaaaaaaaatgtataggaaggttctgtatacccttcacccagtctcctccagtggtaacattttacatagcagttatgcagagatcaaaaatcaagaagttgcccttgtttcaatcctcagagtttattaggtttcaccagttttacatgcccttatttgtgtgtgtgtgttttttgcaattttattaaatgtgtagatttgtgtaagcaccatcatgatcaagatacagaactattctctcaccacatgaagttcatttttttagcttaccttattttgtaatggaatccccccgtcttaaatcttctgggtcaaataattctccatcttgtgtttgctcagatctagagataaaacacatcgtcagggttcttaaatttagacagcttcggttgacatggtatgtgaggttcatatgataatcgtgagagataaacctgcactttcatgggaaaagccatggatagcagtagcagaagataattggcaacagatcttttctggatgttggaggagaggctttggaataacagtctcattgtgatgttttctgcttttgttataggtttgccatgagcagactaatgataatagctaacatttgttactgtattcattggttttcaccgcagcccctactgttatctctgctttaaagataaggacatggaaacttaagaaggttgagtaactagtctgaagatgcacagtgaataagtgatggagttaggatttaaatgtgggtagactgaccctacaacttgtattcttctccacagtgctgctatttagcagacacagaaactttcatgagtaagagtagcaagttctgagtttttgacttttgagcttggggaagatgtgcctagaaggaatgagtaaacaacgagaaattatatgaggtgcacattttgagtggggtatttggtgtctaggttattctcactctactaatctgtatgacctcaggcagtgcatcccctctgtagaccttagttgccttgatctcagatgtatccacatggatctgattttctgtaggaatttctcaaagattgtgaaggcagtgtgttactcttttgattctttcggttatttgactcttgttggagtaggttcccaatgccaagaaattctgggtcttgtggcgatttaatctggccaactaccaaattataggtatttgaggatagtttttctcagctctgggattttttttcttaaactgcctcatatctattgttaagtcctcatgtctgttgtaaaaattcaaaggtgctttgtgttttttctgtttttttttttttgtccttgagaggaccatttcataggaatttgaaatgttttctgtgaatttgaggagcacttatggccagaatatgcttttgcaaaatactctagttgagagttagaagtgtttggagagttgaggaggtagtagttatttttcaacagaatggagctaagaatttcaactaagaatggaactaaggaactaggagatcttaaagtctctttgagtattaagcatctcctttctgtctccacacttgaggcaacagtctaattggggcaaatggaagagaaatgcttcctgtaagagctagtgagcagaatctgtatttaatttttgagagtccttgaaattaacagatggatctatggtcaaaaaaaattgccaaccatatttcttattacattatacattatatattatataatattatattatacattttacattatatataatgtatatataatgtatttcttatgttataacgtatttcttattacattatgttatatataatgtatttcttattacatatgttacatataatgtatttattacattatatattatatataatgtaatatatgttatgtaataattatatatgtcatatataatttaattatatgtcatatttaattatatatgtcataatttatatatgtcatatataatttaattatatgtcatatataatttaattatatatgtcataatttatatatgtcatatataatttaattatatatgacatatataatgtaataattatgtgtcatacatatatgtgtcatatataatgtaataattatatgtgccatatataatgtaataattatgtgtcatatataatgtaataattacatcatatataatgtaataattatatatgtcacatataatgtaataattatatatgtcacatataatgtaataattatatatgtcacatataatgtaataattatatatgtcacataatgtaataattatatatgtcacatataatgtaataattatatatgtcacatataatgtaataattatatatgtcacatataatgtaataattatatatgtcacatataatgtaataattatatatgtcacatataatgtaataattatatatgtcacatataatgtaataattatatatgtcacatataatgtaataattatatatgtcacataatgtaataattatatatgtcacatataatgtaataattatatatgtcacatataatgtaataattatatatgtcacatataatgtaataattatatatgtcacatataatgtaataattatatgtcacatataatgtaataattatatgtcacatataatgtaataattatatatgtcacatataatgtaataattatatatgtcacatataatgtaattatatatgtcacatataatgtaattatatatgtcacatataatgtaattatatatgtcacatataatgtaattatatatgtcatataatgtaataatatatgtcatatataatgtaataattatatatgtcatatataatgtaattatatatgtcatatataatgtaattatatatgtcatatataatgtaataattatatatgtcatatgtaataattatatgtcatatataatgtaataattatatatgtcatatataatgtaataattatatatgtcatatataatgtaatcatatgtcatatacaatgtaataattatatatgtcatatacaatgtaataattatatatgtcatatacaatgtaatacttatatatatgtcatatacaatgtaatatatgtcatatacaatgtaattatgttatatataatgtaattatatatgttatatataatataataattatatatgttatatataatgtaataattatatgttatatataatgtaataattatatatgttatatataatataataagtagtaattacttattatttataattaggtgtattctgagagtcttgatcctttgtttttcacattttgacatttcatgctcagattttgagactactttgttgacattattcaggcaaagtctcagttaaaatggagtagaagtttttgtactttaataccgaaggggtagtaaaagcaagggtggtcagatcttgaaactggggacaaagactgctagtatcagctaatattttcacacccctgcccaaatgtccctctttaatgcaaattggagttagtaggttctcaacaagagagtggagttcccccttgggaactgtccttgtcatgggccaggagtggggaatagcaggggaaggtggtggcagactaactagtaagattagttctggacacagggcagaaggaaagaacaccgtaggcttgtgccttctctttgtttccttgttctttagtgcccgcagtcagtctccttgttttttttttctggccacaggatagtaaagggcaaagtcctggaggatgaaaaacagttcagcaccctcattgagtttgttgccttgataggtttattctgatgttgcagcagtcccctttgtcactagagcttctgagacagtttctagaattagactgaaaaaacatagctactcaaagataatcaaaagtgagaaaagtcagaatagtgtttacttctgggggctgggagactgagggagcctgtgagggaactgtaaacgttctgtatcttgatccgggtggtggttatgtgagtgtatcaaatgtggaagttaatttagctgtacacttaagtttggtagacattatatggtttcatatttgtatattacatttcaattaaaaaatgaaaaaacccaccaaacatccatagggaagagcagacctatgtatctttaattctagcctagcattccacttctctgattctcttggtaggcaaattacaatgaaataaggctcctttggccgggattgtgtgaactctgggtagagggagaacagaccagtgccttggttaaggaacaggagcccttctgtgctcccttcactccttactggctccctgctgtacttctgaggaaagtgaaagcccttccgcttcctatttcttattgaaatatcttgcacttcaagaaaaagagtttggttcttaatcctttcctgagattccttatttgatctcccgttcccaactctcagtaaatttctgccccaggctccttgagaatgggttggatattgaggatgttgaaaatttagtactatattcttttgaccaggggtttctgagggagtcagcagagttttgtctgctttggtgtggctaagagggtcagttgaatatgggcatctctttccctttccttgatcccacactgaatgaacctgtgtgatttccccacttctctgctccttgcagaccccttgtctgtgtcccctgcccgctgggctgaggaatatttggagcaatcagaggagaagctgtggctgggagaacctgagggaacagccaccgatcgctggtgagttcagatacctctttccgaatcccgtgaaaggagtatggacagttttcccagcctcctccatccacgttctcgaaccaacttactttattcttttttttttttttttttttatcattcttgggtgtttctcgcagagggggatttggcagggtcataggacaatagtggagggaaggtcagcacataagcaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtgaacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatcggatttctcaatcttttccccacctttcccccttttctattccacaaaaccgccattgtcatcatggcccgttctcaatgagctgttgggtacacctcccagacggggtggtggccaggcagaggggctcctcacttcccagtaggggcggccgggcagaggcgcccctcaccttctggacggggcggctggccgggcggggggctgacccccacctccctcccggacggggcggctggccgggcagggggctgacccccacctccctcccggacggggcggctggccgggcggggggctgacccccacctccctcctggacggggcggctggccgggcggggggctgaccccccgcctccctcccggacggggcggctggccaggcggggggctgacccgcacctccctcccggacggggcggctggccgggcggggggctgacccccccacctccctcccggatggggtggctgccgggcggagacgctcctcacttcccagacggggcagctgccgggcagagggtctcctcacttctcagacggggcggctgggcagagacgctcctcacctcccagatggggtcgcggccaggcagaggcgctcctcacatcccagacggggcggcggggcagaggcgctcctcacatctcagacgatgggtggtcgggcagaggcgctcctcacttcctcgatgggatggcggctgggaagaggcgctcctcacttcctagatgggatggcggccgggcagagacgctcctcactttccagactgggcagccaggcagaggggctcctcacatcccagacgatgggcggccaggcagagacgctcctcacttcccagatggggtggcggccaggcagaggctgcaatctcggcactttgggaggccaaggcaggcggctgggaggtggaggttgtagcgagccgagatcacgccactgcaccccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcatggaggcgcgtgcctgcaattgcaggcactcggcaggctgaagcaggagaatcaggcagggaggttgcagggagccgagatggcagcagtacagtccagcttcggctcggcatcagagggagaccgtggaaagagagggggagagagaccgtagggagagggagagagagagggagagggcttactttattctttaagatttccccttgggttattactcctgtgaatttatggttgaaatgtagtcaaggacacggtggttgtgtgcctgtactcaggaagctgaggtgggaggattgcttgggcccaggaggtcaagtctagcccgaggaacacagtaagaccttgtctttaaaaaaccaaaagcgcatgcatgtgtgcgtgcacacacacacacgcacacacatatatacacacatacacatatgtacacacgcatacacacacatacatgtgcacatacatgtatatacacacgtatacatatgtaaacatgtagatacatgcgtacacatgtatacacacacatagacatacatgtatacacacagatacacatgtatatacatacacacatacacgtatatatacatacatatcagctatatttgggaggaagggagttttcagacttttaaaatatatgtatataggtaaatatatatatatttttcaagaatcctaactatcctatatgacgttcataacttcatcttaaagttcataattttaccttgttcccttcttaattttgagcctgctactatcccatctgtatgcaaagatatgtttgggaaagggagagctagaaggatgtagctagtactttcacactcctgcccaaatgtccttctataatgcaaattggagtttgtaggttctcaacaggagaatggagttccctcacaggaactgtcattgtcatgggctaggagtggggagtagcatggggagggtgatggcagactaatgtgtaaaattagttcttacccgttccaggtatgatgaatatcatcctgaggaggatctgcagcacacggccagtgactttgtggccaaagtggatgaccccaaattggctaattctgaggtgagccacatccctctgctgctttgcccagcagagctggttttggaaggcaagaatcttgcttttcttaccccagtttagtttaaagagaaggagaagagatcttaggtctcttcgttcctgtctatagaacagagacttaagatcctgcctcttccttctagtgttcattccctcatctccttgcctactaactcttttttctgatgcctttgcaagtctttagagccagaaatccctttctttttgctctctacctcttttagggtctttagcatatcttgtctgcagctagagatggtcaggggaggggtgagtacagggtcctcttgggcatggttgagagtgcacacctggaagtcctttcccaagtggcctgtgtgtgtctctgtgccccagttcctgaaattcgtgcggcagattggcgaagggcaggtgtccctggagtccggtgcagggtcgggccgagctcaggcagaacagtgggcagcagagtttatacagcagcaggtaggacattgtcactttccagtcccacttcagagccagctgatgccccaggccatgggttcagtggtcagtggtcccagatggggaaggataagaccagcttgtcttgatagcatccaggtcccaagtgggtgggaaagagattctgagaatgattttctcagaagtacccaggttggtggtggttagtgggtatttagtgtgcgtctgatggatagaaagttggtggtagtggtactgaccatccttttttgtcgcagggtacatcagatgcctgggttgaccagttcacaagaccagtaaacacatctgcccttgatatggagtttgaacgagccaagtcagctatagaggtgagagcagatagtgcaggagcagacaccccaaaagaaaacactccttggagtgagtgggtgtatgaacatcaaagatgatgcaaattgtatttcatagtggacctggatcatctgtgtcagagttgcttggggatggggtgggtgctgttgaaaaatgcagatttctgggccaggcatggtggctcatgcctgtaatctcagcactttgggagcccgaggtgggtggatcacctgaggttaggagttcgagaccagtctgaacaacatggagaaaccccatgtctctactaaaaatacaaaattagcgtggtgtgttggcgcatgcctgtaatcccagctacttgggaggctgaggcaggagaaatgtttgaaactgggaggtggaggttgcaacgagatgagatcacgccattgcactctagcctgggcaacgagagtgaaactctgtctcaaacaaaaaactaaactaaactatgcactgcactgcactgcactgcactgcactgcactgcactacattacatttctggccatcaccccagactactaaatcagtatctggggatagcatctggccatttgcattttaaaaaacttattcagatgattcttaaacatattgaaattcaagaactgctgccttagagaatcccagcagagctgagtgtggggtggggtggtcatgatggatctcctttttctatctgctttcccttccttacagtctgatgtcgatttctgggacaagttgcaggcagagttggaggagatggcaaaacgggatgctgaggcccacccctggctttctgactatgatgaccttacgtcagctacctatgataaggtgaggtaaaaactcttagtttttcaggttccagaacttccttctttttaacgtctttcctttaatcctgaatttgaagggtgcttttaagtattttcttgagtccctttccacgaaaagaagtctgaataattcccttgcccttcctcttcagtgattgagtataaactttattcttgggatatagatgttaatgagactatctttgtcaataatgacagtccagtacataacacctgtgaaggaggtttgcacatgcttgctgcattaaaagcacagaggaagtagctctgcttggaggtcagattgggagctttttgagaagactgctaactcctttggtgggcagtgttagtggacagactatccctttgcctccacatcttaatatctgtttactttttaaactcacatattcattttaagttctttttataggtagtagccacttgccctaatttagggttttcaaagaatttatattagataacttaaatattagggaaatttcttagtagtatgaaagatgattgcattttgcctatagcatgtgctgttgacttagaagcatatgttacttctggggtcttactgaaaaacaaatctacctgtgggttgtaggatatttggggatgtgtttaataactgagctcctgagttgaaacatgaagaggggaaagaatcacttggttttgaaaaaaggcaaaacaggaactggggatgtgagtagtgatgtctttttctcagttcagatctggttgggaaagtattgtggggctggaaccagggcctgagatgcaaaccagggtgctggagatggatcttgatgtaataagggagctatgcaaagatgggaagatgcagttcagaaaaaggctagagtttgagagccagtgaagaacagtattaggaaaaatatgattttgcttattattccagtctgatctggatttttctaactatcctgtgtgatataagggaaaagacagctgggaccttgccatgtatttcactagactatgagttcattgtatataattttgataaggaagaactgaaggaaatatagataacacttttgttattattttgtattaacaatttgataagtcacataggccccatcaacttataaatggaaagttgtacatttatgtaaaaatgtccatgcttttcatacatatagacataatactagttttgtatgagcagcattttcttttatcatttattactctcgtatttatgacatgctggccagaatacatttttttttttcagacacatagaacaatgtgacaaattagaaagcaaatttttttttagaaaaaaaatcacatttgatcaggttccaagaatagaaatgtggaaaggatagtcttttcgataaatggtattggagaaactgcatatccatgtgcaaaagagtgaaactgaaccgttacctcacactatgtacaaaacttaatccaaaatggcttaaagacccaaatgcagtacccaaaaccgtaaaatgcctagaagaaaacatagggagaaagtttcttgacattagtctttgcaatgatttttgggatatgagcttttggtgtcacatccagaatacattttttaattaaaaactttaaaagtatgtttgtagattcttgagccctacttgatatcattgatactttgggatattgcaaaattaggactagaaatacttgcattaatgttcctcaaaaagtgatgtagtaagcaattagtatctggctttaagctaatattgaattccatgtcaatagaactttttaaaaacaaaggacttgactcttgattgttacataaattcatggatctctttgaatgcactgtttgtttattgatagcccttatattttcagagacaatttacattgcagctcaggcagatattaatatactattatgataaaagagaagtatgtgatgggacaaactctttgtagtgatcatttctgcagtttgatcctatgagattttggagcagaccagaccgtgtatcagataaaattaatgacttgggtttggcttttcaggatgtaacagtgaagccaagcttatcctgtgttctgtgggttgttgagggatcccccagagtactctttttccatcatctatgcaaatattctaattttggaaaattcctctttgatcagcaattgatgagacttcaaggagggtagataatatggatgagaggaaacttagagaatcctgtggttgcaagatggtggcattgagttgttgtattatctaatgaagacacctgaagagcattcgcatcacttctggctgtcatatacaggccatcatatcttaaggaagtatccagagcagtgaggataatagctatttacagatagtatcttaagctttttggtaaggcgttggtgaagattcccatttgatgttctcaatggctctgagaggcaggaattacttttattaggaaactgcattatagatgacagtaatctctgttttctgtagagtggcttaaaacacgtattaatgatgaacaatagttgaggttgaatgcagaaggatttattttattgaactgtaatagtctagggcaagggccagcaaactggcttgtgggataaatctttatgtttttagtgatccactagctgaggatggttttaacatttttaaatggttggagaaaatcaaaagagtaatactttgtgacaagtgaaaattatataaaattcaaattttagtgtccataaataaaatgttattggaagacagccgtgctcatttgtttacttatgtctggctgctttcgcactacaacagtagaggtgagtagttgcagcagatccacgaagcctgaaatatttattatctggcccttcgcagaaaaagtttgctgatcactggactagcgtcattttctgccttctgagtttttatattatgcagagatgtccaaaaacacacttgttttcaatataaatatactttctatacatttatctcaaatctactatgtctttcttcttaaaccccccattgtaattatttaattttcatttgtgacaaataatttgcatctgatcatgacttagaattttgctggtaagatttaagtgtttttgattctttatcattttcacaataatgaaaaagggcctcatgtctttattttgtacagttttatctgaatttattcttaactgcatttagaaagacctccacctggtgttttgcatcttgttttcgttctggtgtattattttatgatggtaactactctccaaaaacggactttttatttgcatgtcccaaattttgcagcttactagtgacttcccctttacctcatttcttctctgcctagtgtaaaatgccagttgacaaagctttgcagatagtatcgtaactcttctctaaagtgagaaatcctcagctggaagagaatggtgtctttctgaagtattctctgccatctggattttgggatccagcttttgcttactgtcagatacagattaatattcatgattattaagaatgaaatcggggaataaattaacattttcaaaatgcttgaaaatgttttatctagttgacatgtggaatgactctgagctaagtaagagttatatttgaatagcaggactccaaacaacatttcctttatacatcatcacattattgaaggataacaagaaatgcactttgcatagctagggacactttgtctcattactataagcagatcctgttgagacattctgccccgtggtgagaagtcaaggtgtgggaatacaagcctgtgatgacttcctaaaataagcttatttccagcgcagatgaatttgtagactttcctagcttcccaggtatcatgaacaggagatgggagcacaaacctgataccaaatgattttacttgtgtcatacatgatctttataatatggagaatttgccagcaattaattcaggaacctgtttggaggccctcagcttctctgcctgctggttgtcatcctcacatccctgctgttctgacggtgccacctctcagtccatctctcacgtgcttttcttgtaggggtaccagtttgaggaggagaaccccttgcgtgatcaccctcagccttttgaagaagggctgcggcgccttcaggagggggacctgccaaatgctgtgctgctttttgaggcagctgtgcagcaggatcctaagcacatggaagtgagtgactccatagtctcatttctggctagagactgcttcctccatcttgagaaaggccccaaggagagtagtgcagatgggttagggcctgggtgatggcctaggataggggcttgagagcgagatggtgagtgggagaagccagggggaagggcgaatggagaggtgaatatggggtgatggaatctgtcaacttccctctaggcttggcagtatctgggtaccacccaggcagagaatgaacaagaactattagccatcagtgcattgcggaggtgagtacactgaaaggtgtgggtgaggtgcttccaaggctctgcatataaccttttgaatgacagaagcccagacctggatccttgtcttctttctgagtgctatcaagagtgttttctcatgctgaaactctgagggttggagtgaattccattccttcatcggcttttgattttatttgcggctttggttggctccttgcctgctaaaaccttccccttagatctgtaactttattattaactcatgtcagaggagtcacaggtgaggccattgtgactctgcatttcaaagcttggcttggatcccagggtgctcacatgtgccagtgtcagtcattgcagatatcaagtctgcccatccctgatcaaacaggtgtctggagctaaagccagataaccagacagcactgatggcgctggctgtgagcttcaccaacgagtccctgcagcgacaggcctgtgaaaccctacgagactggctgcggtacacaccagcctatgcccatctggtgacacctgctgaagaaggggctggtggggcaggactgggccccagcaagcgtatcctgggatctctcttgtctgagtgagtatgaggggttcctaggatgaggaattacagtaacctaagtcccagtaggagggtgaccttggttttggaagtttggatggattgagactgaagggtcctgagaatgggatgggaaacctaggatcaagttgaaggaggtctgcattctacagttcagtgctaggatgaaatagaaaaacaggcttctatattggactttgagagtagaagagatgactgatagattgatgaatgttggggatatggttgatcaatgaagaaattaatttggggggatgggaatagagacattcatctacctactttgtgtttttttccttttcatccagctccctgtttcttgaagtgaaagagctcttcctggcagctgtgcggctggaccctacctccattgaccctgatgtgcagtgtggcttgggagtccttttcaacctgagtggggagtatgacaaggccgtggactgcttcacagctgccctcagcgttcgtcccaatgtgagcccaggggaggaatggaaatgggacatgactgtgtaccttattgaagagccatttgttgggaagctgggtttgatggtgcatgcctgtagtcccagctacttgggaggctgaagtgggaggatcacttgagcctgggagttcaaatccagcctgggcaacatagcaagaccctgcccacccccacaaaaaagaataatttgttcagacttttggagtcttggggtatttcattccagtgttccatgtactgactgccttgggaggactgggaaaagaaggctgggagtgtagggtcatctggacataagagagtctgcatagggtgagaggggctacattgtagccacacaccgaactgttgagaatggaatgggacgaaacatgttagctaacagagtagtgaaacagctggagtaatgtgcagagtttgagctgagtcggtggagtaatgtgcagagtttgatctgagtcggtggagtaatgtgcagagtttgagctgagtcaagctgttcccatccgttctgcatccctatcccaggactatttgctgtggaataagctaggcgccaccctggccaatggaaaccagagtgaagaagcagtagctgcgtaccgccgggccctcgagctccagcctggctatatccggtcccgctataacctgggcatcagctgcatcaacctcggggctcaccggtgagagtatctattgagaaatgaatgaatgagctttttctccctgcctttggccctagctccttattcttagatcctgtttgactaaccagccctagctttctccctcccactgctagctgacctgcttccttccattgttgttcagcttaacagctctcattcctcttcttccttacagggaggctgtggagcactttctggaggccctgaacatgcagaggaaaagccggggcccccggggtgaaggaggtgccatgtcggagaacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctgtattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtatgagttctgctggtcatgaagctgggatggcagaaggtgagttggcgtttggaggactgggattcaacagtttctgcctttcaaattctcactggtatattggttacctgctcatccctctaaaaatgatagagcacaggagacagggtccctgttctctgggcctctgggctagcaggagaaagagatgtcgataatcatgaatttttactcctgttactactacaaaggaaagtgtgcagtgccatataattgttaggttgttttgtattatgaattacatggaaggattttgatagtttttcagtgcttagggtttctaaagcttttcatctggctctgcctgcctttatcgggaactgtattaagtgccatatcaagatgggtatttatcctgaggaaaaatttaaaaatatacacaaatatttatacttggagatagatgtttgtgggcacattagacttggaaaaaaattttttttttttgtttttttttttaaggcagcgtttcactctttttgcccaggctggagtgcaatggcatgatctcagctcactgcagcctccgcctcctgggttcaagcgattctcctgcctcagcttcctaagtagatgagattacaggcatgtgccaccacgcccagctaattttgtatttttattagagacagggtttcatcatgttggtcaggctggtctcgaacgcccaacctcaggcaatccgcccacctcggcctcccaaagtgctgggattacagacgtgagccaccgtgcccagccaaaaaaaagtctaacttttaaatttatttaaaaagtttttcaaatagagactagatctcactatgttgaccaggctggtcttgaactcctggcctcaaggaatcctgcctcagcctcccaaagttctgggatcacagggaggagcaccatacctggccaaagtctaattttttttttccggtgagctcaaaagctgccagaaaaaaaaaaaaaaaaacccaaaaaacaaaaaaacaggtctaaaagacaactgggtaagtaaattgtccagacagtgaaatatagctattgctatttaatcatttatggaataatttccagtgacaatagatgctaacaatatagtgagaaaaatggttggtcaattatttacagattgtcttaagaaaaaaatgcattgaaaagacaatagggaactatcccaatgtgctaaaagtggggagatcatacttctctgtaattctcaaattttcttggtgcatgtttgatacttttctagaggagaaaattaaacacctgggggaggaaaacaggaagctgttgtggcacctgtcaccacctgggggatcacgaggcagctggtgtcttgggctctgcaggttggtggtgcaaagacccaggcgggaagtgggctgggcaggtggaggagcagtttccacactacataggtgcaggacatgacaaagtctggctgtgtaaatgacttaagaattaagctataaaatacctaggaatccaacttacaagggatgtgaaggacctcttcaaggagaactacaaaccagtgctcaaggaaataaaagaggatacaaacaaatggaagaacattccatgctcatgggtagaaagaatcaatattgtgaaaatggccatactgcccaaggtaatttacagattcaatgccatccccatcaagctaccaatgactttcttcacagaattggaaaaaactactttaaagtccatatggaaccaaaaaagagcccacatcaccaagtcaatcctaagccaaaagaacaaagctggaggcatcacactacctgacttcttcaaactatactacaaggctacagtaaccaaaacagcatggtactggtaccaaaacagagatatagatcaatggaacagaacagagccctcagaaataacaccgcatatctacaactatctgatctttgacaaacctga

SEQ ID NO: 14233 - DNA, 15739 bp, Human
ttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaagggaggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtcttcctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagacccccaaggggaaccctgatgctaatggcagttgggccttaggcagggcgcagggcagcgcagatgccccctcccctccagtgcagatgcctgctctggaccctgcctcattgtggccccttccccactccttcatcctcagcctcaccctcttgaggaccccaccctccagcccacaggtgctggaccatccctccctggtccctccgcccctctccaccttgggaccttgtgctgctcctatctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccactccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccgatttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccgtaacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttcctgatggggtccccagttaggagctgcctgctcagggctgggaggggaggagcactgagctgcagatagagggcagagcccacagtgggcagggcctgccctggtgtgtaggtgcctctgcaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagtgaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacagacacttctagtctgttttatttcatgtgtctgggagcggataaagtgtgaggttcagggagaaagagaggtctgtctcaatgccttggcacggcatgaagacaatctcccctccttgtcccctttccctgctagctcctgatgactgacagattcacagcagaacagaaaggactgggaagggatggaggtgggacatctggcactgaccttcaggggctgaccctgtgggggaacatctgccctgaagagttggagccttcatgtgatgacacagagctgaagtgtgatattcgggaggggatagagagtgcttggaggttttctgattttgaagaatcccagtcagtcaggttctggcgtaaagtgactgctggggaggtgtggactgaatgaatgaagaataaatgaaccaggaaagtggacatgcaagaggtgggttattcctcaccctatttcttgatgcctcctgactgctggtgttggggcacacagatgggtgatgcacttcttggtcaaggcaacctcagccccacccacgtaaggtggtcatggcagagagtgtaagggtgacacctgtgaaaaagacccaaggcagggatgggagcccttcttgcagcaggagtggatgcaggacctgcctggaagcaagagaaggacgagggaccctggctgggccctgtttcctcccactgcctggttcacaaagcaaccagtaagggagctggagtagggaattcactcatgtgctacttactgatccagagatgtgttcgttgacattttcttttatgttttcaggttgatgtcatttacacattcatgcatttatgttgtgtatttattagtcttgtttattttagttagcaagtgtcacttgttgaattctgttctcattaggtataaattttcatattcattgaagtttttataatcaaaatttaattgtccatgattttaaaagtcaaatatttgcataggatttctctagagaaatgagtcctctctgcatcttctcaatttctgccttcctagaggcaaccattttcaacatttttagctaagtctttcaactttta

SEQ ID NO: 14234 - DNA, 9781 bp, Human
tattcactattgttatcctcatccctagcacttagcacactgctttattatttatgcactgtaggaactaattgcttacataaaaatgagtacgttctggaaactagggccgaaatagggtaaggagtttattccagtgaggaagggtcactagcaagcaagcctgagaaaacggcgtggatggatccctacctgcctctccgccctggctcctgcctgtcactggaaacatcccgttcccacatggtcacttgaggtctctgggtgtctagccgcctctctgagacatcttgatggcctgggggttggaccaggggaatgtctgagagccaggtgggagccattcttggcagagttgaaaggggccgagcttgaaagtgggaggggggaatcagcccagtggaacctgaagaattacaaaaacaaagatggtcagtttcccaggcagagacaaccaccactccccttgtctggtcccactgacctgaaggtggaaacatctccacattatttgaaggctctagattctgtcttcagccatctatgttcccctggacaagaggagaaacaaagacactccaattcaattttcaggccaccttccaaagagaaagcccctacaataacaaagtcataatccttgaattatagccaggtccacccgatgcttagctcttttcctacttccccaaagtaggagataccccaaattcacttgcttgtctcaacctggttcctcatggaacccaagcaactaactatcaagtggagagaatttactgaaagagacagactgagaggggctctgaggctttactcatactttcaggattctgggcagtgcctttaccctcctccttaagtttctatggtccctgctgctcctggccagaggtgagaaaggaggtacacagtgcaggggtcttgagcgccatctccagagttctctccatggctcagcaaggcctgagggaagcccatccagacaccagcaggccatgactcttgggtccttccctgttaaagtgctggcccaaggcctggccccagctgaatgtggccacatgcagggctagaccctccccaagaccttgggaatccaggccgcctagatccccaggcagaaaagccagcgtcctgacatcttattcaaatctttcctgcggctgttctctcagcttctctctactatccccttagcttccatgcctgctgcccgcctcctctttctcgagtcctaacacatagtgggcacttgaagatcttcctcccaccctcccaccctcattaatctattttttacccgaatctgggatccctactcccgtccctttttacaacctaatctacctttttctgaaggaattattctggtcctgaccctcacccccatctctcaatagcctgccctcgccccctgtacgctagccggctctactctcccaccactgctcccctagatacccgaggcttcacccagttagcccgtgagctctaaggctgttctgatctcttcatctgtcccttcacctggcccctgtacccccttcccctttggaccccttgaaccctcccaggacccccgctcagccccttcccgcccccaaccgactcttcccgaacgtcccttaccaaccgcgagagccccctactgcgctttggccacaccccctacgcctcgctcccggccccgcctctgcccctgaccgcgcctgcgcaaggcgggcgccctaaagtcctatttcactctgttgggaggagggggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcgggtagatccgaaacggggctggggcggagtgggaaaaggccgggtatgccttgcatgatcgcggggagctccttcctgtttttatcccacctagagaagccgggaagtaggggtttaggtccaatttgttggagtacttaaggactcgtttgcactttcttttgggggatgacagtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccttgctgcctgcctcccatactcccatcagattggatggatagtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctccgtgacttgaggcagttagcctcagaaagcctagattcacatttgagttttgccactgcctcttggtaaagtcagctgtaggagtgttatggttattagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaattttttaaaaaaagcctgggcgcggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaacaaacaaaccaaaagcttgcccagggtcacataactggtaagtggtagagctaggatctgaacgagctggagctgggggagagtgagcatgtttgaaaactggaccttagggcggggcacggtggctcacgcctgtaatcccagcactttgggaggctgaggcgggcagatcaggaggtcaggagtatgagaccagcctggccaacatggtaaaaccctgtctctgctaaaaataaaaaaattagccagacgtggtggcacatgcctgtaatcccagctactcaggaggctgaggcaggagaattgcttgaacctgggaggcggagtgcagtgagctgagattgcactactgcactccagcttgggcaatagagcaaaactccatctcaaaaaaaaaaaaaagaaagaaaaaaaaagaagaaagaaagaaaattggaccttaggacagtgagggcagggatcctttgtaggaaagcacaagaaacacagacttgttcctagctgacaaggagtgtactgcctggtacctgtcacctgctgaggggcttaggatgtgagggagaatctgactacagtttcatattcttccccagaaatcatacagatttctccactcctgactctggtcatttctgtttttgtcctccatatttgcctggtgccccaccatcaacaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactgggtaagtggagtcctcacttggccctctcagtgttttactgcttttcgattccttgtatccctaggctgtgaggaggtccccctgcctggggggatgggcacgggaggtggaatagatggaatggcaagacctgggttagctctgataggaaaagaaaaatatgtgcaggagaacatgagaggtggggtggggcagtgcttataaaacaaccggagtgagcatgtcctgctttttacattcatatggctttaaccccattcttctagtgcctaaggatggggaactttcaggctcacactagaggtttttaggcccaccctatgtgtttttaaggacagagtccaggctcaccttagttctcagaccactgtgcctctgtggcctcaccctatgaccagccatagggtggcaaggtctaggccttctcctacaggtttccggtgacccttgtgtctgtgtcacttccttcagaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccagctctccctctgatgttgtgtgaccttaaggagtgtaaatggcaccttagtttcagggtcacttgggtatgagcattggatattcccatccccacctcagtaactgaaggacaaaccaagataagtgtgtctatctactgtgtcccaagcttctttatttaagaaaaaagtgatacatgatgtgggattaaaatcaagagcatcattgaacttcaccttccctccaaccagttgccccaaactcccctgcccccaccctttgtgttcccaattccttccttagtgaatgaagaacttaatcccaaaaaccctggcacaaactccaggttttctttccctagctcctcccctccccctgtcccccattcctagaagggcaggcacctcagtttgaatgcatgggagagcccagagtggtgacagagacagggggaaaggcttccccctcagggaaagggaccgaggagtacagtgcagtgaagtgagggctcccatagcctggggtaccaaaatggggccctggggccagaggaaaggacactggtccccctgagaaaggagacccagcagcctcaaaatcctctcgttgtgcatagtcgctgcttgatcgcttgcccttctggcgccggttacagaaccacactcggaccacctgccagtgaatgacagaaaggagaatgacattagacaatgagctgagagacgggcctgactctgcttggacattctatccaaagccaacagccctagagcagttagaggaggacattagagaatgagctgagacaggcctgactgcttggacattctgtccaaagccaacagccctagagcagttggaggagccagagctagggaaagcgaggtggtgacaggggaaagagatggagcccgcagagagacatggcactcacatccttctcgagcccaagctgctgggcgatgtggctgatctgctgcagtgtgggtttcgggcactgcaggaacaaattctccaggttgcctctcactcggttctcgatactggttcgctttctctttcgggcctgcacgagggtttctgctttgcatatctgtgcaggtgggaagggggtgacaagggcaagctttggacttgctgagtaacagcatcacaggggtctgtgactagatgtgtcagcagagccaggtggtggtgtgaaaaggcaggatcctggaagggttggctctggaccttatcccagcagaactgaggaatttcactccatcccactgagaaccactgcaccaaagacggagagctacgagccagtgatggaagcaatggaaattaggccaagaaagggaaggtccccgggtatccccctcccacccttacctcctgaagattttcattgttgtcagcttcctccacccacttctgcagcaagggccgcagcttacacatgttcttgaagctaagctgcagagcctcaaagcggcagatggtcgtttggctgaataccttccctgggggaggccagtcaaaagagaagcaaaatgagggagcacgcagggcccttgtgaccctgagatccaagcttaccacctcttcccagagggagctcaaagcccaagcatcttctccctctccctactcctcttcatgggtgagggtagagtctgcccctgcccctccccactaggttcagggatactccttagaggggagatgcggtcagaatctgcagaggggaacccaccaaatagaacccccagggtgagccccacatcggcctgtgtatatcccagggtgatcctcttctgcttcaggagcttggcaaattgctcgagttctttctgcagagctttgatgtcctgggactggattttaaaaggcagaagacttgtaagaacataaacacaccagttatcaatctcccctttccattcgggattcaagaacctacgtgtggccccaaggaatagtctgtagaagtgcatctgccttccaagctgcccacctaacttctagaaataacctacccacaaatgtcattcacccattccctgttcactgactcatgcatgtaacaaaggactactcttcccccagaaactggcacatccaagggatgcagagcat

SEQ ID NO: 14235 - DNA, 5934 bp, Human
aaactctcaaaaaaaaaaaaaaaaggtgaggctaggtgcggtggttcacacctgtaatcccagcactttgggaagccaaggtggacagatcacttgaggtctcctgaccagcctggccaacatggtgaaaccccatatctactaaaaatacaaaaattagccgggcatggtggtgggtgcctgtagtcccagctactcaggcggctgaggcagaatagcttgaacccagaaggcggagattgcagtgagccaagatcacgccacagcactccagcctgggcgatagaacgagattccgtcttggggggggagaaaaagggtgagagatcatttcacttggactaaaacaaagtcactatgtctgcaacaggatctacctagccaccagaccagctttgggctctggaaggcccacttcagggccttgccacattagactcttgtcctttgctcaaacaatcaccttctctgtctttaaaagtgtcaccctcctccataatctccttccctcctttaccctactcctatagactgctttattttttttttaatttttgagatggagtctcactctgtccctcaggctggagtgcagtggtgcgatcttggctcactgcaaactccacctcctaggttcaagcaattctcctgccccagcctcctgagtagctgggattataggggagcgccatgatgcccagctaatttttgtatttttagtagagacagagtctcactatgttgaccaggctagtcttgaactcctgacctcaagtgatctacccaccttggcctcccaaagtgaagggattacaggcatgaccactgcgcccggactgctttgcttttttccataatatatatatattttttaaatagaggcagcaggggtgggagaaggggcggcacgggtctcactatgttacccaggctgctttctaactcttgggctcaagcagtctgcccaccttggcctcccaaagtgctaggatttacagacatgagccactgtgcctggccattttttattttatttacttttttatttttcagagcaggagtggaagtttattattaaaaagttatagggcagggaaaaaaggaaagtgcacttggaagagatccaagtgggcaacttgaagaacaagtgccgaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgaggagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttctttttttttttctttgagacagagtcttgctctgtcacccaggctggagtgcagtggcgtgatctcagctcactgcaacctccgcctcccgggttcaagtgattctcctgcctcagcctcctgagtagctgggattacaggtgcgtgccaccgtgcccagctaatttttgtgtttttagtagagacggggtttcaccatgttggccatgctggtcttgaactcctgacctcgtgatctgcccacctcggcctcccaaagtgctggaattataggcatgagccaccgcgcccagcaaagaacttctaaccttcataacctgacaggtgttctcctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagatgcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttggtgggttcccctctgcagattctgaccgcatctcccctctaaggagtatccctgaacctagtggggaggggcaggggcagactctaccctcacccatgaagaggagtagggagagggagaagatgcttgggctttgagctccctctgggaagaggtggtaagcttggatctcagggtcacaagggccctgcgtgctccctcattttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggaggtaagggtgggagggggatacccggggaccttccctttcttggcctaatttccattgcttccatcactggctcgtagctctccgtctttggtgcagtggttctcagtgggatggagtgaaattcctcagttctgctgggataaggtccagagccaacccttccaggatcctgccttttcacaccaccacctggctctgctgacacatctagtcacagacccctgtgatgctgttactcagcaagtccaaagcttgcccttgtcacccccttcccacctgcacagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtgagtgccatgtctctctgcgggctccatctctttcccctgtcaccacctcgctttccctagctctggctcctccaactgctctagggctgttggctttggacagaatgtccaagcagtcaggcctgtctcagctcattctctaatgtcctcctctaactgctctagggctgttggctttggatagaatgtccaagcagagtcaggcccgtctctcagctcattgtctaatgtcattctcctttctgtcattcactggcaggtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctctgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcttgggacacagtagatagacacacttatcttggtttgtccttcagttactgaggtggggatgggaatatccaatgctcatacccaagtgaccctgaaactaaggtgccatttacactccttaaggtcacacaacatcagagggagagctgggattgcagccaagtttatttgtacagggccctgtgataggctagttcccaaaagcctgtgatgcaagaacttttgcccatagactcagtcaccatgtagctgttacctgttcagagctggctttttgctttcccaccctactctggaattcttaaatggctttatacttagaaatcatcttatttctgttgaacctagatcaccccaaccagaaacttctattaatactttgtgctttcttgataccagggtctatttggtttccacttaaggtttttgcatactctgcccataagtgactcattagttactcaagttttattcctggctctgccactagttcattaggggtctttgccccagagtcatttcttccatgtaaaaaaacttgggctcattaaatctaggtaggaaagggcggatgtggcaggttttaatagaacaggtcaagataaggctttatttctatagaaatgatgctttgacaatagtttggcttggtgtaaggctcacaaaagaaaatcacatgtaccatgtgtgggttaagcggtttgattcacactgaaccaggccagcccagttgccctctgctgtgtccacccgtggagtggagctgtgtcacagccatcacactggtaaactgctgtagctggtttaccaggctttctcttgccctgacagtacaggtgaagcctgtaaataaatcttctgctatctttgtgaacttaaccaaatcccagttaccttatttaaatggcaatagatctgttttcccttaaactagaaaccttaattacctgtattcctacctccagctcaacccatatatttgcacctttccagtaagcaggtttgtatttccatctctccccttcccctaagattctgaattagttctccagaccttgccaagcacattctccctggaaagcaaggaatatcacagacccacaagaagagtaaatgcccaggagtgaatgaagcggcttgtccttgacttggaaataaaagcaaagctgtgaaaagccaggtcgctacgattttgttggcagcaggactagccacagagtagggaagttttggggccaggccctaggttttcccagaatgccttgggtgatgccaccaagaaccttaagaactccctcttacattttccatcggttgcaggcatggcttttgcaactgataggtgctctgactacagatattctggtgtccatggcaacatggccttatggcttgtaatagtgggaacttccagctcactggcaatttcctggaggtggcaatatctttggcaggaaaccatctcttctgtcttggccaccagggtctgctccaggccctgaatgagtccacatcaatccatccttcttccctgtagtcattccctcttggggagggaagggaaggggggtatttatcagacctatttgctcgctgctgtgtctactcatgggcaggtgtgtccgatggtgccttggcggtggaccttaggtctgaatgccagcccggcaccctgggcatcggaagtcggcctccctggcagcctggatgctgcagccaacacaggccacatggaaccagacgtcacagccatcacactgaacccaggccactgtctcttcctggggcaggcagcaacaaggagctgcacagggctccccgcccccaactgcagggggagccatgggagcgctcactgggtacttccgaggacggccacgtcgatttctgaaggaagtgacacagacacaagggtcaccggaaacctgtaggagaaggcctagaccttgccaccctatggctggtcatagggtgaggccacagaggcacagtggtctgagaactaaggtgagcctgga

SEQ ID NO: 14236 - DNA, 19761 bp, Human
ctactatagtctaataaccataacactcctacagctgactttaccaagaggcagtggcaaaactcaaatgtgaatctaggctttctgaggctaactgcctcaagtcacggagaaagacatgcccagattattaaaaacattattcaacatagaactgccctaacccaggaacagagtgcctcagcaaagctggaaactgaatcaagtctaaacttggcctctagtggcctcagaacatccccactgtgatatctttctgatgatatcccaggtcctgtatgagctaaacgggaccaaaaagggtcagtctggcagagagcttctgactgtgcacacttctggtgggaagatgaaggtctggaccacgactatccatccaatctgatgggagtatgggaggcaggcagcaaggtcttgtggagaccttactcattccagcctggcgcttcaaccacccaggggcaaagctgccctgcttaatgctcaccttggctgctgtggtcttccaggctgaccctccagtcatcaccccggggctcggcatgcagttcggcgtggatcccagagatgaggccaggctcctgctggggccgcagggccacatcacacaggtcggccctgtggcccaagcgataggtgcagccagccccggcgggggggtggaaggtgtagagatcaccgcccctgccgccccctatgcgcagcagttggaagcagggcagcatgggcggtgccccctctgcaccacctcttccacttcaggcatccatttcctttcccactcctgggccacgcaccgctggcttaagttcgcttcccagtctgatgcaaacttgagttgtgctgtatgcggtttcaactttgagcacactacctgaatagcccaaattcagagtgcaagcagcctaggactcaatgcaaaattggttaagccgacttgcaaatgaaaaattccaggaaggtctccgtgcaatgcaaactcaggaacacgtcctatggcacctcacttgagctggatcctcagatcacaaaatatttggggagcctccaatctgcaaggcaaggatactttaggcagctcctgtgtgtgtcggggtggcggggcgcggggaaggaggtcctgttatacacacgtctacgtgcaatacgaacacatcacctctgtgtaattcggagaagagcagcttcttcctgtcaaacttgcttatcctaatagagcactcctgcttgcctgcgccccgatcttctggccaatccctcactcataactggttgaacctccgagggcaatgaatccactgtcatcccccaaaagaaagtgcaaacgagtccttaagtactccaacaaattggacctaaacccctacttcccggcttctctaggtgggataaaaacaggaaggagctccccgcgatcatgcaaggcatacccggccttttcccactccgccccagccccgtttcggatctacccgcgcggcgcagtctccgagtagcctcctcttcaagcagtgccagcctgtgcggcggatcccgggaccccttgggctcctcggcaggagccgacgttgctgcatctgtttgacagccaagaagccggggccaggaggggcgcggcctctgcgcgcgggcagcgcctacccctccttcggaattcccgggcccgaacttcgcgccgagcgagcccgcccccgtgccgttcccgattggccagctcatttgttctcttccgcgccattggacagcgccccaagatctcccgccttccactttttctgattagttcacaagttttcccgggttgccgcagtgaggaggagccgcctgggcgcggagatgctccgacgcatttagtgggcccaaatttagacgccactgcgcctgcgtacacctttccccctcctcccaacagagtgaaataggactttagggcgcccgccttgcgcaggcgcggtcaggggcagaggcggggccgggagcgaggcgtagggggtgtggccaaagcgcagtagggggctctcgcggttggtaagggacgttcgggaagagtcggttgggggcgggaaggggctgagcgggggtcctgggagggttcaaggggtccaaaggggaagggggtacaggggccaggtgaagggacagatgaagagatcagaacagccttagagctcacgggctaactgggtgaagcctcgggtatctaggggagcagtggtgggagagtagagccggctagcgtacagggggcgagggcaggctattgagagatgggggtgagggtcaggaccagaataattccttcagaaaaaggtagattaggttgtaaaaagggacgggagtagggatcccagattcgggtaaaaaatagattaatgagggtgggagggtgggaggaagatcttcaagtgcccactatgtgttaggactcgagaaagaggaggcgggcagcaggcatggaagctaaggggatagtagagagaagctgagagaacagccgcaggaaagatttgaataagatgtcaggacgctggcttttctgcctggggatctaggcggcctggattcccaaggtcttggggagggtctagccctgcatgtggccacattcagctggggccaggccttgggccagcactttaacagggaaggacccaagagtcatggcctgctggtgtctggatgggcttccctcaggccttgctgagccatggagagaactctggagatggcgctcaagacccctgcactgtgtacctcctttctcacctctggccaggagcagcagggaccatagaaacttaaggaggagggtaaaggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggacctggctataattcaaggattatgactttgttattgtaggggctttctctttggaaggtggcctgaaaattgaattggagtgtctttgtttctcctcttgtccaggggaacatagatggctgaagacagaatctagagccttcaaataatgtggagatgtttccaccttcaggtcagtgggaccagacaaggggagtggtggttgtctctgcctgggaaactgaccatctttgtttttgtaattcttcaggttccactgggctgattcccccctcccactttcaagctcggcccctttcaactctgccaagaatggctcccacctggctctcagacattcccctggtccaacccccaggccatcaagatgtctcagagaggcggctagacacccagagacctcaagtgaccatgtgggaacgggatgtttccagtgacaggcaggagccagggcggagaggcaggtagggatccatccacgccgttttctcaggcttgcttgctagtgacccttcctcactggaataaactccttaccctatttcggccctagtttccagaacgtactcatttttatgtaagcaattagttcctacagtgcataaataataaagcagtgtgctaagtgctagggatgaggataacaatagtgaataagacaaatcctgacttaaatttgtaattaataaggaatctaaaatcctaagaggggagatagattgaccaccagctgatggtaaagcatggtatgaggcaagatgaagaagtgcaaactagaggtagagacccagcactgtggcagtgtgggttcattctgatggaagaaagcctttacagaggacatgctgtgggagctggccatgctgtcgtattatctgtaaacattcttattcttgtttcatgtgtcttttcccagatgtactgggatatcattctgccattttgctccagaataggattacattagaagaagcagcatgatgaagaaggaatactagactgggtgtcaggagacagagactctatttctagtttggctaccagctagaggacatttggcaagtcacttaatttccctagcctacagatcgctgctactaaagaaagaaagaaagagcgagccagatatggcggctcacacctataatcctagcactttgggagctgaggcaggaggatcacttgagcccaggagttcatgaccagcgtgggcaacaaagcgagactccgtctccacagaaaataattagctggctgtggtggcatgcatttgtagtcctagctactcaggaggctaaggtggtaggaccccttgagctcagaagttgaagactgcagtgacctatgatccagccactgcattgaggcctgggtgacacagtgataccctgtctctaaaaacgacaacaacaacaatctcttatagtcctgggtctcagagagctgcctcaggagccatgttccaagctggattaaacttcacgtgacattggtagacgatttctctaaaggctggcactgtgttatttatgtactgttctctcagactcctcataaagtatacctaacactcaataaatgcctttttttttttttttttttttgagatggagtctcactctgtcgcccaggctggagtgcactggggagatcttggctcactgcaagctccgcctcccaggttgacgccattctcctgcctcagcctcccaagcagctgggactacaggcacctgccaccacgcccagctagttttttatatttttagtagagatggggtttcaccgtgttaaccaggatgatctcgatctcctgacctcgtgatccgcccgcctcggcctcccaaagtgctgggattacaggcatgagccaccgcgcccagccaataaatgccttttaactagcacctggcctcaccatattgatactggaagcttacgacctctctatgcccattcctccctcaaacttcttgcccttaaattagaattgagaagtccctgtgtgttcttccaacctttccacttaaaatgtgtggcctaaaaataaaaaaataaataagacaaaaaaaccaccaaaaaacaaaaagaatgtgtggcctaatgatatacacatttgatgttgaatcctcctgtatgtagctctctctagggagatcatgttccacgatctcagccagactttaggtcctgtgagtccaggcactggactcaacatgctcaatagggctttgatgaatgatgatgatgtcaatgcagacatccccataccccagcttcagcacccccttcacctccccacacggaagcagaggggtcctcttttccttctcctggctatgtttatgccctcaactatccttccagcactggagacaagtctcacctgcactaacctgtctttgaaggtcctgggggctggaggggtcacaggccctgagccagcaggctgaggtgatcgttcggcagctgcaagagctgcggcggctggaggaggaggtccggctcctgcgggagacctcgctgcagcagaagatgaggctagaggcccaggccatggagctagaggctctggcacgggcggagaaggccggccgagctgaggctgagggcctgcgtgctgctttggctggggctgaggttgtccggaagaacttggaagaggggaggcagcgggagctggaagaggttcagaggctgcaccaagagcaggtgaatgcaggggtagaaaggattcaaattcataacggagagctgggcagtagcttccaagcaaagaacaggtattgcagaaaagaccctccatgagtagtgagtagtagagtgatgagacctttggtgaaaataaacacacatgggctagaaagatggagaatttgggtacttttatcttaattcaggttgcacttttcccccaagactcaggtggcctcccaccacttgaagccctgcttccctttctagtaggaaatagtttgcctccctactttactccaggtaccaattcatcaggggtattgtggagggcagtgaggaaggtgggtataagggggctatggtggactgggagagagagattattcagtcctcaaactcagtacttactctgccatctctaagactcagtgaccaaattagcctgagtcctgccttcgtggatggaactgacagcctcgtgggggatatacacatccacatttaatttaatcataattaattgcaatcaggaggaatgccttgaaggagaaggactagaaagcactaacttagtctggggttcagggaaggccactgtaaccagttgacatgtcaaggaaagaaaccatagccctgggcgcagtggctcacgcctgtaatcccagcattttgggaggccgaagcaggcagatcacaaggtcaggagttcaagaccagcctggccaacatggcgaaaccctgtctctactaaaaatacaaaaattcaccaggcatggtggtgcgcacctgtaatcccagctacttgggaggccgaggcaggagaatcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataaaggaaaaaattgatccattgactttataacatgaacattaggaatagccaaaaagaaaaaaaaaagctatatttatagctcagatcacaagaaaagggtaatatccctaatataaaatgtgtgcctagaaattggtaagggaaagaccagcaatccaatcagaaaatggacaaaggagatttatgaaagaaacttagaaacaagaagctaggccaggcacagtggctcatgcctgtaatcccagcactttgggaggccgaggtgggcggatcacttgaggccaggagttaaagaccaacctggccaacatgaagaactctacaaaaaaatacaaaaattagccgggtatagtcgtgggcgcctgtaatcccccagcttcttgggaggctgaggcaggagaattgcttgaacctgggagacagaggttacagtgagctgacatcacactccagcctgggcagcagagcgagactaaaaaaacaacaagctaccgtttgtgctgaataggagttggccagtgaagaggcgtgtgaagtccagtggtagctggaagacacttggtgggacaacaggtgaaggcggggacaggaggccagaaggctggggcacagagatgaggggcactgagtgtgctgcagagcccaggacccagggcacaaggctttggccacttcagaacttgctactttcccataagagcaatgagcaggctgggcacagtggctcatacctgtaatcctagcactttgggaggccaaggtggaaggatcatttgagcccaggagtttgagaccagcctgggcaacaaagcgagacccccatctctattttatggaagaaattagggctgggcatggttgctcacatgtgtaatcctagcactttgggaagctgaggcgggtggatcacttgaggtcaggagttcgagaccagcctggccaacatggtaaaacctcatctctactaaaaatacaaaaattagctgggcgtggtggctcatgcctgtaatctcagctactcgggagggtgaggcaggagaatcgcttgaacctgggaggcagcgtttgcagtgagctgagatcgtgccattgcactccagtctaggcaacaaagtgaaactccatctccaaaaaaacaaacaaaaaaaaattgttttttcaagtaataagcaaccgttgaaaggttgtttttttttttttttgagatggagtctcgctctgtcgcccaggctggagtgcagtggcgcgatcttggctcactgcaagctccgcctcccgggttcatgtcattcttccgagtagctgggactacaggcgcccgccaccacgcccagctaattttttgtattttaatagagacggggtttcaccgtgttagccaggatgatctcaatctcctgaccttgtgatccacccacctcggcctcccaaagtgctggaattacaggaatgagccactgcgcccggcctgttgaaaggttttaagcagggaaataacatgattagatttgtattttatgtctaaaaaattttgtcatttatgtcccccaaattaattttattgttgtatggagacagggctagaggaggcagaccaggaagcagggtgggcactttgccctcctttccagtccatcccatgactcttggtggctctgacacccctgcaaccctttgaggtgccatgagcaaaagacacaaaattcctcctttcctggagctttccttccagtgtggtccgacagatagtaacacatacacataagcaagatatggtcagtgctaagtgctcaggaggacgtgaacagctgatggggcagagtagggtggggagggacggtattagagggcccagtgaagccaccctgaggaggggctattgcctggggtctgtggagcaaggaggggccgctgtctggttctcagcagactccccgtggccggagcggggagcagtgggagagcctccagggtgagctcaggaggtaggcagaggccgggtcccctggcctgcaggtgtggagagacacctgggttttgttgtgaatgctgtgagaagccactgagggtttgtaaagactagttaggagatggtcgctgttgcccaggcaaaagatgagggttggtggcagtggagacggagacagagaggtgaagatatgttttgggggagatcggacaagaactcctgatgggttgtggggcagctgcggagagtgagttgccagctctccatttgctgtgcacagttggctgattggttgggtcattctctaaggtcacagaaagtgggagtgaagggaacaaggaaggcctccgtgtggggtcgagcctctgctgagccccctcttctttccgcagctgtcctctttgacacaggctcacgaggaggctctttccagtttgaccagcaaggctgagggcttggagaagtctctgagtagtctggaaaccagaagagcaggggaagccaaggagctggccgaggctcagagggaggccgagctgcttcggaagcagctgaggtaggtgggcggacgccgacgggagcccagcaattagtgatgtggtggatctgcagggcgccccactgatggctgtcccattcccaccccaaccctagcaagacccaggaagacttggaggctcaggtgaccctggttgagaatctaagaaaatatgttggggaacaagtcccttctgaggtccacagccagacatgggaactggagcgacagaagcttctggaaaccatgcaggtgagggtgcaggaatgtatctgtgtgcagacttagggatcaggttgggaggcaagcgtggcccttggaggagcgtgtagagcacagcctccgggagagaaggtggtacctaaggcggcatggaggccctacagaggggctgctttcctctgcccgcagcacttgcaggaggaccgggacagcctgcatgccaccgcggagctgctgcaggtgcgggtgcagagcctcacacacatcctcgccctgcaggaggaggagctgaccaggaaggtacagcccaacccccagacccctcaccctcagccgcatcctgcatctactgtcccctgcctccctccctgtgggcaggaggggtcaatgtgccccagaacctgcttagatctccttcctgtgaactcctcttgctgtagctcatgttgcccaggcaggacagaggagaaacaaagatgccacctccttcctctcctcccccaggagcccacgcttttctcccactccttctccctcaggttcaaccttcagattccctggagcctgagtttaccaggaagtgccagtccctgctgaaccgctggcgggagaaggtgtttgccctcatggtgcagctaaaggcccaggagctggaacacagtgactctgttaagcagctgaagggacaggtcactgcactctcttttctcccggtattccctcccagcaccttgctccttccatgaaggtggcatccattcaaccagtgtttattgagtggttgccacatgctgggcacacagccctgaacaaaactaaaatgtggagcttgcattctagaacagagacacagaacacgcaagtaaacagataatgttgggtaattatatgtgcgatagaaagattgaagccgggtgcagtggctcacacctataatgcgatcactttggtctcgaactcctgacctcaggtgattcacctgcctcagcctcccaaagtgatgggattacaggtgtgagccaccgtgcccagtcaagtaatgccaacagtttgggagaccgaggcaggtggatcactggaggtcaggagttcgagaccagcctgggcaacatgtgaaatcccgtctctactaaaaatacaaaaaattagccgggcatagtggctcattcctgtagtcccagctactctggaggatgaggtgggaggatcacctgaggctgggaggtcgaggcgaggccacagtgaactgtgatcccatcactgcactctagcctgggtgacaaagcgagatcttttctcaaaaaaaaagaaagtagtaagaaaaattcaaaagataatgtgacggagagactgtggggtgagtcagcctcaggtaggatgctcagagacagcctctctgaggaggtgacagcatctgaggagagtggcatggtcagttggtgggtcttgtggggtgtgtcaagggctattcccatcttcgagtgggcacatggaatgtggaacatggaacactgggctcagattccatcctcagaacctaagcttctgtctccctgcgtggcattcattctttttcttttcttttctttttttttttttttttgagaaggagtcttgttcttgtcacccaggctggagtgcagtggcctgatctcagctcactgcaacctccgcctcccaggttcaagtgattctcctgcctcagcctcccgagtagctgggattacaggcacatgccatcacgctcagctaatttttgtatttttagtagagacaggctttcaccatgttggccaggctgatcttgaacccctgacctcaagtgatccatctgcctcggcctcccaaagtgctgggattacaggtgtgagccaccgtgctgcgacccacccccgtcgcccgccctccctccccccagcccctgcatggcattcttacagagatctctgcacctgccactttgcttccagtgcccccctcatcttttagctctagagggccctgcccagctctctctcctcccccaggtggcctcactccaggaaaaagtgacatcccagagccaggagcaggccatcctgcagcgatccctgcaggacaaagccgcagaggtggaggtggagcgtatgggtgccaaggttggtgtcagcctactagagactcggggagggcaagggagcccctgttccggggctgcagccaggacttagggagggaccctgtcctttgctgcatcctccccagggcctgcagttggagctgagccgtgctcaggaggccaggcgttggtggcagcagcagacagcctcagccgaggagcagctgaggcttgtggtcaatgctgtcagcaggtatcagggatggaggggtgggtggagtagtgtttctgctacctcaggttcctgggcaccttgttgctgaggatcctcaggcaagaggggctggaaagtggccactggaggctacagggctgggcagatttagctctatcaatgttcctgtgttcgtttcttttcctggggaagccccttctgcattcatacctgattgcttgttatgaatttcccgttgcatgtttggctggaggtgaggccttgcttcctcctgcagttcagtctagtaatggcttgagctaaatagagcacccgggaggatcttcacttgcagtattgttcaaggatggagagtgtagacacttcatcttcctttttttttctaaaattttacgggcaatccgtttcactggagaaaaatttagtctatttatttatttattttgagacaaagtctcgctctgtcacccaggctggagtgcaatggcgcaatcttggctcactgcaacctcacctccctggttcaagtgattctcctgcctcagcctcccgagtagctggattacaggcatcctccaccagtgtcctccactacgcccggctaatttttgcatttttagtagggacggggtttcaccatgttggccaggctggtcttgaactcctgacctcaggtgatccacccacctcagcctcccaaagtgctggaattataggtgtgagccactgcacctggcctagtctatttatttaaagctgtatacttacttgcttattatatacttaacttgcttactattccatctaaaatgtaagccagttagtttccttctaaatcaattgccagcctttgtctctcctaccaacttcctagttgtttcattacctacaattgttgtatgaccttcagaaaaacctctaagaaaacagcaaagcttctttgtgctggtgatgacttcccctcagccttagacactgaggtacccaaggcaggtagttctttttttttttttttgagacagagtctcgcactgtcacccaggctggagtgcaatggcacgatctcagctcactgcaacctctgcctcccgggttcacacgattttcctgcctcagcctcctgagtagctgggattacaggtgcacaccaccacacccggctacttttttgtatttttagtagagacagggtttcactgtgttggccaggctggtctcaaacttctgacctcgtgatccgcccgcctcggcctcccaaagtgctgggattacaggcttgagccaccgtgcccggccggcaggtagttcttagcacagtctctggcttgtaaatgttgattgttatcgtgaggctcttcttgatgggttaatttagataaagataatttttggtttagcgaaattaagatgcaggatgagtccttgcccaccacttccttctcttgggtttgtaccttagggactaatttagctttaaaaattatgaaaaatttcaaacttgcacggaattaaactagttataatgacctaccacccaggttcaatccatcgcgggtgccccctacctccaggagaacagaaagatgcactgtggacagggtttgactttggtaccaggtgatcacagaaatggtctgtgtaatgatgcatttgccgaaagtcctccaggcttaaagcagtccaaactctgattgttgctgggtttattagattgtctctaggtaattggagactttaataagagctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccaggttggtcctacttctggcacagccagctggtaaagcatgtggacctgcccgtcactggtgctagatcgacactcctgggcttggagaggataactttgttttcttttgtttttttgagatggagtctcgctctgtcacccagtcttgagggcaggggtgcgatcttggctcactggaacctccacctcctaggttcaagtgattctcgtgcctcagcctctggagtagctgggattacaggcatgagccaccatgcccggctaatttttgtgtttttaagtagagagagtttcaccgtgttggccaggctagtctccaattcctgacttcaggtgatccgcccgcctcggcctcccaaagtgctgggattacaggcaggagccactgcccctgaccagagaggataactttactctttgatacacgatagtgagcaaaacacagttgtgagaaataagcttaacaggttgcttaaaaagatagtcatttaatgcattcttggggcaagggtcctttagataattgacggaagctgtgcgttctgtacttgtataatgggacaggattagagggagttgtctatacaaggcacagcaagtcctttgggaatgaggggaggcatggaggatcagtgacttgtgccctctccagctctcagatctggctcgagaccaccatggctaaggtggaaggggctgccgcccagcttcccagcctcaacaaccgactcagctatgctgtccgcaaggtccacaccattcggggtgcgtaggacaactgcgagccacgtcctgcccccaccccaccagctcggactttcttcttcctgacccagctctctctgatcccacatccattcaccttcctcctttcaccagtccttgcatctctttttcccttactccctgtccccactttctcccatgcaaacttcatctctttttctccctgctttttccctcccaggcctgattgctcgaaagcttgcccttgctcagctgcgccaggagaggtgaagtttgggcactttgaggtggatggggctttagggcattggctgctgggacccccaaaaccatgaggactgaggtgggatgggggctttgggatcaggcagctgggtgatttctcctgactctttctcttccccgtctcagctgtcccctaccaccaccggtcacagatgtgagccttgagttgcagcagctgcgggaagaacggaaccgcctggatgcagaactgcagctgagtgcccgcctcatccagcaggaggtgggccgggctcgggagcaaggtacacctggttgccagagggtggagaggatgaggaaaaacccagtgtctagggtgctgggagaggcctgacccagcaccccctccttttaggggaggcagagcggcagcagctgagcaaggtggcccagcagctggagcaggagctgcagcagacccaggagtccctggctagcttggggctgcagctggaggtagcacgccagtgccagcaggagagcacagaggaggctgccagtctgcggcaggagctgacccagcagcaggaactctacgggcaaggtgtcgagagggaaatgggtgcttcccttggagggtggggtgggaactgcgaatcaaagctcctgctgatatgccccgtctgcactttcaccccagccctgcaagaaaaggtggctgaagtggaaactcggctgcgggagcaactctcagacacagagaggaggctgaacgaggctcggagggagcatgccaaggccggtgagccttgccagggtggatagggccttccaggaagaaggaagtgttaagacataaggttattattttcccctcaaagtgtgttcaaagcttcattacaggaagtaatgaaggtatccaggagtagcacagatgaattatcacatcgtgaacacacccatgtagccagcaccagattaagaaacagcatatggccggtcgcggtggcttatgcctgtaatccaagcactttgggaggccgaggtgggtgtatcacctgaggtcaggagtttgaggccagcctggacaacatggcgaaaccctgtctcgactaaaaatacaaaaattagctaggcctggtggtgggcacctgtaccccaagcttacttgtgaggctgatgtgggaagactacatgaacccgggaggtcgaggctgcagtgagccaagattgtgccactgcactcaagcctgggtgatagagaaagaccatgtgtcaaaaaaagaattgtgtaatgaatgtatcttctctaactaaatatagcagttaacatttgccacatttggtctcttatctatatacacacatatttgtacatcttttgaatcactttaagttgtaatcatttaatgttttgttgttgttgttgtttgagacagagtcttcctctgtcaccagctggagtgcagtggcatgatcttggctcactgtgacctctgcctcccgggttcaagccattctcctggctcagcctcccaagtagctgggattacaggcgcccaccaccatgcccagctagtttttgtattttcagtagagacgggattacaccatgttggccaggatggtctcgagctcctgacctcgtgatccgcccgccttggcatcccaaagtgctgggattataggcgtgagccaccacgcctaagtaagttgtaaacataagttgttcagccgcatctcccaaagccagtaaattctcctatatagctgcaatcatcacactttaagacagtgaacactaattgcacaaaatctaacccagttcatgttcagatttcccctgaggaactccaggatggttcagggatgaggaagatacttaggttcagattcccaggctcctagagcatcagcccacccctccaactgtacagaagagacagatccacagagcagaacagcctccccaagccacagagttggtgacccagcgtttgttcctgtcttcatggtgcctggctgcctctggcctgactcacacctgcctcctctgtgccttggcctctctgtagtggtctccttgcgccagattcagcgcagagccgcccaggaaaaggagcggagccaggaactcaggcgtctgcaggaggaggcccggaaggaggaggggcagcgactggcccggcgcttgcaggagctagagagggataagaacctcatgctggtaggagacaggagggcagacaggcagacactagggcccatcctgggctggttcctgggctagaggtgtggaaagaggatggtgagggaggctctatccgggctaggtttaaccctctccttcccaggccaccttgcagcaggaaggtctcctctcccgttacaagcagcagcgactgttgacagttcttccttccctactggataagaagaaatctgtggtgtccagccccaggcctccagagtgttcagcatctgcacctgtagcagcagcagtgcccaccagggagtccataaaaggtcttgggccaagcacaaagggacaagggacaaatgcgcgcacttcaggaatctcctcttcagactctcgcatgatgagtgttgttctctgcggtccttcgaggcccttagcctcttttagcgatgcccagcttggaccaaagagcctcctctctcccattcctcatttcctgtgccagccctgtttcctctgtaaccacgagcaccttcccttgtctggtgctcatctgctgtcttccttcccagggtccctctctgtcctgctcgatgacctgcaggacctgagtgaagccatttccaaagaggaagctgtttgtcaaggagacaaccttgacagatgctccagctccaatccccagatgagcagctaagcagctgacagttggagggaaagccagcctgggggctgggaggatcctggagaagtgggtggggacagaccagcccttccccatcctggggttgccctgggggataccagctgagtctgaattctgctctaaataaagacgactacagaaggagccattgtttggaaatgttatttctgggaatctgtgggaattctccctgcagccatctctcttggagattgtgagaagtggtcccacccatagctctctctatgggtggcaccttttcaaatcctttttctaggcagctttggaaatgtttgggaagctcctgcttttctttattctcaacttttgttttaaaactcttttcttctggaagatgataaatgctaggagtggggaagatgaaacattcactcgttcaacaggaatgtcaatgccaggcactgtattagcctgggggccacttggaccctgagagcctacatcctagtgggagagagagcgagcagatgggacctaaacagatgaacgagatcgtttcaaataagtgcttgaagagaaagtacagtatgatgatatgatagaaactgactctggggagaggcctctgagcaggggaccttgtgcagaggcctgcctgaagtgggctcctgtggaggccaggaggtctctgtagagaatgctcaaggatgctgctgcgaggccgagatgtggccaagtttggattttactgtaagtcaatagaaagccattggagtacttctttaaaaacggggaagaaagccaggtgtggtggctcacgcctgtaatcctgacactttgggaggctgaggcacgcggatcacctgagctcaggagtttgagaccagcctgggcaacatggtgaaacttcgtctctactaaaatacaaaaaattagccaggtgtggtggtgtgagcctgtagtcccagctactcaggaggctgacacaggagaattgcttggacacgggaggtggaggttgcagtgagccgtgatcatgccactgcactccagcctgggtgacagagcgagactcagcctcaaaaaaagaagaagaattaaaaaaaaaaaaaaaaaacagggaagggggcccggtgttgtggctcccgcctgtaatcccagcacttttttttttttgagacagttttgctcttgttgccaggctggagtgcagtggcacaatctcagctcactgcaacctccacctcccaggttcaagcaattctcctgcctcagcctccggagtagctgaatcccagcacttttttgggaggccgaggtgagcggatcgcttgagcccaggagtttgagaccagccaacatagggagactccatctatataaaaaataaaaataaaaaacattggagggcatggtggcgtgcacccatggtcctagttactccagaggctgagttgggaggattgtttgagcccaagaggttgaggctgcaatgagctgtgatcgcaccactgcaccccagcctaagagagcgagaacctgtcctcactccccaaacaaagggaagacgcaacatgatttggtgtacattttttttcctgagggacttactggatggtcccttccagagtgaggtacacatatccacgcactgtggtcagcgattgctcccggcacccagcgcagcagatgggtgggtctaaccaggtcacttccccaggagggcataattgagcagtttccgcatcaggtccacgtgggccagcagcatgcggcaggcagcggctgtggcgcttcaggcccagggcgtccccatcagcgtacttggactgcagcagccccaggtaggcctcccacgtgttgcccacagtcttgctgcaggtgaagcagcgcacacaactcctgagctcaagtggtcctcctgtgtcagcttcccaaagtgctggcatgagccactacgcctggcctgatatatatatatatgttttttttttttttgagacggaatttcactcgttgcccaggctggagtgcaatggtgtgatctcagctcaccacaacctctgcctcctgggttcaagcgattctcctgcctcagcctcttgagtagctgggattaccaagaggcatgtgccaccatgtccggctaatatttttgtatttttagtagagacggggttt

SEQ ID NO: 14237 - DNA, 15771 bp, Human
ctggaccctaagggaccaggcgtgatgccttctggttctagcctctgagtgccccccacaactcagtcgtccccctcagctgctgcttcagagctctggggtctcagctgcctcttacattcctgccctagtgcattgtgggagcagctggaggaggacaaagggatgggggagtatcccccactcctcctacctcctggggtgacctgccttccttgtctttagacccgccctcgtctccaaggcaactcagcctttcctcagtccctcagaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagattttgattgagcaggtcaagggtgagcctgagattctgatttcttccatgcttccaggtattgctgatggtccagggaccaccctgggcctagagggctataggggacagtaagactagaaggtgctggggtcccctctgcccttctcttagaattctggactcctatgtgggagggcagcagggtgagctggtccaggcttatctgatgtttaattctatcatatcctcaacaaggaattgcccaacctttcctgggacatatttattttttaaaagtcaaaatgattttcatattcttttacatatcttatgattttacataaatgcatttatgttacaagatttagaaaaatagtacaatcaacctgtctttttaaatttgcttttcttttgccccgttcatgttaactcttgttatattgtattctattgttatattctattatatattctctccttctagacgtacacacaggtatatatacaaacatgggtgcttgtttattctattttcaaaaggtgggatattttttatacttctgttgcttgcttttcatattcaacagatatacatggaaatcacacaaagttaggaatatattgcctctttgttacttttcatagctgcatagtagtcaataaaccttattttttttaattccagcctgtcccctgtgggcattcacatatcttacagatttatgtcttacaaaaggtaccataataaacatctttgaaatcttcttttttatttttatttttcactttttttaaagagatggggtctcactatgttcaccaggctggtctctaactcctggcctcaagtgatcctcccatctcggcctcccaaagtgctggggttacaggcatgagccaccagacccagacctgcacatatgttcttacttcctggtgcttctctctcgagggaatgctgggtcgaagaggatgtgcatttttaattataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctagtgaatttgaccattaaaaaaaatgtttgttggcaatttggctttgcttttctgtgaaatgactattcacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggagaaatggggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctggtgaggagactgaatcatgggtccctgagggccagggcttgggaggtagagagttgggggccttgacctgttacatgcctgctttttactcagccaagtgccgctatgccctgggcatgcaggaccggaccatcccagacagtgacatctctgcttccagctcctggtcagattccactgccgcccgccacagcaggtacttggcacacctggcacacttgtagctgccccgagaggagctcctgggacctctacttcccctccaacccctctgcccatgccagtgaaacccctgcaggctgagggggcaaatgaagtggggtttaaatactggagatggaggcagacctggggccagatgttctctgtgcccctcttcaccctcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgagactggcaggggcagcacccagaggaggttggctctcctcacttccagctgtactttaaacaccacctatacgctgacgactctccagtttatatcatctccagactaagcctctcagctgagctccaaacaatattgtaaacctggccaccttttggatttctccacttagatgtctttttttttttttctaatagatggggtcttgctgtgttgcccaggctggtcttgaactcctgggctcagtgatcctcccaccttagcctcccaaagtgctgggattacaagcactgtagccagccacctagatgtctaataggcatctcaaacgtacgtttaacttcccaagctgaatttgattcccattcccagcctaaacctgctcctcccctggcattctccagctcaggaagtggtatcaccattgcctggttgcctaggctataagttaagatgatatccttgattcctttttttctctcacctccttccaaagcatcagcagccccgtctgttctacctccatagtgttcctgagtccagtcactcctcaccactccacctctactgccctaggccacctgcccgccatctccagcttagatgagtgcagtagatgccaaacgcgtctccctgcttctgcccttttctgcctggagtcaaatctccacctgggggggcggcatccagtggaccttagagcatgtaaatcagatacgtcacacctagctgacacccccatgctggctttccactctgccagaacaaaagctgagtccctagctggtgcaggatgctcagcctgacctggctcctgcctgcatcacttgtttcttggcgcctccttggccacgctgcctttcttcttgttgctggaacaagccagggctcgttcccacagcttctggacattttctctgtgcctgcaaagctcctcccctaaataaccacaggctctccctcactccattcagttctctgccaggtgtcacctccttagagagccttttctggccacccacctcactgctctgtccatacttcctgcctcttgttcttcgcagctgttttccctgctgggatctcagtcctacaagggtggggagtgacgttcaccactgagaacgcgcctggcacagagcgggcactcagccaacttctgctgaatgaacagagggaatgggctgaaatgaaggggaagctgaggcaggggtgcagggctgtgaggattggggagaatctgggcacaatgggatgataggcttggagacaaatggatggagccaggcaaggagaagagggcagctgagcctgaagtctgaggatggaacatcagagctgcgacagagccagaggtctcagctgcagatcttcatttcacccatgcctggctgcgccccacagtgctgtgtgctcggtgccacccctcatgggtctctaagtggccactgtgggctgggccagggagcagctggtgggtgggaagtaagatctgacctggactccatcccacccaccccctgtttcctggcccacaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatgggggatggagccttagtgcctctgacccccatcctctcaccctgccccagatggactcctgtcttacaccgcccctgtggggcagacaatgtatttatctgaggccgtgtacctcaacgactccacctatgacggacataccgtgggcgggtaagaaaggcccctgcaggatatggagtttggggtgggagggaggactgtgtgtgtgtgtgtgtgtgtgtgtgtgtgtgtgagtgtgtgtgtgtaggggggctggtaagtagggtggggagtgagatggaagagctgagaagagggatgggttaggtggggcctcaaagggtagcactagggtgaccactagcccgtatgacactgtatgaaaaaggcacccctttgctaacacacattgttggaaattgctgcaataaatatacacatcatagattgaaatggtgccccttagaggtggtgcctttgtgctggatgtgacctgcaaggtacctgtagtgctggggtggggtggagagaggagaagggccagctgcatgagtgtgaggtgggatgggaatgggactagtggatgggagccaggctggccatgccactgtgccggagggtggcggagcagaatgcctggatgtcaagaccctcttcccttccaacctcctcttccttggtcccctcttctccagactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtgagtgagtccggctctcgaggagggctctgaagccatgcagggtgccgttggggtgcccccaccactcctagccttgaccctgtgccctcttcccttccccccaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctggtaagccctggagtagcccagtctccagtccctgaaattgacaactgatttcattcctaaccctgcagtgtccctaaaatactcattccttgcattatatctacccatcacccaccgaaacttctcaattaggggtgccccaaataacttgagcccctttctgcctcttgttctctgcgtatccatctttcctttgtaagccccttgcccgtgactattattgagccagtatgacagtactggttgttaaaatattgaaatacttctgtattagttgagaaatagcctcttctctaagcctccagatacctgtcctccacctccccacaatccagcaactatagggttaacacccaccacagctgggtgttccaggaccctgctcccccagcccccactggtcagtggttgcctattgagaatcacccatgcttctgctcctttgcacaacagtccactgcctctgcctcccttgggtctcctcctcatttacctccctcctttctttttgttccttctccccagatgtggtgaacaattcctctccggcactgggaggcaccttcccgccagccccctggtggccgcctggcccacctcccaccaacttcagcagcttgggtgagcaatcttgggtgggcgtgtggaccctctgcacccttctccctgggcctccccctcggctagggtgggaccctcctgtggtgctgaccctgctgcctccaccagagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtgggcacagccgtggcatgtggagtggcggggggaggccaggccccagcacgagccagcgtccagtgggacctgcagggcacagcccactagcatcccaagaggagggcttagtaaagagaccacttacaccatgtcaaagagggtatggggctcacagggagggctgctccccagctctgggtctgctcagcggagaggagcaaataccacgacccagaggagagagcctgtggagagggcaccttgacaggggcagtagactttggtcctgggatgcagctggcccgtatctacccctcagggagggcctgggagaatagatgccctgacctcactttctgccccaaactcctgctgggctcctctctggctaacccaaaccaggcctgttggtgcagtgtacactggtcagccttggggcagaagcagggtagagacaggcagagagtggggttggaggggcaaagggaagacgtctggcacaccccaagccacgtcttccggctggagtccagtggcagtaatatacattaaggttgatgactggacacggtggctcatgcctgtaatcctagcactttgggaggccgaggcgggaggatcacctgaggtcaagagttcgagaccagcctgaccaacatggtgaaatcccatctctactaagaatacaaaattagccaggcatggtggctgatgcctgtaatcccagctactcaggaggctgaggcatgaatctcttgaacctgggaggcgaaggttgcagtgagctgagatcatgccatttcacttcagcctgggcgacaagagcaaaattccatctcaaaaaaacaaacaaacaaaaaaaaaacggttgatagttatggactgggcagatgagggttagaatctcattgtgggacagggaagttacctccatgctcttgagcttcactttctctgcctgtaagatggtgctgatagtatccacagctgtagggctcttgtgagggctgagggagggaacgcagggatggacacagcagagggccaggccgtgtgtgctgagcaacacgggtgatgcctcccatccctatgacaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtaagacctgccttgttccagtcgcacctctgtcctctctgctgttttcttattgtatccctttcccattctctttttttcctgtcttccccagtttccacttgttttcttctttctgtgcccctggttactgtctatatcactctttgtccctaccatgtagtctctctcaagagttccccatgtattacccatagtcccccgtggtgctatcttgtctgtgtcccacagacatctctctatctttgttgtaccctctcattgtgtctccctggcccctttgctttgtattagactcaccatgtttgttccttcatctatcctccatcacccatccttccatccatagtcatacatccttgcatccatccatcaatcttccatcatctgtctttctatctatattcataaatctattcatccatccatccacccacccatatccatcatccatctatccatctatattcacacatccatctttccatctgttatccatccatccaacaaaacatctgtttaccatccatccatctattcatacgtcccatctgtccatgcattcattatccagccagccgtccgtcactctgcagatccttgttttatcctgtctgtctcttaatgcaatcatcccatcagccctggtcttgccctattcaaggtctccctgtctgtctagccttgagtctcatcccttccccgtgtttcccctcctccttctcccgacagcgttgctgctctccaatccagcctaccgcctccttctggccacttacgcccgtccccctcgaggcccgggcccccccacacccgcctgggccaaacccaccaacacccagggtaagcccctctgcccctgggctccgccaggctccccatacctctactggggcagggaaaagccctcacaccttgcacttcctcctctccccactgtggcctattctgctctcctgagctcccaaggaggaagctcttgtgcccttagctcatctctgctgctgcttgctcttttttaaggtcccccccttgagctgaggagtagaaagcttactggtccccagctcttctccctcctcctcttccacgccatctcttcagctctccagagctagacaggaggttgctgtggtggccccagactatagtaactcctcctttattctccactctctctagagctgcgaggaggagggctctcaccccgggcgcttgccctttccctcacatgtgtcctctctctgcagtcccagaggtgaaggctcatgccccaaccctttccatctgcccctcttctcctcagtgttgccttctcattgtggccccttccccagggctaagaggggacagctctgcttcctctcctgtctgtagacaacttgtgttggggctgtgagcagctgttaccctccctcctctctgtgtgcctctgtctctgcttgttgttgagcttggtgtgttgggttgaaagggttgggagggcttggccccagggggagccaggctgaaagccacgggagagcagctaagtgaaggggagggagctgtggtgaacgggacaagggtttggaaggtggagggtgcctggatgctgggaccatcctgaggcgggagaattcctggggaggaattcttcttccagccaagatttatctcacagtctcttgagagaccctagggaggccctaaaagagtaagactttatgacagttttgctcaaccatattcattgccttgaaaagctctggaatagctaactctcgtcccatgccagtgtcttcctggtttgaggttggcgcatggaatactgggaagatacagcatagacccagtctctcactcaaccgggagacacagggccctccgggaggctgaggtgtggggaactatagctcttgggctgttcctgatgcctcgtcctgtcttctttcccctcacccctgcagcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtaaggagggtgcctacccagtgtctggccctattgtgtgctctgatgccatgcctgcgcatccccctagccaggaaccttagtcatttgtaaccgtgttaatccgtttgaccctgtgaccgcctagcaaacgaacttctttctccaggtgcacctgtgtgaggtcgacagccctcaagatctggttagtcttgatttcccccttaatgtgcgtaagggacaccctttgctggtagctgtcaagatcttacggccagatgccaccaagaatgccaggtgaggaccagggatggcatctggaagaagggaggggaggccgtgaagagtggggagccatctagagagaacaatggcagagcccaacagaggggtggcatctctgggaggggatttacatgtacgctgggggtggggatgcctggtctgcctgaggtggggcaggggggtgggggcgcgggggaaggtgcaggccgcccactcggcattcctcttcagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgcttacccaggctgggccttgctcagaattcccccaggggatctcctcctctcccctcgcttcagcctggaggaaaagaggggagcgtgggggtgggaagggagagaggttccaggagggcctgggataaggaatgtgtgacaagttaacccaggaacatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagggaagtgacccttggcctcacgtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcaggagctgcagtgtgatgggcaagaatccaggagccaagagtgggtactggggatggagacagggtggcagagagctcaagagatgaggttgggcgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagaggagttggaaaaggtggccagcggaggagagtggagagcctggcgtcaggagggatcaggcctgagtggagcccagagtggatctggggcttccaataggaagggaggagggtctacgttgcctgatgtccctgtctgtttttgctgccttctctgcatcccaggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtcagagtggaggagagggaagatgggtccgaggcgggggacagaaggggcagagttgtcatcttggagactaaagaatatttgttccctgactctcatccacactgccacaatgcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacctgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaactgtgtgagtgggttccttgggaatttggtaactctgcctcctgcacctccctctgaacccacttcccaacccacttcccatcttccttttttcctgcctcctcattccatttcccatcacctgttttgcccagcattgtgttctgtttctggataatccaggcctttgcctgtgggacctcaggagatgcatgaatgtctgagtgcatgaaccttctcaactcagaggggtgctctggtggaggcctggaaggaatgcagtcaggccaggggtgctgaaccttttttgtgccataaacgcctttggcagtctgtagaggtctactgagtcctcctcagaattaggttttaaaacctataaaatggaccaggcatagtggctcacccctgtaatcccagcactttgggaggctgaggtgggtagatcacttgaggccaggagttcgagaccaacctggccaacatagcaaaaccccatctctactaaagatacaaaaattagcagggtgtggtggcatgcgcctgtaatctcagctattcaggaggctgaggcaggagaattgcttagaacccgggaggtgggggttgcagtgagctgagatcacacaactgtgctccagcctgggcaacagagtgagactgtctcaaaaacagaacaacaacaacaacaaaacccataaaatgtataggattataagggaaaccaatggaaacagtttaccaaaatgctaaaaaattatgaaactaatgtgcttctttttcatgtatttaataacaagatctaaaaacaggtgtaataaactgacattttccaaatactaatgagcataagccatatttgagatttctacaacagtcacagtgagacataaaagtagctgtggtgtcaattagtgacaagtcacaggtactgctaatactactggtggttttacccatattcataattggaggaaatgctaaacttctattagaggttagtaaaaggtgtaatttctttttcttgcccaaattctagaacccatctggctccccagggtctggaaatcccaggggagaatccctgggttatgctgatcaagtgtgcaaatgccccactgggggtaggggataggttgttggaatggaaaccagaaccagaaaccagaatcaagagcctcagttatctcagaggcttggaaggatgagctgcaaccaccaagagaacaattaaagggttcaaatttggttggaaagaaaaaatcggccagtggggtggctcatgccctgtaatctcaacactatggaaagctgaggtaggaggatttcttgagcctaggagtttggaaccagcctaggcaacatagcacactctggcccccatttatacatatatatataaaactagctgggcttagtggtgtgcaccagcaactcaggaggccaaggtgggaggataacttgagcccaggaggttgaggctgcagtgagccatgattgcatcacttcactccagcctgggtgacagagcaagaccctgtctcaaaaagaaaattaaaagtcagttgcagggatgggacaaggcagacccatcttgatggccattcatgtgaaataaaaaccctggggttttggttgatgatattcacaaaatgagccaattggataatgaggatcacaataaagataaatcaatgtgaagttgaattaataggcccttggggcctaggtcccgaatctaatagtcctgctaaaacttacacaggtcaaaccactgtgcactatgatttaagttgtgtactgataggttagagtttagaggccagatcccagaataatgagcgatggaagccacggcagtgagcctgataacccaaatctctgagctgtctttcaagcagaaacacctggagttaattttttttttttttttttttgagacctggtctcgctctgtcacccaggctggagtgccgtggcgcaatctcagctcactgcaacctccgcctcctgggttcaagc

SEQ ID NO: 14238 - DNA, 15771 bp, Human; identical to SEQ ID NO: 14237

SEQ ID NO: 14239 - DNA, 15771 bp, Human; identical to SEQ ID NO: 14237

SEQ ID NO: 14240 - DNA, 22218 bp, Human
cactccagccttggcaacagagtaagactccgtctcaaaaaaaaaaaacagccatttctcttacctgccaatttagactgtaaatttcataggcataggataaaactttcagtacaatccatagtagaaggtaaaaggctggagggatgtttttataatgccagaaacagttactataaaacggactgtagggcctcctggatatacgaagtgtggggcacctacagtaatctctttggcactgcaaaggggctcctaatctttatttttctttttaattttttttattttattttattttttttttgagacggagtctcactctgtcgcccaggctagagtgcggtgatgcgatctcagctcaccgcaagctctgcctcccgggttcacgccattctcctgcctcagcctcctgagtagctgggactacaggcgcccgccaccacaaccggctaattttttgtatttttagtagagacggggtttcaccgtgttagccaggatggtcttgatctcctgacctcatgatccacctgccttggcctcccaaagtgctgggattacaggcgtgagccaccgcgcccagcccctaatctttatttttcttaccctaaaaagaaaagactctccttaccctaaagtcaacatgcaacttgtgatctcgacagatggggcagggattcccaacaactttattccgacgctgtagagagaaaaaaaacagcagttaaggatgttcaaacacgtcagaaaaagtgctgctgttactgttacttgtggcctccccgcactccacatcccactctcagaaactcacaatacatgtcttccgagtccgctgtgggggtacaccacccttgtggttgcggcggtagtcagcccagacggggcgagaaccatatcgctcctggtattctgaaatgaaagatcatacaagttattcctgggtgggagtgtagtgggtggctctgtccacttatctcaaatcctatctgaccctccctttccccctttagaggtaccttctgattccagatatttccagggctcatccttataaggagaaatgggaactgaggacaaagaatcttcctcagagggagctttggtgcaaagagtctggaggggaacctacaaaggagaagaaaaaaataaaagaatgagtttaaggaaaggactaaattgttttgcttatcacactttggaaaggaggaatgcacacatactgcattaatggaatataacaggaatgcatatgtaagttaagtatttttgttgggtttaaattgacataaatcaacaaccactctccttttctacaattggatcctgaaagaaaagctaagttaggggatatatgcctaaaaaacaatcttatttcagaagacaaataaaaagtctagtacaaggccgggcgcagtggctcacgtctgtaatcccagcactttgggaggcccaggcaggcggatcatgaggtcaagacatcgagaccatcctggccaacatggtgaaaccttatctctactaaaaatacaaaaattagttcggcgtggtggcatgcgcctgtagtcccagctactcgggaggctgaggcaagagaatcacttgaacccgggaggcggaggttgcagtgagccaagattgcgccactacactccaacctggcaacagagtgagatttcgtgtaaagaaaaaagaaaaaaaaatctagtacataaaaggtattcttgctttttggaaataaattgactctggtggaagaataaagtaagaggaaggatatctaggttcttggaactaagatgtgtggtggggaggggatgcagaagacaggtgagtctccaaatcaatccaatgaagtcactgagttgcccattttcataaaagctgaaggtcaacattctacagggcagaacaaacttgagtcctaacgctagttttaaagctaccaaggctgttattatttctgtgttgacctctgtcaccactcttcagtcccactttagggagtggcagctgggcaagccttcctatctcaccgtgccccaccaagaacctccagagaggtgagtacacaagactggagggaaacctcaattcaaaggacggagttaagctctcataactccgataagaaactgatttaataaagagagctgagaaactgtcctcaggtcgtaagaatatatcctgaccttattgagaaatagcaaggttggtagaaattgggatccctaatttccccaaggacattccagagcaacacagatttagtcaccacttgcatagttaacagctggttgtggcgctcgcttggggagtacatatgttatgctaaaattgcaacgatacagagattagcatggccccttaattagttaaataatttttaaaaagctggttatgcatgactgagggtggacaggggtcaattccatcacttaagttattttactgaaatggcattttggaaaaaggatgatacctaaccctggcgtttagtcctcggctcgggattagaaaatgcgcggggtgtggggggggggttgcaggaagtactgcctagacagctaagacacacgtgggaaggtctccactcgtggattcctgacagtggagcgacaacctcgagaaggtataaccaacttgaggttgtgcaaaatgtctttcgaagagttacctgaactctgtgagaacctcggaagagagatagcataggaagccgcctcagcacggtgtttaatacagacgccgccatcttgacgtacgcccaggacaggaattgacggaaaggcaactgcgcatgcttcaggaaactgagtagggcagggccaaggacaagcccgcagtgcggaaggcggccccacgtttgcgtcaggacggaagcgtgaaagggaaggcatgggggagaagctaatttcaactgcgtcacaatcgaattagaccccaaaattgcggttttttttggccagtcactacgactcttagatcgcattgttaaagtttgccttttaagcaattttgaaggcgatttttagcggtatcctctcagtgcgcatgcgctcttaggtttctaccaatcctgggtgagaaatgttctccagggcggaagtggcggaagcagaggaaagggaggtgctaggctcctggtcacgcgcacgcgacagggaggcaggaaggaggcggaagagagtgccagggaaaggggcggagcaaaggtgaagtgagagtagccaatcagttggcgagttgtcatttgggttgaccaatgagttcacgcctcgcgtataatgtctcgcgacaagggcgtttcactagcacgtttgggcgcgttgggcggcgtccgggtataaaagactccacccgagcgggcggccgccattctggggttcgtttagaggtaagtttgcctactttgtcgtctagtgggtaaaattttgcggagagcgttggatctgggaagcgggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggatagtaagtgtcgaattttcaaaaaccagccttgcaacaagaaatcaacgtttcccgttgtgaaaccaaaaataatgagaggaagaaatgagaccatagaacaaatagagaactggagaaggaccaatctggtcacttaatctccattaaaaagggcctgtgggtctaaacagtcttgttctctctcccctaccacctatctcttccctgccttgctgcaggcaaagagagggtggagggagggccagcaagtgaggattttgatggttaacccttggtaatccagccaatttccagactgccaaagccatatgtgtttatataaggaggaatggttaccttcctctggttagcagcagtcttcaaaagggttaatgagctcacatacaagagatggtggatcttgtggcccagaagtaccacttctttgtgtgtgagacaagcagggtgcctttcaatttgccagattaataagcaatctgtacataaagattgcagggtaaggagatgggcagagagaagtaatagctcgctataactttttaaatgactgttaaatcctctcaattttaatgtaatttgcttggggtatatttgtgtggttaaaataggtggcaatctaggaataaagattgcaagacacttaggacaaaatataatcttagtgccagtacatacaagataatagttggggaggtaaagaatgtcttataattgttgcagattgcataggtatttaaaagcaaaagagtgattaacattttaacttgatattttttggtgggggaggtacagttaaatagagggtggaaaggttgggaaatgtggaatttaggagtataattttaaaagccatttagtgcaattgaatgctagctttctaaaagatttgtgtcgttaaaaggaatttttttcttccctgcttcaatatggcgactttccttgtccttttgtcttccaagcggcgttgcaggttgtgtcttgacccattttttttcctgtcctcccacctcaaccctatttgttgagaggggtccaagtccttcctccccctttccctctatagggaggatgggggtggtcgatggtagccggttgaacctccgttgcaaattcagttcttccctgcagaaaattgttctttttaatattttaattgctttaattttcactacgctcttactgatcaaaataggtcaaagattattcacgatggggaactggtttttgattttttttttttttttttttactaaaaaggtgttttataatgtaactgaagctaccggcagagccgggtggctttttagtttaagtcctctttctccattacaaaatggcgtccctccgtctttgttgtttttctcccccttttgccatcctgagcttagggccgccctagaaacttggtcaagtgggaggagcagccttgaaaggtgatgtaatcagctttcttcctcctctctccaccctcttgaagctccacccctgagcagatgcttttgcactgcctgtgctcgttgctgctagggagaagacattttccttattttcattatataaaatatcttaaagggataggagcttataggaattaagtatcaaggctgtccatctctgtgtagttctagtttttatagaaccagtttttattttcactttccttcactcatcacaactgcttgtaatttttccccacttcagctgccaggggtgaaaaaacaggcaaacctaagactgggaagctttgaggatgtgtgtgagcgtgtgtgtatgtatatatgtgtgtagagggagatgggaaagacacaagggcttgcaagagtaacttggagataaacgggcctaatgacactgaagtgtgccatttctgcttaggaaccagtgggcctcctgcatttggtcgctttgtgtaatgagaatcgggggaaggtgggtacttttaggactttcttctaaatcgccctcattcccacctctcagtttggggataaactgtattcagtgctgtatcacgttctgcacttgattagttcctgtacattggtactaggataagaagtgaatctttaggaaaggaggcggcagttgtaaactcaaggcagggggaatcaagctacggtttctggtaagcaaaacctttctggtattacatttcacaactttcattttttttttttccccaaagagccaccttttttgaatttctttttccttcccttctaaaagaaattcctaaaagcattaatgaaaaaatgatgtcctcttcatttttcaactcatgcagtgctgtggcatttggtgcatgttcagaagccatgccctatctgagggtggtattgggtgtctggttcctttcttcccccaaatttttcaaagtcaaatctttatcagactctccatataattttaatttttaaaagtcctgcactgaagcgtggaggttctaggcagaattggaaagtataactgccctctggtgacctgggtgagacttagggctaacttcctactgggtacagattctcaaattattacttaagcttctggattggatgggagggactcttcacatgtctgttgactacaagctttttttgttttgttttgtttttttcttttaagcagtttgccatgtgcctctgcagcatatcttccttgggagctgaacattctacccactggggttcctgatctctagtgagccaggggattaataaagaagatcttccttaacatgggagatgggaagccaggtctactaggggaaccacatccattcagaaaatcttggaaaacctgatccttgtagtttgtggccagagttctagtctggggtctttttctatgagtcagggtggtatatcattttgcatctttattggaaggcagataagcttttgaggagctcatgtatcaggtttgcaaaatgactgaggggtaggggcttactacttggaagaaagctatgaccttgtgatgaatcacctgagagacataattcagtccactattgtgtcaaactaggaagtgcctaaaacactgaagaaaggaaggggaacataaggggttaggtacaaatcattttcatttccagaagtgcctctaaattaaggtaaatttgggacttttttctccttttgttagaagacagttattttttaaagagctctgacttgcacagaatttttatcctgaaccaattcagtcctgtttcattggtgatgggtgtggaataactttagctatgctggatattttttcaccctatttaattgaataaccctcaagtaaaattcattttgaaggcaggagttggtgtcacagacgtttatctctggtaaaaatggtagaaaattccccaatgccttgtgccagtagagtatggctctgcctgaaacattctccataaggaacgcatagcttaggatgaggtggaggtaggccagggggttgctacctcactccccaccttctgtatgttctgcagtcaagaaaatagcagctcattaaaagaagacataatcatgccgtggattacttgtggttccagaaagctttcttaagctttcattctagactccagatcttgagtaggtaatgttacaacacttagtcacggcccctgcctgccttcatcaactcagtttgccttctctgctgtagccctgtgcccgaaatgttggactttacattcctttccacttgagcgccttggaaattgtttggtttttttccaaaatatactgacttcaaagcaaggaaactaggttataagacacttggggtccttaattttaaataagaactaatcttcctgaaggaaggccatcatgagaaaacccacttacattttatcaagattggtgctcatgagacaaaatttcacttatatttccaaaatataagtagtggaaaatgaatatttaacgctaattttgctttgtctcttagcttccctttgactattaatgtcttttattcttgtttatacatgtgggaataaaaaagtccctggatcccatttccagcagagggcactggacagaatttagctttgtactcattggtccatttttctaagactggctcttctttcttgtctcccatcctcttaaggaacacttgagctcagatgacagtttatttagtgtctgaaggaaataggggtagtaggtctatttattggcttagcttgtagttggatatgcaaaaaggaattctccagggttatatatattcaactctgggtttgaatcagtcaagggtaactggtttgaaatgatgtttaattcaaggccttttgtcaaattgcatatattttgctttaggaatctaatggtaggtatgtgtgtatatatagagagagggagttttaaaaatttcttagtctcttgattgcttatgatatgttgttattggaacccatacattgcttttccagtctccaacagatgtgatatctgttttatgtgtccctttatcgtatctctttatagtttctatagatcactttatagtatctcactacatgggaagaatacctttatttctgtgtctgtctctgtgtgtgtaggaatcaccacacttgagtggatttggcccacggacatctaatcttttccagtattctccttgaatgttttttctctgacctcaggttccacttgtatttgtggaggttccagggcagcagcgacttctcaacatttcttgcctcatctctccctctgttcagcccacaggttatgatctccagagccaagattatactcctacccttcctggctgcctcctccctgcttctgctgctgctcgcctaggttgttaggacctacacatttggaaacttactgacgtttttgttgggaggacaaaaaggctgagattgttatgctatgttttttcttttgtttgagaacaagtagaactaatttgcattatcttacaagaaacctgtgttttttccggcacaaaactactcatctttgtaaaatactgatttttctacccttctgctgggattgtgtctgttacttctgtgctagatgtaggatgaggaaggttttgttcttgcctcttccttgctactcagtgtgggccttattgcccaaaggcagatattgctgaagtggctttcttttttggtggttttttgtttgtttgtttttgaggcagcgtcttactctgtctctcaggctggagtgcagtggcacaatcacagctcattgtagcctcagtatccctgggctcaagcagtcctcccgttttcccacgtcagcctcccgggtagctgggactacaggtgcacaccatcacactcgacttatgttttgtagagatgaggtttcgccatgttgccaaggctggtttcaaactcctgcgctcaaggaatctgcccaccttggcctcccaaagtgctgggattacaggcatgagccactgcacccagcctcttttttgggtcttagaagcaagtatttagaggcagtgtagataaaaatcccaatcagaaccatattgatcctaaattacctttctggaacttcagttctggcttgtcccttccataaaaggagcttagcttttaactaattcccttcccaacctggtctaaaacagctgcttaaaagggaatttttctagcatttggctttatctgttccctttttaggttccatggttttcagttttaggctttcctaggggatcttgtacagcgtgatttttgaggagaggaccagattcgcatctttgcttttgaaagcacaaaccactagcttccttttaacttagagacagtaaaaacttgtgtagtgtttggctaatgagtgacagtctattcaaggtctaggaggacctgcttgatttccatgcatccatttgtctcaatctctggcacctactcccagatctccttagggagggattctgttttcaagttttgttttgttctccatcatctaccacttcagctgatacatatcttgccatgtgtagtgattatgactcttaatgggctaagataaaaaggactcaagtcttataagacatttagctcaaacacccaagattggcccaatttctatcaagctataggctgtttttcaagccaaatttatcagcaactagggaagacaggacttaacgataggtgtaaatgccctggagagttgaacatcttgttatgggaactgatcttagctttaatacgatctagtgaagttcagccatcctaggaaggatgctgctgggagggagggacaggtgtgctgccctactcctccaatcgaattgctttcctgttcagtcacatatgctccccatgcttaacttgccagggctattttctcagtagtggcaagtggtctgtgtcgatttttcatatctaaaaaatagcatagttgaataattagtcattatactttgtcaaatatagagatgtggtttattagagggcctactcgggtagtccttgccacccatttattctgtgggtttgtttgttttgtcctcttaccatagaaaccaccatcatgggttcgggtcccatagaccccaaagaacttctcaagggcctggacagcttccttaaccgagatggggaagtcaaaagtgtggatgggatttccaagatcttcaggtgagtctttacccctttttgtattcactgtgagtagagaatattgtgtgttaaaacatggctgcagttgaggcacactggaatgatcctggaaaggaaagggaaagatagtcagtgcaataggattaaaatgtaacaattttaggataagggataggaaaagatgatcacttgtttctgaccataatggaaactggagatttggacgtccacggtcccaagggagtcatgctttggaatgagagcagggtagcctggtaacagaattctagattgttttggttcgtgttccacctacccataatgttattttccttcagggattctcaggtttttcaggggagagtaaataactaagccagtcttgaacagactattagggacagttgttgagggatagccttatcacctggaggcagaatggaattcatcctgtgtgttacggaggcagcgatgctctcctccccaggtcagagactgcggtgtctctgttctcccataagtttccatgtcacactggatccatcccatcttcctagaggtatatgtgactccccttctctggagcaaagtcccaagtcattaggaatctctaggcagttcacagagaggcgcttttgctaagagaagagatactggctgcttcatttctaaccctaactcatcttctgcagtttgatgaaggaagcacgaaagatggtgagtcgatgcacttacttgaacattctcctgcagacccgttcaccagaaatattggtcaagtaagtggggatctggatggttggaatgggaaggtgtagcgaaaagatggggcggtgaggcatggggttcctgggtcattgatgggagactgggattgtaggatgtggtactgtcaaaacctagaaagggcattactgatagactctcctgcctgcctgcagatttattgacgttggcggctacaaacttcttaacaattggctgacgtattcaaagacaaccaacaacattcccctcctccagcaaattctactgaccctgcagcatctaccgctcactgtagaccatctcaagcaggtacctttagtctttaaaccctgattcttccttttttggtttagtctaatggatgaaaaactcaaactgactgatgtggctgtaatcttgggcctgtgaggtagaacagcagaaaaaaaataggaatttagaagaagaagacttggtttgaatttatctcctttaataggtgtgtggcggctgggcacggtggctcacgcctgtgatcccagcactttgagaggctgaggcgggcggatcatgaggtcaggagactgagaccatcctggctgacgtggtgaaaccccgtctccactaaaaatacaaaaaattagccaggcatggtggcatgcgcctgtagtcccagctaatcaggaggctgaggctggagaatcgcttgaacccaggaggtggaggttattgtgagccgagatcgcaccactgcactccagcctgggcgacagagtgagacttcgtctcaaaaaaaaaaaaaaaaaaggaatgtgtcagccaggtgtggtggctcacacctgtaatcccaacactttgggatgctgaggtgggtggattgcttgagcccagtagttcaagaccagcgtgggcaaaaatgataaaactctgtctctacaaaaaatacaaaaaatttacccagatgtggtggtgcatgcctgtagtctcagttatttaggaggctcaggtgggagaatcatttgagcctgggaggtcgaggctgcagtgagccaagactgcgccactgcactctagcctgggcaacagagtgagactccgtctcaaaaaataaaaaaaaaaaaaaaagcagggaggactgtaacttttgtcgtttttagctctaagtggaattatttgcctcctggcatttacctttctgctgctcccatctctcatagaacaacacagctaaactggtgaagcagctgagcaagtcaagtgaggatgaaggtagggtgccacttctgctctctcatgggcttttctctattacttccacttaattaccttaatatcttttcccatccttggattgtcccttcacttttctctttctacctcaccttgctttttttccttcttttaaagagaaagttcctctaacctgtaccctctttcctgttctcaattccaaagttgttcatttctctgttgctgaatataaggtgccatactttaactggaagctgattcctaaaattgcttgttataaaacacatacacttaaaatttgctgtgggaaatagtatcatcctagcgtgtctcatctgtgaaactcctattactaaatgataaattatgaaatgagtttataagtggaaatgttggccagaagagaggtgccatagatcagagatgttatttgccaagtacaaaaggaaagagttacaaagtattttttcatatatttagaaacaaattttattcttgttttcacatctataaaggaaaataaaaagtcttcagattgttgtaacaattaggtgtgttatacataaagcaactaacgtagctttttaaaaaaatgtcagtttttgaggaactggtggattttggttacatgtataagttctttaatggtgatttctgagattttggtacactcatcacccaagcagtgtacactgcacccaacgtgtagtcttttactaatgtagattttaaccacatattctgaaatattaggtctttttactccagagtggtgtgatgacatcagagttgaaagttatccaagtagaacacaactctaattcattgttccattttttaagggtttggtttttaagcatatctcatgttcttcttaaaactttgggttactttctccgttacataaattttcacaatattttctcaaacctcccattttctgttcctggaagaatgttactttacattatttaggcatttcccctttctgtcacctgcagagctccggaaattggcctcagtccttgtcagcgactggatggctgtcatccgctctcagagcagtacccagcctgctggtaagctccttagtcctttatcctttgtatttatttctttcctattgggatgtggcctttaggtgctcccagtctgcttcacctctgacagtgttcatctaaataaaatccttttctgctttgttttttcacaacagagaaagataagaagaaacgtaaagatgaaggaaaaagtcgaactacccttcctgagcgacctttgacagaggtgaaggctgagacccgggctgaggaggccccagagaagaagagggagaagcccaagtctcttcgcaccacagcacccagtcatgccaagttccgttccactggtaagactggcggctggcctctggagggttcatgggcatgtgcacacccagagccttatgggggaatcatttgatgtgtggtatgttaatcgtaaggaagagggaagactagcagaggaagctttggttacaaggctagaagaacatttgcgggtgagaacgggaggaaaattcgggggtctggggtttgagttcagctgcccacaccgtgcttctttccccaggactagagctggagacaccatccttggtgcctgtgaagaagaatgccagcacagtggtggtttctgacaagtacaaccttaaacccatccccctcaaacgtcagaggtatggaccatattctcaggctctgaatggggtggatctgtggacacaagggagcaggagggggtgagtcggagatgttgatgacagttcctcttctgacagcaacgtagctgctccaggagatgccactccccctgcagagaagaaatacaagccactcaacacaacacctaatgccaccaaagagatcaaagtgaagatcatcccgccacagcgtgagtctaaagtggggaagatgtactttgaattaggagcaaacttttttttttttttttttggagacagagtctcactctgtcacccaggctggagtgcagtggcacggtcttggctcactgcaagctccgcctcccgggttcacgccattctcctgcctcagcctcccgagtagctgggactacaggtgcccgccaccacgcccggctaattttttgtatttttagtagagatggggtttcaccatgttagccaggatggtcttgatttcctgacctcgtgatccacccacctcagcttcccaaagtgctgggattacaggcatgagccaccgcacctggccaggagcaaactcttatgggaatgaatgtccctgggaacgagaagttttttcccttctcttttattatttccctccattttcctttgatttcttggtatcccttactttttgtacctctggaactcccgtttcaggggtcacttaggagtaattttagagataagatagggacgtgtgccattctgtgactggtcaggggcacctggtaaggtgatctgtcatgttcacaagggctcacttcgtcagctacctgagctataattcacatccaaagctatggcttgcctgccatgagaaacctagaataacaacaagaatatcctgtgtgaatcctcctgcatgtgcttcctggtcctcttgagcttatcgtgtcctaagttgaggcagggtcttcactggctcattttatgcctggactgtgtttgcaggtgtaggattatgaaggaggtctgatgatgccatttggtgctctttctttttgtagctatggagggcctgggctttctggatgctcttaattcagcccctgttccaggcatcaaaattaagaagaaaaaaaaagtactgtcacctacggctgccaaggtatgggctcccagaagtaggtttcagtgacagagtataaaaggtaaagtagaagaaagggcacagcagctaggagttgtcggggaggacaacaagaggcgttttgccttggatatagactggtgcaggtgagacattgtggagacagagtcttcctttatataggaactgttgggggactgtgcctgggaccctggactaattgccttgcccttggctttccagtcagttcattaacttccttttctttcacaatagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacaggtaatctagaaactggttcagtttggggggttttctgaaaggagggatctgggtctgaaacctcttctgcttccagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgaggtaagaggtcatttcctacgtaataggtgtgtttaagggattttgaaaggacttggttgtgcttactttccctcttgcttttcttcccctgccgacagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagaggtgagcagagtggggttcgtgccctgggatgttgagtgcttggacactcctgagggaacatgagctggggtaattacggggtggaggttagaaattactttcagggtctgaattaataacttgactatcattcttttttctctcacctgtgttgttcctgatagtcctcatgagcctgatcctgagccctacgagcccataccccctaaactcatccccctagatgaggtaagtcaatgttctgtgatgatggaagttgtgatggtcattgaattcggtgcatctttcatatgagaatgtctctgttctgtcagtcctgattttttttgttcttctttcaggagtgttccatggatgagactccgtatgttgagactctggaacctggggggtcaggtggctcacctgatggggcaggaggctccaagttgcctccagttctggccaatcttatgggaagcatgggtgctggaaagggcccccaaggccctggaggaggaggcattaatgtccaagagatcctcacctccatcatggtacgcaccctccttccccttttccaccttctgtggagcctccttaagctcgctctcctcactgtctcccattcgccttaccccagttctccacatctacccacttacccctaatctttggcgctatctttcgccatggttgttaccctttctgtctgttgactttgccttcttacatcctcacagggtagcccaaacagtcatccttcagaggaactactgaaacaaccagactattcggacaagatcaagcagatgctgggtaatcttcagggccagccccaggggactgggggaggaagcctgcagtggagttgggggaagcagggtttcaaagatgcagaagaatacagggctgtggccactaggcaagaaatgggaggggaagactggacagagagagcattgctctgccaggttggtttgagagggtcagttggttgcacctaaatgggagatcatgctagtcttctagagtgctcatgctgtgttactcttgttttcattaacagtgccacatggactcctaggccctggcccaatagccaatggtttcccaccagggggtcctgggggccccaagggcatgcagcactttccccctggacctgggggacctatgccaggtaggtggtgagtaaaaggttggaatgggcttatctgcttaatttcagtctgataatagtataggattgactggaaggtgggaggtggtggtttaggttgggagatggcagttcctggtagctgatactgtctctcttttttgtccccttacaggtccccatggaggccctggtgggccagtgggtccacgtcttctgggtcctccaccccctccccggggaggtgatcccttctgggatggcccgggcgaccctatgcggggtggcccaatgcgggggggtccaggaccaggtcctggaccataccatagaggccgaggtggccgaggaggaaacgaacctcctcctcctcctcctccattccgaggcgccagaggaggtcgctctggaggaggacccccaaatggacgagggggccctggtgggggcatggttggaggtggtgggcatcgtcctcacgaaggccctggtgggggcatgggcaacagcagtggacatcgtccccacgaaggccctggcggtggcatgggaagtgggcatcgcccccatgaaggccctggtggtagcatgggtgggggtggaggacatcgtccccacgaaggccctggcggtggcatcagtggtggcagtggccatcgtccccatgaaggccctggcggaggaatgggtgccggtggtggacatcgcccccacgaaggccctggcggaagcatgggtggaagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggaggtgaggatgctccctgtcccccatatgccttttggttgtcccatacaagcttttggggagtgggtgagagtcactactgttggtagctaggcagaacgtgaggtacccgtctctttgatgtcctagtatgcatagcagttcctactctatgcccttcccccaaatccccaagattgtctctgaaagacagttctcaggatgtcatggacaaggggtggtgagggtggcattgccctcagctatttcctgtctaactgttttgccatcgttcccacagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaaaggggtattgtatatcccactgcactgagagggctcaatcagctggatttgagttctggaacacacatcatccccacccctcccccagcgtgggctcaccattcttagtcctttctcaagtgggaccttcaactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttggcatcagttgttttctatgaaaacagtggattggttgggttttgtgcagggtcttgggttagagccaaaatggatttgaggatgagtatttttttttttggttttgtatattttgtacattaataataaacagtggaaagagaagcagcttatttaacccctagtgtgtttggacttttttgagacggagtctcgctccgttgcctgggctagaatgcagtggtgcagtcttggcttactgcaatctctgcctcctgggttcaagggattcttctgcctcagtcttctgagtagctgggattccaggcacctgccaccatgcctggctaatttttttgtatttttagtagagacttggtttcaccatgttggccaggctggtctggaactcctgacctcgtgatctgcccgccacggcctcccaaagcgctgggattacaggcgtgagccaccgcgcccggcctggactgtttttcattttttttttttaaaagccattaccacctgtgttagatacattagtacaaatctgtggaatctgatttttactcctctggagctaatgcttgatctaacagttgctattaagtactggtgaaaaaatgcttcaaaaagtacataaaatactctaggatacagagtagatctcggccacagggctctttcctggttttcatctttctgagtcttctttaacacgcctcgtgtgtgttcctagaacagtcctatcctggctatcgtgccctctaggatgtgttcttggtcatcttatccacattctacagataagggaggaaatcctgaggatgctggagtcagataaaggccattgtcccagctctacctctctacagcctgggtgaccttagccaggttagtgttgggtatcagtggctcatgtctgtaatcccagcacttttgggaggccgaggtgggaagactacttgagcccaggagtttgagaccagcctgagcaacatagggagaccaggtctgtacaaaaaatacaaaaaatattaggcatggtggcacatgcctttagttccagctacctgggaggctgaggcgagaggatcacttgagcctgggagttcaaactcacagctatgattgtaccactgcaatccagccggagcaacagagcaagaccctgtctcaaaaaaaaaaaaaaaaaaaaaagccaggcatattgggtcatgcctgtaatcccatcactttgggaaggcgaggtgggtggatcacctgaggtcaggagttggagaccagcctggccaacatgacaaaaccccgtctctactaaaaatacaaacattagctgggtgcctataacccagctactccggaggctgaggcgggagaatcccttaaacccaggaggtgcaggttgcagtgagccgagatcatgccactgcactccagcctgagtgacagggcaaaattccgtcacaaaaaaacaaagggtaagtatagactgctcttcccaaagtggctctggccaggcatggtggctcaagccagtaatcccagcactttgggacgccaacatgggaggatcacttgaacccaggagttcaaaactaccctaagcaacatagggaagctccatttccccatttccgcgcctggcctccactcttcttaaaccagaaattaaagctgggcatgttggctcacgcctgtaatcccagcactttgggaggcccacatgggaggatcacttgaacccaggagttcaaaactaccctaagcaacatagggaaactccatttccccatttccgcgcctggcctccactcttaaaccagaaattaaagctgggcgtggtggctcacgcctgtaatcccagcaccttgggaggccgaagcagttggatcacctgaggtcagaagttcgagaccagcctggccaacatgaagaaaccccatctctactaaaaatacaaaaattagctgggtgtggttactggcgcctgttatcccagctactcggaaggcaggagaatcgcttgaacccaggaggcagaggttgcagactgcaccactgcactccagcctgggcaacaagagtgaaactccatctgaaaaaaaaagaaaggatacatcactctggggggagtgtgtgtggcagatatggggcagttgaagatattaa

SEQ ID NO: 14241 - DNA, 7804 bp, Human
tttctccatattgataaggctggtctcgaactcccgactgggattacaggcgtgagccaccgcgcctggccaccccctgtatctaaaataaaagttaaaaatttaaaaataagtacataagagaatgtatgctatgagccaagaatgatgcttgcaaaattttgcaagaacaacacttatgaaaatgaaaaataatcactcttcttgttaccaaaaatcttggtagctgcagaaggtgggatctttcctcactgggagtcgcagagccaatacatgaaaccaaaagtgagccttaagcagagcaagctttatttcctgcacaggacttgtaaagaggagagcagctctgccaagtcaacttctccactagtgaggcggctagtgaggggtgagggggctaaaatgtaggattgctctaatgaaggggttgggcattaaaagtgagggggaggaatattcatatgttttatgggaacaggcagtgaacttctccaaactggtaataccgctttccttttggtccttttaggacttcttctactcatcgtcatggagatcgtcaactgtcatggcatggatgggagcgcaatttagcctggaaacgggattacaatgaagcatgaggtctttttgaagtcatttggccggctctcttggttgtaacgagtctcagctggtttgactacaaaggcaacttcttgaagcagatcctgtttttttgtttttgtttttgttttttgtttcttgttttttccccctagacatctcactctgtcgcccaggctggagtgcagtggtgtgatctcggctcactgcaaccaccacctctcgggttcaagcaattctcctatctcagcctccagagttgctggaattacaggcgcgcaccaccacacccggctaatttttgtattgttagtagagacagggtttcatcatgttggccaggttagtcttgaactcctgacctcgtgatctgcctgcctcggcctaccaaaatgctgcgattacaggcgtgagccaccgttcccggcctatacgttgtttattttggaaaaattaaaaattaagttttttttcattaaagatatgttatttccgatcaagagatcaagaccatcctggccaacatggtgaaaccccgtctctactaaaaacacaaaaattagctgggtgtggtggcacacgcctgtagttccagttactggggaggctgaggcaggagaatcgcttgaacccgggagaaggaggttgcagtgagccgagatcatgccactgcactccagcctggggacagagcaagactctgactcaaaaaaaaaaaaaagttgtttctattaacatgtaatgggttattaatattctcttaaatgaattaatatttttaatattttgttttaatatcttttaatttatatatgataaaaattgatacaatccacagaaacaaaatttatttgggtcctcactaatttcttttttcttgttgcccaggctggagggcaatggcacgatcttggctcaccgcaacctcctcctcctgggttcaagtgattctcctgcctcagcctcccaagtagccaggattacagccatgcgccaccacgccggctaattttttggacttttagtagagacagggtttctccatattggtcgggctggtctcgaactcccaacctcaggtgatcagcccgccttggcctcccaaagtgctgagattacaggcgtgagccaccgcgcccagccaggactaatttctaagagtgtgcagagataccgaaacctaaaagtttaagaactgctgattgctgggaaactctgcagtttcccgttcctctcgtaacctggtcatgtgtccttcttcctggatactcatgacgcagactcagttctcattcccaatgggtgtcgggtttctagagaagccaatcagcgtcgccacgactcccgactataaagtccccatccggactcaagaagttctcaggactcagaggctgggatcatggtagatggaaccctccttttactcctctcggaggccctggcccttacccagacctgggcgggtgagtgcggggtcgggatggaaacggcctctaccgggagtagagaggggccggcccggcgggggcgaaggactcggggagccgcgccgggaggagggtcgggccgatctcagcccctcctcgcccccaggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccggtgagtgaccccggccaggggagcaggtcacgacccctccccatcccccacggacggcgcgggtcccctcgaatcttcgggtcccagattcaccccaaggctgcggaacccgcccagaccctagaccggggagagtctcaggcgcctttacccggttctttttcagtttaggccaaaatgcccacagggtggtggcgacgggggcggggcttggtgggcgggactgactaaggggcggggccagggtctcacaccctgcagtggatgcatggctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctgggtaagagggtccacagggctactctcccatctccttcttgggctaggactgtgcccacagctgacagacctcaaacagtagaagaaacagggatggaggccagaataccactcctcccttggatcaggagagggagctgtcacctgaggtacaggagatcctataccacagagtgactctcttaaagggccagacctctctcaggggcaattaaggaatctagtctcgctggagattccatccttcagatgaactgatgagcagttctctttgactcccagtattaggaatcacgggggagtttctctcgtgcctgattctcagccccacaccaagagtttttggaggtctgactccagcttttctcagtcactcagcatccacacaggccaggaccagaaatcccttttcaccttctaccctgggctagctcatcccgattctagaactttccaaggaataagaggctatcccagatccctaagtccaggctggtgtcaaggttttgtcctcttctcctactataattgtcctcttccttctcaggatggtcacatgggtgctgctggagtgtcccatgagagatacaaagtgcctgaattttctgactcttcccctcagagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggagtaaggagggggatgggaggtcatgtctcttctcagggaaagcgggagcccttctggagcccttccgcagggtcagggctgaggcctgggggtcagggccccttacgttcccctcttttcccagagccggcttcccagcccaccatccccatcgtgggcatcattgctggcctggttctccttggatctgtggtctctggagctgtggttgctgctgtgatatggaggaagaagagctcaggtggggaagggagaagggtggggtctgagttttcttgtcccactgggtgtttcaagccctaggtaaaagtgtgtcctgcctcgttactgggaagcaccatccacacacacgagcctacccagcctggggccctgtgtgccagcacctactctttttttttgagacggagtcttggctctgtcacccaggctggagtgcaatggcgtggtttcagctcactgcaacctccgcctcccaggttcaagcaattctcctgcctcagcctccctagtagctgggactacacatgcgtgccaccacacctggctaatttttttttttgtatttttagtggagatggggtttcactatgttggccaggctggtctcgaactcctgactttgtgatctgcctgcctcggcctcccaaagtgctgggattacagtcgtgagccaccgcacccagccgcacctactcttttgtaaagcacctgtgacaatgaaggacagatttatcaccttgacgattgtggtgatggggacctgatcccagcagtcacaggtcacaggggaaggtccctgctgaagacagacctcagaagggcagttgatccaggacccacacctgctttcttcacgtttcctgatcctgccctgggtctgcagtcacagttcaggaaacttctctgggatccaaaactaggaggttcctctaggaccttatggccctgcctcctccctggcccctcacaggacattttcttccaacaggtggaaaaggagggagctactctaaggctgagtgtaagtgcggggcgggagcgtggaggagctcgcccaccctataattcctcctgcaccacatctcctgtgggctctgaccaggtcttgtttttgttctaccccagggagcgacagtgcccaggggtctgagtctcacagcttgtaaaggtgagattctgggggtctgaagtgggtggagggtggggcagaggggacaggactgggttgtggggattttttgattcagaatttttgagtgtgtggtgggctgttcagagtgtcatcacttaccgtgactgacctgaatttgttcatgactattttcttctgtagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtggcactgttttcttgggagagtcattataaagctaatataaagtacctgtactgtggtttgaatgtgtcctccaaaaagcgtgtgttggaaactgaatccacaatgcaaccatatcgggaagtgaatcctaatggctggctggccatggaggttccaactttatgaatggattaatactgattataaaagggcttgaggttgaggcaagttcaacctcttgccctcactcacccacttgcctttaccaagagatgatacagcaaaaagactcaccaaatgccgggatcttgatattagacttcttatcctccagaaccatgaaataggctgctttgctttataaattactcagtctgcgtattatattacagcaacacaagatgggcaacctgatacttaggtttcagttagtggtagatatttttatttcaagcattcctactggagtattagtttcttcataagcccagaatctttgcattttagcaacaacaaataagtcttttttttttttttttttttgagactgagtttcactcttgtcacccaggctagagtgcaatggcatgaccttggctcactgcaaacttggcctcccaggtttaagtgattctcctgcttcagcctcccaagtagctgggattacaggcgcctgctaccacgcccagctaatttttgtatttttagtagagacagagtttcatcatgttggccagctggtctcgaactcctgatctcaggtgatccacccaccttggcctcccaaagtgctgggattataggcatgagccaccacgttccac

SEQ ID NO: 14242 - DNA, 14477 bp, Human
cagcaaatatacaacttctctccattcatttagggatggaatccctgatcttttatttttaagtccttcctgggttttatcccctcccttgctgtcttctctacgacctaatacaaggatcagggccccttcctcctcacctgacttagggtcgccaggttttccattggccatggggggagggcccagaaggctgggtggtcctaagagcagacatgaaaatatggtcatcagaatggattaaaggactgatgattctgttcttaggtgtttttcttgtattacttatttcttaattcaaccagtaaagtcaggtatattttcagcagtcttgggagttctcaccccatctatctgcccttttttctgcaaagctgtttcagggtttgcaaaaagtagatattcaatcaaaggggataatgcaggaaaagatactgacaactttttttcttcaccgtaccgtcgctatccaaaacaacctaagtgtctccagacatgaaccaatccctcaccttaactgctggccagaggactagtttagagaaagctgcacctgtaccttttcagtcaaagtctggatacaaactgtcatcccagtcatcgcaatctgcaacatctctactacccctttcccctactgttctgcggctgcgcaaaagagctctttattctctccacccccgccttctccagaaaggtctggggccgtattgaggttgatggttccagtaagagaactcctggttcaaggctccatttgggagagccccacttccatccctccccagcgcgtgcgcccttcctccttccgttacagccccctccttcgcaccttattagcccctagccccttgcccggacgggcttgacaggcatgtgcacatccctcccagacccctcaccgatgggactcccatcctcctcatctccagtctcttcccgctcgggcagcgggggctgctgctgtgtcggtggctggtgatgattctgcttctttcgtttcggcatcgtgtctgcggcaatggctgcagcgggatttggagggtagtgaggaaggggcacgcggggattctgtttccgcttccggggggtcggtgggcagcaatgctgaggctcccgccattccacttccggaaggttgcggagaacatctgcggcggccgcattccggagccaactgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtgactatatctcccccgtccgccttccatcgccgccgcggcggtaattctgtcgggcccgcccgctgacgtcacctgctagccccgcctcctctagggtcccgggcccctgcggcgggggctgccccggggggcagtcagttgaggcggcgggagctcggcggagggcgggccaggtgactggtccgggccatgccgaggaagaagccattcagcgtgaagcagaagaagaagcagttgcaggacaaacgggagcggaagagaggtcagtgcgggagcgggaggagggggcggggctcgggcttccgcacatctggaaggaggggtgtgcccgctgcacctctggggatcgtgggagggggtcgtgggaccgcgtcaaccctcgcggcctatcgcggaggggatcccccaccccccctacatctggaaggggtggggaaggatggagagttgggggaggggaatccctccagctagcacggggcgccgtccccactgctccctgaaggagtgactccccccacgcacatccgggagggtcccaaatagggtgtctgggaggactgaacatcggaagaagttgagtgggatgaaagggagtcaggccgatgggggagagggtcttatggcccctgagagctggccagcactggcgtcaccggcccctccccgcagggcttcaagatgggctgcgctccagttccaacagccgcagcgggagccgggagcggcgagaggaacagaccgacacctcggacggggagtctgtgacccatcatatccgcaggcttaaccagcagccttctcaggggctgggtccacgaggctacgacccaaatcggtgagggtgggagggggcgctggtcccggctttcccgcctacccggaagtcagagctttgggggaaagcgggctgctactggtgaagacggtgggcctgggatgccacagttctccgctagccactcggctccccacagcgggccacagtcttcctttccagaggggctggagagagttgggcttttagaaggagaaggctgagtattgcctgaaagaaggacttgggggaagtctgacttgagagaggagacttgaacgactctggagagaatggtttgcgaagttgattgtacaagaggggagaaaataggagtttgtggccacaggattgctctggatgtctcggtccctgttcccttagataccgactgcattttgagagagacagcagggaggaggtagagaggagaaagagagcagcccgggagcaagttctacagccggtcagtgctgagttgttggagctggacatccgggaggtgtatcagcctggctcaggtgagtgagagcaagacaggcattgggctggggaaggagtttggaaaggtaaaagccgactgtgaggaaggaggggtctgggatgtactcttgaatcctgaagatttcctcacacttggactttttcctgaattcccagttctggactttcctcgacgtcctccttggagctatgagatgtccaaggagcaactaatgagccaagaggaacggagcttccaagactatcttgggaagattcatggggcttactcctctgagaaactcagctactttgagcacaatctggaggtgacagtgtactctagggacaggagtggggcatagtgacctatggtcaaattggtttgggatcaggctggagagggactctgttttcagtttctcttcctgatcctgtctttttagacatggaggcagctgtggcgggtgttagagatgtctgacatcgtcctgcttatcactgatatccgacatccagtgagtactagggataagggtgggcaaggaggagggagaaaggtttttcaggggcaaaggtcagaggcaagagttgggagacagagaggtatctatcttcctgtctttctaatctctacctagtgctgatgtccgcagttaggaactcagttttttattctcttatagcctgtcattcctcccttggccagctcactcttctcttcaaaacagccatgtcctgtcctttagctcatcacagaccaatagaaaatccaagtgttggagctccagggattctatgaatgcagctggggacttcctcctgcccagcccaaagatgccctttcttccttatctcatttctctagcactgccacatcagttgctacagaacccacctggaatgctagagtagtagttaaggctgtagactgctgctggactgccctgtgtgaatcctagctctgcaacttcactcttgtcctccagtgggagaaagggaggtctgtgaggaccatttaggttggaggtccttaataatatgtacacacacatactcacacgtacatcatgtgcacatcaatatacacaggcatgtttgcacacatgttcacagtcacattaacacacaaacatgcacacatgtgcacgtacttgcatgcatgcatatatgcacgtgtacacacttacatagttgtgcacacacaaaaaagcagactaatttctaccctaacccccatccctgtttccgatcccagcctttacctcagtgtgctaagtgatgctgtttccttgtcttgttttgggttcatttccatctctaatcatgacctataggaagccctctgagactcagaagtattactaacccctgttttgtctttgtttttcagtttgtctggtttatagtttttagcccagagtctgctaccaccagggccttgtctctgagctacacctgctgagtggggagctggaggcagagaactctgggttgactttcactgctccatcctcttatcaactctgtcctaggttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggatcctagtagtggtgagtgggcaatgagagagggcaacttgggagaggtgagttggcaggggacaaaggggagaacagagaggcttattgacaagggggcacctggtcttgggcctaagggtggtgggagagatgagaggcctaagcccgtgtgcccatccttttgtgccctctgatctcagtcttgaagaagagtcggaggcgggggagaggatggactcgggccctggggccagagcagttgctgagagcctgtgaagccatcactgtggggaaaggtatgtggcccttagaggagggctgtaggaggacatgggggagaccaaagatgcagaatcattttgctcacctttcctgaagccaacccctctatggtggatatgtgcaagaggccaggggaagggacagaataaggagcagactgacttggtgggacgagaggcagcaggtagtcaggagcctcagtggcttgctgcctttagccttcccagtacttttcagaagctcagagaaacgtgcgtgattccagggagggtagggtcaaatgacttttgggagattctctgacctgctcttatttaggttggcactgtacaactccagagggtgccagttacataatctgtgcagggcacagtatgtgccatcatgcacagcagccctggggagaacctctttaatcttctccttctttgagcagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtaaggaagtggcagcttgtgcgtggtggcctccaaggaggtacagagttttcatattcggagaagagagagggcgatcaggtctcattaggccccagggtgtctgaggggtgatctctgccagtggcggtgggcaaggcagaagaggcgtctgctgcagtggaaggatcatgacagcctgagttaaattccacctcttctcagctgtgaggtcttgagtaagtgattttgctactctgagtcttagttactttgattttaaaaataaggacattgatacctgagtaaaagaatggatgacggccatgtgtgagggctcatgcctatatagtcccagcgctttgggaggctgaggtgggaggattgcttgagaccaggagctcaagactagtgtgggcaacatagtgaaaccccatctttacaaaagataaagaaaactagccaagtgtggtggtatgtgcctgtagtctctgctacttcagaggctgaggcaggaggatcacttgagcccaagagttcaaggctgcagtgagctatgattgtgccactgcactccagcctggctgatagagaccctgtctttaaaaaaaaagaatggatgtgaggaatgatgggaatagtgttaagagagtgtaagaatgcctgacaaatagtgataacaataataacaattattattgttaaaactcagtatttatatggtgcttactatgtaacaggcactgttttaagtggtttatataaaccatttgaattgtagtaattagtctgtagtacagtgattatcaaatcatagtaggagctcagcaagaattagtattcttctaggttttaaccctttaagtttgttgccaaggagaatctcctcttaagggctttgtctcagctcacagtggaggaaaaaggaatgtatgattaggacccagggcccgtcttcatttagggtgggagaggtaagaagagaccttggacaagttatggtatccgaggtgatattggaaccaaaaagggcccaacccagaataaatttgggagtgtggagtaggtagttgggttccttggaagtgccctgacttatctctgtgtcctttttgtctttggaagaacctgccttactgctgagtgattgctcctctttccagtcatttcacccggctgtcccttccctgacttctgatcctagtctccctgtcacaaggagcctctgttccctctcttagcagcctctgctctagctgatctctattccaggtggtgtgagagggagagtgtttgctgtggcacaggcacccctgagtttggatttccctccagctctcattcatttacccattcaacaaatatgtactgaacacttaaccaggtgccagatattctagggatgggacatactgctgtggaaatggcaaaaaggtctgtagattcatggagcttattttcttgtgagtaaatagattttgtgatccgaaatcatgtaggggcagtgaaggcaataaagcaatgaaaggggatagagagtgactgagaggagaggtgctcagggaaaacctccctgaggagagaactggatgatgagatgaagtgagccattcagaactgtggggaaagggtcttgaggagggaatgggcttggagattctaggaccagcaagagtgcccaggggattggagtatgggagccaggataaagtactggggatgaggtcagcaagatcaccagggcccacatcatgtagagccctgaggctgtgacagccattttggattttattccaagtctcatgagaagccaagggtaggttttgaacaggggaatgataggatctgattttgtttcttataagtttacctcctgagtagagaataaatgatggggggtgggcaagaaagggagcagagagagcagttgaggctatttcagtaatctaggagagaaataagagttgcttagagtaggatgctggagctggaggtggtgagacagggccggaagcatgatatattttgaaggtagagaaaatgagatcgctgatggcttgcagttggcacgtgaaggaaagtgaggataaagaaggacttccaggtttttgtcttgagcaactggaaatactgagatgggaagactgggggagaagcagatttgaaggctttggggaggagaggggaatcagaaatgaaatttcagattctttttaaatatccctagtggagatgttgaataggcagtgggtaagtagtcagcagcttaggggagagaagaggacggaaatttgaatttgggaaagatttaaatttggggaaccattgatggatataagtggtatttaaagccacaggattaggctgggcacagtggctcatgcctataatcccagccctttgggaggctgaggcaggtggatcacttgaggccaggagtttgagaccagcctggccaacatggtgaaaccctgtctctaccaaaaaatacagaaaattagccgtgtgtggtggtgcgtgcctgtagtcccagatactcaggagggtgaggcaggagaattgcttgaatcctggaggcggaggttacggtgagccaagatcataccactgcactccagcctgggtgacagagcaagacttcgtcaaaaaaaaaaaaaaaaaagccatggaattggatgagatgtaggagagaaaggaaatagttggagaagaggaggtcaaggactgagccttaggacaagccagcatttagttgggcaaaggacagtgagaaggaggaaaaccaagggagcgtcccagaagtcaaatgaagaaggtgtttgaagaggaaaggaggaatcagctgtgtcaactgttgctgacaggccaaatgagagaacagagagctgctcagcaggcttggcaatgtgaagatccgtggtttcagtggggtggagaaagccaaactggagtaggcccatgagagaaggtgcaacaacttcacataacattgtgtgaaaagagtctgacccaatagcatccatactgcacaatttcagttctatcaagtttgaaagctgcaaaattaagctgcattgttgagagatacacaggtcataaactaaagagaaatgtaaggagttgatttccttaaaaggataaagcttgcatgtatagagggagaggattatgatcaagaaggatgagtggcggccggtatggtggctcatccctgtaatcctagcactttgggaggctgaggcaggcgcattacttgaggtcaggagtttgagaccagcctggccaacatggcaaaaccctatctctactaaaaatacaaaaagttagccaggtgtggagccgcacgcctgtggtctcagctactcaggaggttgaggcacgagaatcgcttgaacctgggaggatgaggttgtagtgagccaacatcgcaccactgcactccagcccgggtgagggagtgagactctgtctcaaaaacaaaaacaaaaaaaaacaaggacagatggaacatgttgtcacacattgggtggtatggggttcatcaggctgcacatgtatgttctgtgcatttttttgtatgttgtagtttacagttacaaagaagatagcaggaagaaatggtgaaaaaagtaggtaagtcttttaaggagttttcctgcaaagcggacagagaactaggtctggtggtggtcgtcaaaggagaacttttttctccctccttccctcccttcctcctagatacttgcatgtgttgtaaagagtgagcacagtggtacatcttttcttagccacagtcagctgcccaggggcagtgctgaatgggcagagctggattttacagggttgggattttgccaggtgagtaagatagaggggagaagtgggaccagggagttccaggtctgtgaacggccctggctgaggagctggatcatgaaatctgagtcaagtaagaaggaaattgaggacacgagttgggtattgcatagtgttactgtgttaaggtcaggggtcaaagacttactggcatggagtaaccagagtaagtgagctggaaagatgagttgtcagggcagagaggggtgcttggaattgaggctttggagctgtgaagtgacaagatgcaggtattaccatgggagtgggcagctgaggtggggtaaaggagatgctctgtggaagggagatgaaggcactgaagtcagccagaaacacaaaaactggtggtggtgagtgagcagagtggcagtgagccccaaggcttccagttttctccttggacaagtcatcgtaattattattattattttttgagatggagtttccctcttattgcccaggctggagtgcaatggtgcaatctcagctcactgcaacctccgcctcctgggttcaagtggttctcctgcctcagcctcccaagtagctgcaattacaggcgcccaccaccacgcccagctaatttttgtatttttagtagagatggggtttcaccatgttggccaggctggtcttgaagtcctgacctcaggtgatccacccgccttggcctcccaaagtaatcacgctgggattacaagcgtgagccactgtgccaggccaagtcatagtaattatgagatgtggatcactggtactgggtacttactgtactgcaggcactgacccacacaagttgtattggttatctcatttaatcctgaccaccctgaggtagggaggtgtccacactgtaaaatgaagaaacagaggctcagaaagttagttgccctgacatcacaaagctggtaagtggaagggccaggatttaaccctggcagcccagagcgtgatttgtattctgcaataccatttccttaatttctgagccttagttccccttttacctataggtatagcaccaagtcccatcacagagtagaaacctgttaaacgttaattttccttgccttcctcaggtttccctaatgtgggaaagtcctcgctgatcaatgggctggtggggcggaaagtcgtgagtgtctccagaaccccgggccatacccgatactttcagacctactttcttaccccctctgtgaagctctgtgactgcccaggcctcatcttcccatctcttctgcctaggcagttgcaggtatgacggggagggtgggtaagggaaagagagaaggtgggacattgaggaaagtactgagtgctcatttccctcaggttctggcagggatctaccctatcgcccagatccaggagccctacactgctgtgggctacctggcctcccgaattcccgtgcaggccctgctccacctgcgccacccagaggctgaggacccctcagcggaacacccctggtgtgcctgggacatctgtgaaggtgagttccatgtgcctggcttcgccccacctggtttcagctgctcttccttacctgcctcgccttttacccttccctgtctcctttcctctcctcagagattctgccattgatgaagctgctgtccactcacccctagatttttgttgcatagccagtaagatctctggcctggaatgttttggggaaaactggaaggactgtgttatgggagtgggagtataactggtacctggttaatgctttccctttccattattcttttcttcctccagcctgggcagagaaacgtggttacaagacagccaaggcggctcggaatgatgtgtacagagcagccaacagtctcttgcggctggcagtggacggccgcctcagcctgtgttttcatcccccaggctacagtgaacagaaaggtcagagcccagatattcttccccagccccctgctatagcgtaggtaaaagggtgtgggctttgtggccagagagagggtcaaacctggattctgtacctgttggctagctctgttacttaacatctgtgatattttcctgatctgcaaactgagggtaataattgacccttagcatagtgattgtaaagattgaagttgatgtgcacaaaggttctgttcagcaatctgcacataggaagttgaatgaatggatgaatgaatgaatgccagcagctctaaagattattgttattcctagtctttgcctcttccccatctttccttggctttagttcttgctcaaaactctcctccatttttttcttgttttggttccccaggcacctgggagtcccatccagagaccacggagctggtggttttgcagggcagggtggggccagcaggtgacgaggaggaggaggaagaggaagagctgagcagctcctgtgaggaggagggagaggaggaccgggatgcggatgaggagggagaaggggatgaggagaccccaacctcggctccagggtccagcctggctggccgaaacccttatgccctgctgggtgaggatgagtgctgagttcctcgcccagcgccatcttccctcccagtatctttgcttttggactgacctgggggtatctcccctctgccaccccaattgtgaataaagattgtttgctttgtagccccttccccagatgaactgaggtgagagcggctgttccaggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatgtggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttct

SEQ ID NO: 14243 - DNA, 12707 bp, Human
atattggttacacaatgtcatagccaaacaatctctaaaacacagaattcataatccacaggcaggcacacagttatacaatcctactgacacaatttagccgtaattgagcagacacacatggggagtcagatacattgtcacagaactttttttttttagatagtgtctctctctgtcacccaggctggagtgcagtggcatgattttggctcactgcaacctccacctcctaggctcaagtgattcctctgcctcagcctcccaagtagctgggattacaggtgcctgctaccacgccacgctaatttttttttttttttttttttttgagacagagtttcactcttgttgcccaggctggagtgcaaaggcatgatctcagctcattgcaacctctgcctcctgggttcaagtgattctcctgcctcagcctcccgagttgctgggattacaggcacccacaagcaggcctggctaatttttgtatttttagtagagatggggtttccccatgttggccaggctggtcctgacctcaggtgacccaccctccttggcctcccaaagtgctgggatgacaggcatgagccgccccagccagtcaaaacctacactttatacagtcacaccaccggtcacttttacaatatgtaaagtaattatttagtcacagttgcatagctaccagtgcccaaccgtaggggatgcacccagttaaacacagacaaacgcaaggacatggcatcacaggtcctgagaatcaagacacacacatttctcaacagatacacaatcagaatgggtgcaccacaaatgcactacacaaaaagacaaaacaggcggggcgcggtggctcacgcctgtaatcccagcactttgggaggccgaggtgggtggatcacttgaggtcaggagtttgaggccagcctggccaacatggtgaaacccgtctctattaaatataagaaaaaaggccaggcatggtggctcacacctgtaatcccagctactcaggaggctgaggcaggagaattgcttgaatccagtaggcagaggttgcagtgagccaagattgcgctactgcactccagcctgggcaacagagtgagaatccgtctcaaaaaaaaaaaaaaaaaaaaaaaattagccaggcatgatggcatgcttcagtggtcccagctacttggaggctgaggtgggaggatcgcccaggaggtggaagctgcagtgagctatgatcgcgccactgcactccagcctgagcgacagaacgagaccctgtctaaaaagaaaaaacaaaaacaaaacaaaacaaccacatagactcacagaatcacacaagttcacacacacacacacatacacagacacagacacacacacacacacacacacacacacacagagtcacaagtatctacatgtgcttcctgggacagactggcagaaaggtttgctaagatcgcccacttggagctcgtcttccccacaaccagcacccaattagagaactcgagtctggcctcctgggttcaggaggacgcctagtgctcgcgccagaatttctttgtttaattcttgactccctccgcacacaccccctgcaactgaccaaccaggagtgggccgagccctttcctacggccaataagaggagaaacccagctggccaatcggtttcccgcactcgtcttccgcccctaccccgtccgcttcttaaaggggctagcctatctctgtctgggccccccgatttccacaggcaaggctaccttagcccttttaaaaggcagagctgcggagggggccggattctaggaggaaccaatgaaaagcctcactcggcctccgctcctcccacttcttgctgaggtcaaaggcctgcgtcagttgcactgtagcctcggcagtgaaccgggaggtactaccaggtaaggaaggtgcggtggccccagccgtgggtgagaggagctccgctctgacacccccgctcctgtaggtcgccgtcgttgctccgctcgctctgagagagcatggccctgagaggcgtctccgtgcggctgctgagccgcggacccggcctgcacgtccttcgcacgtgggtctcgtcggcggcgcagaccggtcagtgtggggtcgggagtgtggagggaaggagggaggaactgggggtttagggactttccggggtgactttcccgttctgtgcttgcagagaaaggcgggagaacacagagccaactggctaagtgtaaggacctctggtcgcaccgtgtgtctgctgcccctgttcagctgtctgtctgccgcaggtggactctgtcccagaatccgagagctgcccgagcggggtggcagggtcgtggccagggtcagaggcactaaggcagtgagtgcgctgtgcctgcggggccggagaaaagtcacctgatcagtctcgcttgcagctcgcactagccggggggcgacatgggtgttggggggtagggctgatgagggtccgagaagggagggcacagtgatcttgcggactggaccgaggcgaattccccttcccagcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggtgggcgggctggtgggtgccctgagactgctcctccgcctggagccatagccaccccacctcaaggcccctctgtccttggggctggggcttcctgtggcctaggcctgggcctgaatttgggcactggtccctttgcagtttttcatcgggagatcatttcggagatgggggagttgggtgtgctgggccccaccatcaaaggtaggaacaagtatctctccacacactgcagaaccctctgtattctgaaagcctcttcctccttccctccctccctttcttccttccttctctttcttttcttttccttttctttcctttcttcttcccccccaacagagtctggctctgttgcccaggctggagtgcagtggcacgatcttggctcactgcaaattctgcctcccaggctcaagcgattctcctgcctccacccctctagtagctgggattacaggtatgtgccaccatgcctggctaatttttgtatttttagtagagacagggtttcactgtgttggccaggctggtctcaaactcctgacctcaggtgatccgcccacctcagcctcctaaagtgctgggattacaggcatgagccaccacgttcagccttctttttgagatggagtttcgctcttgttgtccaggctggagtgcagtgatgcaatcttggctcactgcagcctccacctcccgggtttaagtgattatcctgcctcaggctcccgagtagctgggattacaggcgtccgccaccacgcctggctaatttttgtatttttagtagaggtggggtttcaccgtgttggccaggctagtctcgaactcctgacctcaggtgatccacccgcctcagcctcctgattacaggtgtgagccaccgttgcccggcccttttcttttttttttttttttgagatggagtttcgctctgtcacccagcctggattactggattacagtggtgcgatcctggctcactgcagtttcctcctcctaggttcaagcaattctgccacctcagccttctgagtagctgggattacaggggtgcaccaccacgcccagctaatttttgtattttttagtagaaatgggatttcaccatgttggccaggctggtcttgaactcctgacctcaggtgatccacccacctcggcctcccaaagtgctgggattataaacgtgagccaccgtgcctggcccctttgtttctttttttagagacagggtctcactgtgttgcccaggctgttctcaagtgatcctcttgccttactgaaagcccccttctttccctaagccacaatttcccagtctgtaaagtggggctgttgtcccaccctctgaaagtggctgtggagatgaaatgaataaacctcagctagggccagcttggtgcctgcctccttgtgtgtccttattcagccctgtctcttgggtcttagctgggcagggccctgttctctattgtcctgctttcccctcctactaccaccaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctgggtgagtggctgcccatggggcctggtggaaggaagacagtctctgaggtctggaactcaagggtggggctgtcccctgagcctattctgtccctatctcaaagatagcataagtggccacctggacccccgccagaccctgggcttcacctggagatctgatccctggccagcctgactgtccccctctgtgaccaccgtcatctccctatgctttctgtgttccccagtccagcccaaagtttaaagtccaccaggttcctgctggccatttgcagtggctcacacctataatcccagcactttgggagggtgaagtgagaagatcccttgagcccaagagttcgaaaccagcctgggcaacgtaaggagaccccatgtctattagaaaaacaaaaaaaggaaagagcctatgtgacctgcgctaagtggacgttggccctcttccgtggtgtctcggaggtgttcagctgcttcaagatgaagctgaacatctccttcccagccactggctgccagaaactcattgaagtggacgatgaacgcaaactttgtactttttatgagaagcgtatggccacagaagttgctgttgacgctctgggtgaagaatggaagggttacgtggtcggaatcagtggtgggaacaataaacaaggtttccccttgaaacagggtgtcttgacccatggccgtgtccacttgctactgagtaaggggcattcctattacagaccaaggagaactggagaaagaaagagaagatcagttcatggttgcatcgtggatgccaatctgagtgttctcaacttggttattgtaaaaaaaaggagagaagggtattcctggactgactgagactatgatgcctcgtcacctggggcccagtacagctagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagcaccagggacaaatcgtgaagagacgcagactgtcctctctgcgagcttccacttctaagtctgaatccagtcagaaataagattttttgagtaacaaataagatcagattcgcaaaaaaaaaaaaaaacccacaaggccctgtgtgaccaggcctctgctgacctttccacctcatctctggccactcatgtgatcctcccagccagacttagctacttgaaattctccagaagtaccaccagttctttacacatctgttccctctcccagcactgctcttccccacagcctcctcctgcttaactcctcacacccttccagtttggccaactccttcctgattccctgggtccccctccccatcttggcattgtgatcatgactttggggtaacctgtctcttgaaagcagggccagatctaacttagttatgaggtctgactcaggggcgagggtaattttttttttctttttttgagacaaagtcccgctccgtcccccaggctgaagtgcagtggtacaatcttggctcactgcaacctgcggttccccagttcaagcaattcctgtgcctcggcctcccaattagctgggattgcaggtgcttgctacccgtgcctggctaatttttgtatttttagtagagatggtgtttcactatgttggccaggctggtctcgaactccagacctcaagtgatccatctgccttggcctcccaaagtgctgagattacatgtgtgagccacctcgactggcctaattttttgtatttttagtagagatggggtttcaccatattggtcaggctggattttttttcttttttgagatggagtcttgctctgttgcccaggctgtagtgcagtggcatgatcttggctcactgcaacctctcctgcccgggttcaagcgattctcctgcctcagtctcctgagtagctgggattacaggcacccaccaccacatctggctatttttttttttttttttttttaagtagagatggggtttcaccatgttggccaggctggtctggaactcctgacctcaattgatccacctgccttggcctcctaaagtgctgggatgacaggcgtgagccactgcaccccgccacgaggataatttttgagtaaggggatgtatcagggaccaggcagccttgtgactttgtcttgtgcctgcagccaagggggagctcctgggctgcttcgggctcacagagcccaacagcggaagtgaccccagcagcatggagaccagagcccactacaactcatccaacaagagctacaccctcaatgggaccaagacctggtaagggttctgggtggtgggcaggtggtgaacaggggcaaaggggcactggtcagacccctcaccgactgttccatccccaggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctgggggtaagtggcagccactttgggaatgggtgttgggtcacctgcggatgcggctttgtcaggcaggctccgtgctggggacgcggctccctgtgcctgtggagcccacacagtggtgattcttactcagccggactcgctgacgtgctgaaaactgcccccatttggtgaccgtctcgctcatcccggctctgcccgggacacatgggcctgaaccagctcagtcatttgactcacagtgcatcttctggcatccgtcagcctcctggctctgagcatcgaacccagatgccaggctgggtgggactgtgtgcaaaccgagtgagcaggcaccgagcttcagtgccagggccatctgtgatgtgaaccacaacctgagtccccctgcgtggggtggctggggaggaggctttccctgcttcagagttggttctgcataggccctcttggtgtctcttgggtgggcctgaggcgccatctcaaccctacagggtcccttcggctgcctgaacaacgcccggtacggcatcgcgtggggcgtgcttggagcttcggagttctgcttgcacacagcccggcagtacgccctcgacaggtgtgtgagggctgcagtgagattctctgggggtgtggggcagcttgggtttcactctctataccatgggtgactccccagcccccacccaccaggcctgagttccttgctctggaatgaccagtgacgtccttctgagcagctgtgggctgagtcaacggcagggccagggcaagcttgggggcactgaggcagcctgggaaggcgtcctggagcagggggccccaggacagggacggggtgggagagtgggcctcccctcgctcttaccctgccattgcccatgtaggatgcagtttggtgtcccactggccaggaaccagctgattcagaagaagctggcagacatgctcactgagattaccctgggccttcacgcctgcctgcagctcggccgcttgaaggaccaggacaagtaggggctgtgtggtgggggcggggggatggcagcggtggctggaggaccttgtgtccttcctggagagaaaggtccttcctgcctggtggccctggggacctgaaccttctgctgtccctcttgtccttgatgggctgggctgaggacagccccactggtccctcattgggagcttggctgcatcagggaatccccaccccgggctaggtttgcttggagcatcgggatgccaggatccccagtccttgttaccctcatgtgccactcccagggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtaggagctggacctcagagggctcactgaggcctcagtgtctggggagggggtacagggaggtgggacggggacaggtctgagtccaactccacctatcactaagtgacagtgtgacctggggcgagccttacccctctgtccctcatctggagttactcacatggggactgtggaagtgaagtgcttcatgcagcacacagaggccccatcaggccttgcgaggggctcccagctctttctcccacatgctcgggaggagggatgttcctgagacaggtaagctccgaaggcagcccaggggtgaggcccgactcctagcaggctggtggacgcaagggagtgagcgaagctacacgcaggaatcaacgctccattttgttaagagacaaaagtcatcttcagatgacggtgtttgcaccctgtaactgatggtgatttacatgggggtccagaaccccttgcttggtgggaagacagatgtggaaaaagatacttaaaaaaaaaaaaaaagtgcaaacccagcatgcgctatgtagaaatagagggaggtatgaggaccccccgggcagagatgcttccagacagagagaacagcaaatgcaggaggggtgccttccctgcgcaccttgcaaccccagatcttgtctctatctggcatctggggggtggggggatcctacaaatgtgagaatgaccctgaggacaagcagcgggcgccatgagatggttttatgcagagaagggatgagtcagatttggtgctttaggggctcggcgcagtggctcacacctgtaatcccagcgctttgggaggctaaggcaggaggattgcttgagcccaggagttagaagttatgatgagctatgatcaccccactgcactccagcctgggtgacagagtgagaccctatctatatttaaaaaaaataggtttgtactttaggaagtaaacagaattggctctaaaaaggaggctacaatctgccttctgcttcaaggagctggggaggagcaaaggatgagacaccagggcatggggtgtgggattctctgggagaggcggcttcagatgggcagaggtcagctgaggcaagtgactgctcttccgatgtgctgtccctcctatccctcccgagggtaagaaagggcttgctgtgtttccttggagctcaggggtgctttcagcctctgtggcaaggaagcgtggccaggttgaaaatcaaacatttaataaactgtggggctgggggtggggagaacttgccaagggtggggagcacgaagcctgggcctatggcaggggctggacttgctacattttgggagttcagcacaaggagctttgggtttttgtttttttctgccaagatgcattatagaaccatgaaaaacaatttctcagtgtggcccaaatggtggcctcacagtcttctcctggagactgtcactaaggcgtgagtctcccggcagctgtcagcattcaccatctctgttggtctgtacttctgaagcagtggcctggggatacatgaaaattgattttaaagggaagttgtgagctatgaaaactccaaaccgactctgtattaatcttgtccaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcggatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgaccccctcacactgagttcacagtgcgccctccctccctcccatctgggggtagtgccttatgctgggtgttggagcagagtgagggagaggaaaataaagacctgcacatctgaccccaaggtgtcaggccggtttactggtaaccacctgagaagtagtttcagccacagaagaaacgaacacgtctgggggctgtgagttgccgggacgtggtggggactttcccctagagtggtctggcccccatctgagtcttaggctctgctgtaaaaaagaaacccaggttagcagtgccggtctgtgccagggctgtgggcagaggggatgatttctgagtggcaggggtgcaagggactttgtcctttctgtcaccacagagctgctcatacaacagtgggacatgacaacggtttggcttctcagctcagacacaccatgttataggggatcacaaacaagatggtgagtgcaccaagggctttgcagggactgtggcctggcggggtcagggctgggtgcctggtttctgttcacatttactcttggctgggccatccctgtcctcttcctcaggcagcgccccccctgtgagtttactcatacctcaggctggagacacaggtctttgtacacagtctccacgctgtggcagacttgtttgagctctgtctccaaatggctgatctttgccattttctgggtgaactcttggagcttttcctggatgatcttgttgtggtcattataaatctgatagatcctctcctctaatttctctgtcagatccgaaacctgttaaacaataagatgtgttctcggaaaatcaaacaagaggtatcacaagacatctgtgttaagtgggtttcttagatttctgcaatttatcttatgaaaatgacaaaataggctgggcacggtggctcatgcctgtaaccccagcactttggtaggccaaggtgggtggattacttgaggccaggagttcaagaccaacctggccaacatggtgaaaacccatctctattaaaaatataaaagctaggacgggtgtggtggctcacgcctgtaatcctaacactttgggaggccgaggcgggcggatcacgaggtcaggagatcgagaccactgtgaaaccccgtctctactaaaaatacaaaaaaatttagccgggcgaggtggcgggcgcctgtagtcccagctacttgggaggctgaggcaggagaatggcgtgaacccgggcggcggagcttgcagtgagctgagatcgcgccactgcactccagcctgggctacagagcaagactccatctcaaaataaataaataaataaataaataaataaataaataaatacacaaatacataaaaactaactgggcatggtggtgtgcacctgtaatcccagctactcgggaggctgagacaggagaattgcttgaacctgggaggtggaggttgcagtgaaccaagatgatgccattgcactctaacctgggcaacaagagcaaaactccgtctcaaaaaaaaaaaaattagcaaggcataggtgacgcgcacttgcagtcccagctactcggaaggctgaggcaggaggatcacttgagcccaggagttggaggctacagtgagtcatgatcacactactgcactccagcctgagagaccctacctcaaaagaagaaaagaaaaacaccaaaaactaaaacccagtgcagtgactgggggtcagattgcctatattttaaatttttttgctttttttgttttgttttcttgcggcggagtttcgctctcattgcccaagctggagttcaatggcatgatcttggctcactgcaacctccgcctcctgggttcaagcgattctcctgcctcagcctcccgagtagctgggattacaggcgagcgccaccacacccagctaactttttgtatttttagtagaaacggggtttcaccatgttagccaggctggtctccaactcctgacctcaggagatccccaccttcagcctcccaaagtgctgggattacaggcatgagccactgcacctggcctgttaaatttttttaagaggcaaaagtatatacagtcgtgtgctgcataatgacattttg

SEQ ID NO: 14244 - DNA, 12707 bp, Human; identical to SEQ ID NO: 14243

SEQ ID NO: 14245 - DNA, 11728 bp, Human
tagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccctcctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagcccaacccctctgggatgcctccaggactggtagatccaagggagaattctgtatttaatgtagtgaggctttgaaagttaacatctttaaatacttctggggtcagattaggtatagtacaacaaagtactcctgcccggagacccaagaatgaaaattgtaggttcattccaaaactccagatccctaaagaatgaatgaggctacaaaatggcaccttgcccccgcttccaacttaaggttttttttctgtgcttggtggcctttcaggtatttctagttttgagtaactttcactttgactgctctacaagggttcctgccaggatacccagaccagaataaaactcatttgggggccgggtacggtggttcacgcctgtaatcccagcactttgggaggccgaggcgggtggatcacctgaggtcaggagttttgagaccagcctggccaacacggtgaaacccaatacaaaaaattatccgggcgtggtggggggtgcctgtaatcccagttactcgggaggctgaggcaggagaattgcatgaacccggaaggcggaagctgcagtgagccgagatcgcgccactgcactccagcctgggtgacagagactgtttgaaagaaaaaattctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgcgggccgggccggagcccgggggcgggagcgacgggtttcgggggtggggtgggggcggggaggctagaatcccaacgggaggggcagggaggacggcgcgggtcggccctgcccagacccccgacctgcccgactttcctggaccccccgatggtctttggcccagcccccagccgatcgggcggcgctcctgcgccggtctccgggcgaggccccacccccggggcgctggccaggccccggctccaatgtcagcgctctcgcggggcgcgggagtcacaagctcggattcctgggcaggccaagctctccaagactgggctccacgttcccagctttgcaggcgtctccttgggacactggtggtcgaatctaggagtaatgaccaggagatactgagtagtgacgacaacaacgatgttaatgataataaacgggtctcagtctttataattttggtggtccgtgtttgttggccgtttactttttatcagtcaccgagtgttgtagtgttgttttaccgctctgcaaaacgggcttgtcattggggacctctgatcattttacagatgtggaaacctagggattgaggaactttgccacagtcacacacaagtaatggcagagctgggattcaaattcggttctgcctcgtgtgagcgtccacgatataaatattatgctgcctttttagtcaaaagtagaattaggacctaattcaaacatactgaatgtctattgggtacttggcgctttttgcatagtgagggagacattgaagtccactttttgtagaaaaggaaacacacattttttgatccgctcaagtgtttggctttgggcaagttaacctgcctacctgtctgtgcctccgttttctcaaatatcaaatgaaccggtcgcctgctggcttccgcctgtaatcccagcacttagggaggcagagggaagaggagcccttgagcctaggaattcgagatcatcctggcaacacagtgagaccccgttctctacaaaaaaaagaaacaaaaatcaataaataaaatgagaccaattaaacgtatttcataggaaacttaaaaggtatgacacatatacatttacagtagcactattggccaggcacggtggctcatgcctctaatcctgatgatttgggaggcagaggcaggaggattgcttgaggccaggagtttgagaccagccagtctaacatagggagacttatctacaaaaaaaaattatttttaattagtctggagtggtggtgtgtacctttagtcctagctactcccaaggctggacaagagtaccagttgagcccaggagtttgaggctgcagtcagcgatgatcgtgccacatcaatccagcatgggcggcagcgagatcctgcctcttaaaattaaaaaatatcactattaactattagtcacttattgtccaaggtagagtgtagagtgggggactgtcccctttattctgttaattatactttatactacccgaaattacattttcttcacattagtgttctctcattgagagcagggacttacttgtgttgagtttgttctgtgctgtggcctctgtgtctaaaacagcacctggcacataatgggtgtttagtataagtaaatactgtgttgaatggcatgatgattgaatgaattcaaatctagcatgctttagatgctgagaaagcttaaaaaacccagcgtgcttgcctttctgccatcagggctggcagtttctctgtcctaaactagaagggaaaagagaatcttggggtctccagtgactgtctgtaccactccctctaggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaaggtgggtgacgtgtgctggctgggagggtgggtggacgagctggggagctggcaaagagcctgtgtgcccaggagagattagctgtgaacagggcggggccacagcggagcgggttgttgggtctgatagggttgctgatgccagctccctttttcttgctgttgcagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcagggtaaggcgggggcagcagtcccagcttgggccctgtcctcctagcacattccagcgtccacataagtggtcccacacacctggagggagggcaagccgccagaagccagggtccgatttctctctcttgaatttgcagctctgttccctcttcaggtagcagcgggcgagaggaagacgcggcctccacgctaggtgggtgggtggtccccagggcagaggtgactgggtgccccagccatcagctgggccttgtctgggtgcgggagggcctgggagctgccctttcctcttcctggtgacctaggctttgctgcttcctccacagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacagggaattcctgggagccccgagccggaacacggttctgtccaggagagccaggtatcggagcagccggccacggaagcaggtgggtgtgcacatgccgcatctgccctccaggtacctgactcacattacactccaccccgcagtgctcctaggagcccggcgtggtgtctgactgcaccccttcctactaccagcaggagagaaccccctggagttcctgcgggaccagccccagttccagaacatgcggcaggtgattcagcagaaccctgcgctgctgcccgccctgctccagcagctgggccaggagaaccctcagcttttacaggtgtggtcccaagggcagagggagctagggcagccaccatttcccttccctgtgggcaccagagtccataacacgtaggaatcgttctaggtccggaaagcaggactaagcacatgcttcccccacgcccctgtgcttcctgtgacctggtgacccccctggtttctcagtcttcccaaccaccttgtaaggtgtgggtgctgtcaacatcacctcccacagaagaagacaccggaaacttagagcagcctgtcattcccagggtcacgcagctggtagtgtgtgtgtctgcctcctgcctcggggtggggtcctgggctggggctctggcttcacatacagatggtgctgcgtaaatgtctgtaaggtggcatgacgtcacccaggacagctgtgccccagttggctctgggacaactctgctcagtgaggctccatcttgcccttgaaggttcacaggaagagtgggggagtggccccctgggtgcaagtaggttcctctgggttctcggtgaagtgcctaccggtcttggctcaggaccctgctgtctgacccttctcctctcacttctcagtcccttgccagctcctcctggtcggtcgtgttcttcatctgcactcagccctccctcatagtgtcctggggccttcagtctgtatgggaacccccaaatctatgtagccagcccaggcctctctgaatgccacactccatggctggcttaattaactctccatcaaagtgctccctagactagacgtctaagacttagaacagacctccccagtcctccccgatctctgcaaggattagcttggggttgcttcagccccaggccctggggatctgctggggtctaccccttgtcctgtctgctcttcccactcagcccctccctgcactccagctctctggtagcctcttcctgggcctctgccactgcatagtcccacagtccacttttcaaccatgaggcagatgactaaaaagcactttcttttctttttttttttgagaggaaatctcgctctgtcgcccaggctggagtgcaatggcgcaatcccggctcactgcaacctccgcctcccgggttcaagcgattcttttgcccccgcccgagtagctgggactacaggcgcccgccaccacgcctgactaattttttgtatttttagtagagatgggatttcaccctgttagccaggatggtctcaatctcctgacctgatgatctgcccgccttggcctcccaaagtgctgcaattacaggcatgagccatcacacctggctgactgaaaagcactttcttctttaatgtgaaaatgatcagatgcatacaatggtagagttatatcagagcttccagatacccaggtagggcacagtggctcatgcctgtaatcccagcactttgggaggctaaggcaggcagaccacttggtcaggagttttagaccagcctggccaacatggcaaaaactcgtctctactataaatacaaaaagtagctgagcatggcggcaggccactgtagtcccagctactcaggaggtggaggcaggagaatcgcttgaacccaggaggcagaaattacagtgaaccgagattgccccactgcactccagcctgggtgacagagtgagagtgtctcaaaaagaacagaaacaaaaatgaacaaatgaacttccagatacctaaatccaacacccagatgagttcactttttttggtttgggggctggtaggtgggaatagagatagggtctatgttgcccaggctggttttgaactcttgggcccaagcagtccctcctgccttgcctcccaaattgttgaggttacaggcgtgagccaccacacccggccaagttcacctttctaaaagatccacagaccacgtcttttcccatgtaactgtcaccaccgtggcttccccctgctctagaaaatgggtctgacttgggccttcctctctggtgtcattgtctgcctcctcccccttcccttgttcgctgttttttgttttttttgttgttgttgtttgtttgtttttgagatggagtttcgctcttgttgcccaggctggagtgcagtggcgtgatctcagctcaccgtaacctccgcctcctgggttcaagagattctcctgcctcagcccccagagtagctgggattacaggcatgtgccaccacgccctgctaattttatatttttagtagagatgggatttctccatgttggtcaggctgctctcaaactcctgacctcaagtgatctgcctgcctcagcctcccaaagtactgggattgcaggcatgaggcaccgtgcccagccccattcactctgttcctgcttctgtttctgagacttcccagatgcatccaccctgggcctttgcacttgctgtttgctttacctggaggaaaccctctgcatctgccatactgcaggcctctccaccagccctcatctgcagttccttcctagccagacacttgcagttgtctggttcatttattggctcactcacttattttttgagagtctcttgcccaggctggagtgcagtggcacagtctcggctccctgcaacctctgcctcccgtgttcaagtgattctcctaccttagccttcttgagtagatgggattacaggcacgtgccatcacacccagctaatttttgtattttagtagagacggagtttcaccatattggccaggctggtctcgaactccaggctggtctagaatcacctgaagtgattataggtgtgaaccactgcagccagcctatttatgtatttatttattcaagacagggtcttgctctgttgcccaggctggagttcagtggcttactgcagcctccgcctcctgggttcagtcttatgcctcagcctgccaagtagctgggattacaggcgtctgccaccacacctggctactttttgtattcttagtagagatgggggttcaccatgttggccaggctggactcgaactcctgacctcaagtgatccacctgcctctgcctcccaaagtgctgggattacaggtgtgagccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtaagaggcctggctgaggggtgactgcaggtgggcaggacccctaccctctcctgctcacacttaacctatcttcccacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactagccctatggtctgtgcctgctggggctccccgcgcccacctgtctgggtcttggggggctggctgggcacaggcaggcatggtgacgggtgcctggaagggggagaggagtctgtgagtccctgcagattgaggcttccggtgtctcctcccccagtgtgtcatttccaggcagtggaccccagcccaacgttacaaggactgcttctccccggcccccaccatcatcaccacagtctgttttggctatacttccccccccaccagccttgtaattggctaattactggagatgaatgttggtaaacagaagccttcttctcttctgccatctgcttctccattatttgcccattgtacaccccccttttcctcccactgaagccccagttagtcagcagggcctagagtccctgtccccttttgagtacagccaagtgggggattccccagctcttaagtattgggggaggaaccaggggacccagagaggcacaccttgagaggacgcagatctcttcaggggtactgccaggtagcaggctttattgggaagggacaaagcctcaggagctgggtgccccagaggctgctgggtcttgagccacagctgcagccaatgcagcagctcgcgcctccttcttccgtttctgtttttcctccttgaggcgcttgcgctccttcttctctaggtcctggagcagctcctggaagcgggcactccttgggtccacctggtagcccaggagctcctgggcctcagcctgcagtcgggccctcctctccttgtcagcctgggccttctcccagttctcccgctgctgctgctgccagttcacaatcatctgtggcatcttggccatgcactctgcgatgtgctgctccctgcaggggagggagagtgggctgtgacactggcactcagccagggcagagcccacccacccatatctcacccataggcctttgcccacgagcctgcctcctcaactcccccagtagattaactgtcaggaaaagcccttgacaagtgaagaaacaggaagagatgatgagaaagttacctgtgcatgaatttgatcacaagggcatgtcaagccccagtaaaccccaggtgccaaagccaaatcagcatttcactgagctgcctactgagcaagccaagtgccactcccatggataatttcacacctttatttcatagacattgctgagcacttcctgtacagaggccaggcccaattctaggcacaggagtgaaagcaagaaagacatttcccaccaatccttgagtttgtagctaccagtcacagccccatttttttcttttaagttcaggggtacaagtgcaggtttgttacgtaggtaaacttgtgtcatggggtttttttgtacagatttatttcatcactcaggtattaaacctagtacctagaggtcatttttcctgatcctctccctccaccctccaaaaagccctagtgtgtgttgctcccctgtgtgtccatgtgttctcatcatttagctcccacttacaagtgagaacacgttgtatttggttttctgttcctgtgttagtttgctagggatgatagcctccagctcccgtcgtgtccctgcaaaggacatgatctcgttcttttttatgacagcctcatttaaggattagaaaagtaaaagaattaagccctataatggtcatctggctgaggaggggcagaaacaggagtccctgctccatgattccctgcctgggtgatcagacgcatgacttcacttcaccaagcctcagtttcctcatctctaaaattagggcaatcccttcttcctcttaaggctattaggaaaacaagaagattaaacaccaggaacacacttgacctacccccttcacgctccaggatgtggcattatctataagagatgcccctggtctggcccgacgcggtggctcacgcctgtaatcctagcactttgggaggccgaggcagatggatcac

SEQ ID NO: 14246 - DNA, 10267 bp, Human
cctctcaaagtgctgggattacaggcgtgaggcaccgcacccggccggaaaaatggctggtcataatttaactactacacctacagtttagcagaattcaggctcctctcatcctcctaacctagtgccctttcattatttctacaaaggcagtttagtttggggaagggctattatcatttaagctataaactaaattcctcccaaaattagcttggggccaggcatggtggctccctctttaatcccagcaatttggcaggctgaggcgggcagatcacttgagcccaggagttcgacaccagcctgagccccaaggtgaaaccccatctctaccaaaaatggtgaaacccagtctctaccaaaaatacaaaaattagctgggcatgtggcgcatgcctgtaatcccagctactcaggaagctgaggcaggaggattgcttgaacctaggaggcggatgttgcagtgagctgagatcacaccactggactccagcctgggcgacagagtgagacaacgtgtcaaaaaaaaaaaaaaagttagcttgaccccactccaggaatgaccaagcaagggcagtttggagattaaaggcaagatggagttggttaggtcagagctctttcactgacataattttctgtcataatttttgcaaaggcagtttcaagccagtactcagattcccatagccctttgccctgccatgatcctttgaggctgaggtgggagaatcacttgaaccccggagttccagagcagcctgggcaacatagtgagaccctcatctctgcaatgaacaattatctgggtgtggtggcacaggcctgtagtaccagctacctgggaagatctcttgagcccagtaggttgaggctgcagtgaactgtgatggagtcactgcattctagcctgggtgagaaaccattatcctgtctcaaaacgacaaaaaacaaacatacagtcacctctttgctagctcaggggatcctggagaaaacgtgcagaatgaaaaaggagagtctgggtggcgtggattacatgcctgtaatcccagcactttgggaggcaagacaggtggatcccttgagctcaggagttcagcctgagccacatggtgaaaccgtgtttcaaaaaaaaaactacaaaaattagctgggcatagtggcatgtgcccgtgatcccagctactcgggaggctgaggtgagaggatcacttgagctggggaggcagaggttgcagtgagccaagattgcgccactgcactccggcctgggcaacagagcgagatattgtccgggaaaaaaaaaaaaaaaaaaggaaggaaaaaaaaaaagaaagaaaaaggggaagatacactggaacacaaatgcttcttaaggggcgcagtggctcacttctgcaatcttggcactttcgggggccgaggctggtggatcacgaggtcaggagttcgagaccagcctagtcaacatggaaaaaccccgtctctactaaaactacaaaaattagccgggcgtggtgtcgggcgcctgtaatcccagctactcgggaggctgaggcaggataatcgctttaatcaggaaggcggaggttgcagtgaaccgagatcgtgccattgcactccagcctgggcgacaagagtgaaactccgtctcaaaaaaaaaaaaaaaaaaaaaaaaaaaaaaaagaggaagaacaaaggtcccaagagttggacccaggttgtagggctggaataaaaaataaaatacaaacttgtgcctgatccagaaacccgggcgggagttgggtcagacagaagagcgtgggctgggattagctaccacgaaaaggaacggtggccaggctccaggagacgctggagcgccgggcccgtcgtgggcgtggtctgggcagactcagcgttgccttttgcctctccaaaacgcagcatcgcgtctcgggggaggagtctgtaccctcgtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggtgagtgcgcagcggggggcctaccatcgccccggggtccggctgcggtcactcaaccgggatggctacctcctcggggaaccctggggtgccttctcttccctctctcctatttctgtgcattctccgacctccaggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccaggtgaagggggccccgggccaactaggggcgaaactctagggctgccctgcctgggaggaatttcacgttgcctccgtttatccgcccgcagctcgccttcctgctctacaatgaccaaccgcctcaacccagcaaggctcaggactcttccatgcgtgggcacacgaagggtgaggcctggattgggggctggggagagactcgggtcccatttttccaaggtaacccctgacgtgcatggggtggtcggggagatctgcactgtcagaccctgggcatctattccccccaacttttttttttctttgtttttgagacggtgggagttcgctctgtcacccaagctggagtgcagtggcacaatcttggctcactgcaatctctgcctctggggttgaagcaattctcctgtctcagcctcccaagtagctggtattaaaggcgcaccatcacaccaggctaattttcatatttttagtacagacgaggtttcaccatgttggccaggctggtctcgaactcctggtttctacctcaagtgatctacccgccttggcctcccaaagtgctgggattacaggaatgagccaccctgcccagccgagttcctatgcatttttccaagctaacccctgacctccatagtggggtgggagatctcccctgtcagaccttgggcatctatttcccctattttattttcttttagacaaggtctcacccagtcacctaggctggagtgcagtatcacagctcactgcagccttgacctcccagggctcaggtgatcctcctacctcagcctcccaagtactgggcctgccggtaccccccaccacgcctggcttttttttttttttttttttttgcggcactctctctccatcacccaggctggagttcggtggtgcaatctcagctcactgcaatctccatctccccagttcaagcgattcttctgcctcagcctctggagtagctgggattacaggtgtgcgccaccatgcccagctaaatgttgtatgttttagtagagatggggttttaccaggttggacaggctgatattgaactcctgacctcaggtgatccacctgccttggcctcccaaagtgctgggattacaggcgtgagccaccacacctggcctactttttgtatttttgtagagtgggcttttgccatgttgcctaggctggtctctaagtcctggttcaagcaatccacccaccttggcctcttaatgtgctgcgattaccggcatgagccgccacacctggcctgtttccctaccttacattactcttggcgttattctggactataagaatttatgcctgcaaaaactgagctcagctgtggttctaacactgctggcaccctctctaagccccgctgcaaactgagggtgttcctgattgcagatgagcttgctgggaggcctggagcaataccctctaattgcctttttttttttttttttttttgagaaggagttttgctcttgctacccaggctggagtgcaatggtgcaatctcggctcactgcaacctccgcctcctgggttcaagtgattctcctgcatcagcctcccgagtagctgggattacaggcatgcaccaccatgcccggctaatgttgtatttttagtagtgatgaggtttctccatgttggccaggctggtcttgaactcccgacctcaggtgatccgccctcctcggcttcccaaagtgctgggattacactgcgtggggcctgccttctttttttaaatttttatttatttatttatttatttatttatttacttacttacttacttatgtttgagatgaaattttgctctgtggcccaggctggagtgcagtggtggatctcagctcactgcaacctccacctcctgggttcaagcgattctcctgcctcagcctcctgagtagctgggattacaggcgtccaccaccacgctcagctaatttttgtatttttagtagagatggggtttcgccatgttggccaggctgatttctaactcctgacctcaggtgatctgtgtgtctcggtctcccaaagtgctgggattacaggcgtgagccactgcgcccgacctcccctaatgccttcttttggtccaggtgtcctgctccttgaccacgatgggggcttctggctggtccacagtgtacctaacttccctccaccggcctcctctgctgcatacagctggcctcatagcgcctgtacctacgggcagaccctgctctgtgtgtcttttcccttcgctcagttctcgaagatgggtaagtcgagtcagggacacaggatgagtcctgggtttactgaccagaacctggaacgatcttgcatttcctcctccccttgtcctccaggcaagcagctgacctacacctacccctgggtctataactaccagctggaagggatctttgcccaggaattccccgacttggagaatgtggtcaagggccaccacgttagccaagaaccctggaacagcagcatcacactcacatcccaggccggggctgttttccagagctttgccaagttcagcaaatttggagatggtgagtctcaaggttgagggttggagagctccttctctgcagacagggtgactggtgtggccatggctgagttcaagtcagcggtagagaccaggtctgtttgggagctataatcacatgatcagtgaacagacctgggttcaaaccctgggttttgctgtgtgatgtataacttcacctgagccttggtctactcatctgaaaaatggggatactgacatctacttaaaaaattgtgaatgaagtggtacctgtaagtcatttgggtgccagaggtggtgcctcactcctgtaatcccagttacttaggaggctgaggcaggaggatcatttgaagacaggcatccaagacaagcctgggaaacatagcaagacctcatctctacaaaattaaaaattagccaagcaacttgggaggctgaggcaggaggataaattgagcccagagtttcagactgcagtgagctataatgactccactgcactccagcctgggtgacagagcaagaccctgtctttatttaaaaataaataaataggctgggcacagtggctcatgcctgtaatcccagcactttgggaggctgaggtgggcagatcacgagctcaggagatcgagaccatcctggctaacacggtgaaaccctgtctctactaaaagtgcaaaaattagccaggcatggtggcgggcacctgtagtcccagttactcgggaggctgaggcaggagaatggcgtgaacccggaaggtggagcttgcagtgagtcaagatagtgccactgcactccagcctgggtgacagagtgagactgtgtctcaaaataaataaataaataaataaatacaaataaataggccaggcacagtggctcacacctgtaatcccagtcgaggcaggaggattgcttgagcccaggagtttgagaccagcctgggcaacacagcgggaccccatctctacaaaaaaaattttaattagtggggcatagtggcacacacgtgtagtccccactactcaggaggctgaggtgggagaacagcttgagcccaggaggtcgaggctgcaagtgagtcatgatcctgccactgcactccagctggggtgtcaaaatgagacccagtctcaaaataaataagttaattaattaaaaacactcagggccggacgcggtggctcacctgtaatccccacattttgggagaccaaggcgggtgggtcacttgagcccaggagttcaagaccagtctggccaacatggtgaaactccatctctactaaaagtacaaaaattatctgggcatggtggagggcgctggctgattacacggtcaggagtttgagaacagcctggccaacatggtggaaccccatctctactaaaagtacaaaaattagccgggtgtggtggcgggcacctgtaatcccagctactcaggaggctgaggcatgagaatcgcttgaaaccaggaggcagaggttgcagtgtgccgagattacaccactgcactccagcctgggcgacagagtgagactctgtctcaaaaacaaatttgggaagggcaattaatattaatgtcatcattcccaggactgggaattgacaactgagctcagaaatatggaaactgtggcagggcgcggtgacacacacctgtagtcccagcattttggaagaccgaggtgggcggattgcttgagatcaggagtttgagaccagcctggtcaatatggtgaaacccctctttattaaaaaattagccgggtatggttgtgcatgcctgtagtcccagctactcagaaggctgaggcaggagaatcacttgaacctcggaggcagaggttgcaatgagcctagattgcaccaatgcactctagcctgggcgacagagcaagactccatgtcaaaaaaaaaaaaaaaaaaggaaatatggaaactgagctgagagaggggaagtggactagggactccctcgcagtggccctgaccctacctgtgccctctctccatcctttgcagacctgtactccggctggttggcagcagcccttggtaccaacctgcaggtccagttctggcacaaaactgtaggcatcctgccctctaactgctcggatatctggcaggttctgaatgtgaaccagatagctttccctggaccagccggcccaagcttcaacagcacagaggaccactccaaatggtgcgtgtccccaaaagggccctggacctgcgtgggtgacatgaatcggaaccagggagaggagcaacggggtgggggcacactgtgtgcccagctgccagccctctggaaagccttccagccgctggtgaagaactaccagccctgtaatggcatggccaggaagcccagcagagcttataagatctaacccttatggccaggtgcagtggctcacgtatgtaatcccagcactttgggaagccaaggagggaggatcacttgaactcaggaattcgagaccagcctgggctacatagtgagaccacatctctactagaacttaaaaaaagttagccaggcacggtgataaatgcctgtagtcccagccactgaagccagaggatcgattgaaccagggagatcatggtcacagtgaactatgattacgccaacctgggtcacatagcaagactctgtttcaaaaaaaaagggggggcgggggacgggtgggtgcagtggctcacatctgtaaccccagcactttgggaggctgagatgggcagatcacttgaggtcaggagttcgagaccagcctggccaacatggtgaaaccccatatccattaaaaatatttaaaaattagccagacatggtggcacgcgtctgtggtcctagctcctcgggaggctgaggcaggagaatcgcttgaactcgggaggcagaggttgtcatgagctgagctaacaccacggcacttcagcctgggtgacagaatgagactctgtgtcaaaaaaataaaaaataaaaaatctaagggctcaggaaccagtttggacttgattttgaatcccagttcatccccttcctagctgtatgaccttgattgtgtgccttaaccgctctgtgacacagtctacctgtctgcaaaatgggaaacataatacctgccatcaggattgttgaggagtaaataaatggaaattggtggacgaggctgttaaccttctcttcaggtgggcgctgggacacaagagcatcgcagcttcaattctccccctaaaggtttgggggcagttggtgcagaggtgagaccagaagtgggaccacaggaggtgtctatccaaaattccctccactctccatggtaaccagaactggagtcccacctcccaaaaagcacctgggcatgggggtggggtcgtgtgatgtctcgccttgcctggagaggagtgagccccagaaaactcacgcagcacggacgcactttatttatatgtgtacatatgtatacggaggctgtacagcgcggggccgatgacccccttggctatggtcccgggggtgcgggactggacactccttttttggtcaggcctgctgggggcacagcttcagcagggcaccgggaggtcagccccacttgaggcttggtgcctgagcccaagagggatgcgggtgggactggggtcactgcactgctgggtgcactgcacttcgctggggctagggagggtgtctggggctccggggagagctttggggaggcgggcttggagcgaggaccgctcagcgtggtgcgctcctccaccacctccaacacccagcgctcccggccccggggggcctcgggcacggaaggcgccaggggtgcgggttcctgcaaccccttggagtccgcgcccagaggctgaggcaccacagccttagccccgggccgcgcaggctctacgacaatgggtaccaggggtgtgcccgcctcgccagagctgctgcgccggcctgtctcgtgttcctgcaccgggctcagcgccgccttggccacagccctggccatcccgccagtgccatcctccgtctgcacgctctgatgccgcgtgcagccgacgtcccgctccagggtccggccaccgggggtcgtcgcgcggggtggggtgcacgcctcggcgccccccggggattccttctccttgctcgacactggtggcctggaggcaccctcgggcagcaacgggtccgcgcccaggctcaaaggtgactcctgtcggcccaggcggcggacggcgacctgccggggcgcgccaaggccctcgactgggggcgtctcaccgtcggactcggcaaggctatgcagcgccagctcgccatggaagtccttgcggaaatccgggtggcccacctcgaggctgtgtttgcgcagcgcgcccttcttgtccgcactcaaagaggctcccagcttctcggccgactgcacgcgcttgaggagcggcgagcgagggggctcggcactcttggggcgcgggcgcacgacgggaggcgatgagtgcagtttggccgggaagctctgagtagtgtgcgagctgcccaccgtgtggcccggcagtggcggcggtgacgcctgcgtgggggacggcgtgtgtgccagcggcgatagagggatgttgccggccgacttgcatcgcgcagagcggtactggcgatggagctttggcgacagtccgtgcagcgtgctgggccgaatgtggtgcgacgccgacgacgcaggcgagttgggcgtgctcgaggctggggagctgctctgggatgaggcgcctgcgggagacaggaggtgaagcgagtgagtacagcccaagcaccagccaggccaccccgcgctgctcggtccccgcgcaggtgcaggaggtaatacctaggtaggcggagtcaggcgtggagcggtagctgtgcgtgggcgagcgcgccggcagcccgtgcgtaggcgagcccgggagactatcgctggatgacagcgagcggttcagcgacgacagcgagcggctagtatgcagcaggttcgactgcttcgtgatcttccggaagagggagctgcgcttcttgctgcgggacagggagggggccaagcgtccttgacctggacgccagagctcagggctcctcccatttcacggcctcacaacggtaaccacccaccccttctggcccttccctctcca

SEQ ID NO: 14247 - DNA, 9879 bp, Human
gccactgtgccccgtgtgtttttagttaatttccacaagagtccttccttcctctcttctatcatgcagcaagtactttttaagcctgttctgtgccaggtgctgcaggtgacactggaggatgcgaagtgaacaaaacaggcagtgtctaacctcaagtaggaagcgccaagcccacaggtgcctgacacaggaacaggaggaagggtcagcaagaggcctgggatggtccccgggatcctcatgggggggaccagactaggcaatactgaatactacctagaggaagtggtagaaccccaacttcccagttcattctcccccgtctttttttcgagatggagtcttgctctgtcacctgggctggtgggctggagtggagtggcgtgatcttggctcactgcaatctctggctcccaggttcaagcgattctcccacctcagcctcccgagtactgggattagaggcacccgccaccacgcctggctaatttttatttatttatttatttttatttttagtggagatgggttttcaccttgttggccaggctggtctcgaactgacctaaaatgatctgcccgcctcggcctccccaagtgctgggtttacaggcgtgagccactgcgcccggccaccatttcttttttttttttttaaccagagacccttgccaagtcattccccccactccactttattttccttttcattttttccttcctctcttttctgagtcacaaccattagccaggaagcaccccctccccaccctctttcctggatccccctcattccctccttccatagtccactcccgcgctcccaggtccagggcttatttgcccagagtttggaaaacccccagctctccttcctcctttctacagcgtgggggcagggtactggtgccagtcacgtgcctctggcttctgaagaagactctagactggggtcggggggtgggtcctgcccatctccctagcatcttatcgtccctaccatctgtgtcttttttccctccccaaacggaaccccctgccctctcgcctgcctatagccgtttaattgcaaaagccaggccgtttgtgggagaccacagacagcgacccccttcatttaccggttgagaggagggtaaaggggcggctgcaatctgggtaataaccctatccccactccaggagtcacagtcacatcgttaagccttcctcccctcttgtcccaggacagctttaaaaacgttaaaagcatttctgctgggtagcatctggccagggtcgccccctctgtctgctcaggaacgtctgtcacttcagagagcttaagtgacttgccccggtcacacagcagcagtccgataggctgccagggctctaggggcagaaggaggagagggctggcattcttcccaccggcccgcgtgactgtagcaccggggtgcagcgaagccccaagggccccaatccgtgagctctctcccatcccaggcaggggtgggggagcagcagtggggtgctggttctcaaatgcaagataagagctggctaagaaagccttgcccagcccctccacctagagggaatgggagggagagaagctgagggcagggtcccggtcccgcgtggagacagctgcgctcccgcggtttctttaaacgcccagatgggcaacgacgcgcgcggacgagggcggggttgggttcaggtctggtcacatgacctggcctgaggtgctcgcggcccccaccccaccagtgggcgtcccccccacgcgtggtcgaccatcattggtcggtggtgaggccaatagaaatcggccatctgggaacccagcgttccgaggcgcagcctaacatagtgaaccgacgaaggtccaatggaaaaagacggccatgggcatagaccaatgacaaagtggcaggggcgggcccaagggctgggtcaggttggtttgagaggcgggtgggtataaaagtgcaaggcgggcggcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgcccggtgtggtggtgggcgcctgtagtcccagctactcgggaggctgaggcaaaaggatgacgtgaacccgggaggcggagcttgcagtgagccgagatcatgccattgcactccagcctggggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagcttgccgcgccaaataatgtctctgtgagactcgagaactttcatttttttccaggctggttcggatttggggtggattttggttttgttcccctcctccactctcccccaccccctccccgccctttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccctcctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagcccaacccctctgggatgcctccaggactggtagatccaagggagaattctgtatttaatgtagtgaggctttgaaagttaacatctttaaatacttctggggtcagattaggtatagtacaacaaagtactcctgcccggagacccaagaatgaaaattgtaggttcattccaaaactccagatccctaaagaatgaatgaggctacaaaatggcaccttgcccccgcttccaacttaaggttttttttctgtgcttggtggcctttcaggtatttctagttttgagtaactttcactttgactgctctacaagggttcctgccaggatacccagaccagaataaaactcatttgggggccgggtacggtggttcacgcctgtaatcccagcactttgggaggccgaggcgggtggatcacctgaggtcaggagttttgagaccagcctggccaacacggtgaaacccaatacaaaaaattatccgggcgtggtggggggtgcctgtaatcccagttactcgggaggctgaggcaggagaattgcatgaacccggaaggcggaagctgcagtgagccgagatcgcgccactgcactccagcctgggtgacagagactgtttgaaagaaaaaattctcatttggaagaggcaaaatgaggtttttacagaagaaatacaaatgtctgtaaccagtacaggtacataaaaactttgttaaaaattcatttgagcgtgagagtggggacaccagagtcactttgcagccccgtgacgtcaccgataacgggcatggcgtcactcaggagaccacgtgtgcgggccgagcaagaagccccgcccacagcgcggagtttagtctgcgcgtacctcgctcgagaacgcgctcgtgcgcatgcccacaaaggccaaggagggagtgcgcaggtcacgtgcgccggtggtcagcgcgcgcattgcctgccccggaagtggtcggcgcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgcgggccgggccggagcccgggggcgggagcgacgggtttcgggggtggggtgggggcggggaggctagaatcccaacgggaggggcagggaggacggcgcgggtcggccctgcccagacccccgacctgcccgactttcctggaccccccgatggtctttggcccagcccccagccgatcgggcggcgctcctgcgccggtctccgggcgaggccccacccccggggcgctggccaggccccggctccaatgtcagcgctctcgcggggcgcgggagtcacaagctcggattcctgggcaggccaagctctccaagactgggctccacgttcccagctttgcaggcgtctccttgggacactggtggtcgaatctaggagtaatgaccaggagatactgagtagtgacgacaacaacgatgttaatgataataaacgggtctcagtctttataattttggtggtcc

SEQ ID NO: 14248 - DNA, 8991 bp, Human
ctacctcggcctaccaagtagctgggactacaggcacatgccactgtgcctggctaattttttgtattttttgcagagacggtgtttcaccatgttgcccaggctggtctggaactcctgggctcaagtgatactcccatctcagcctcccaaagtgctgggattacaggtgtgagccagccaccatgcctggcctcatttaatatttccacgagtctcaggtggggaaaccaagacccagagacagcaagccaaccttccaagctcatatacggggtaagtgggccagaggaactacaacctgacacttccaggctgtgccagcctgcccagttgtgagtgtcctacaacatccttggtgcccgccatttgaagctgacttctgtcttcaggggtgtgaccatggccctacctagaaggcacaatgccacctgacagcagggttgtcaagtgataaatggcataattgacataatgaaggtaagtaaatctcccggtgctgtgctagcatatacaaaccaatttattatgatcagtttgtttatttatttaatttatttattttgagacaagatcttgctctgttacccaggttggaatgcaagggcataatcatggctcactgcagcttcaaactccttggcacaaatggtcctcctgtatcagcctcttgagtagctgggactacaggcgcatgccaccatggcaggctaatttattttttatttttatttatttatttatttttgtagagtagggggtctctccatgttgcccaggctggtcttgaattcctgggctcaagcagtcctcccgcctcggcctcccaaagtgctgggccatcaagtcaggctaattttaaaatattttttgtagagatggagtcttgctgtgtgggccaggctggtctggtctccgagaccaagggatcctcccacctcagcctcccaaagtgctaggattataggcgtgagctaccgcgccggccactgtgatcactttaaagggctctttactgaatctgcccctttcccctatgagacagatcttatcccaactccgatcttatcccaactcaccgctcaccaaggtctgacacctcctaccctcccacacccatgtctctgccacacctcaccgacctctttccatttctccttcaggacttttcaccttggcatttgctattccctcttccttggacattctttccccaaatctttccatatgggactttcgcttgtcgttctcgctgcactggtcacgggtcttctgcaatcggaccctctctgatttcccaagcttgcccgcccccttctttctctgtctctgcccttcctggcacctatccccgagtgacagcttcagtgtcctgcccacaccctctcttcccctgggagctgctttaaagcagtatctatttcaatatatccaagagtaaaccgagccttagagaaaagtaaccagcccaaggggacgcctccagtgcggagctgggtggagatttgcagcccgccgaggaaggtccctttgcagccagcaggagaagtagggcaacggggagcctttgggcatcgtcatccccgccgcctgaggttaccctttagatgctgcagcctcagctgctcccagctgtcaccttcgccctgctgccctaagtactgatagtcctggtagaccagggcaggggtcgccagctgcaggagtagcagaggcgccagcagcagcgcccccggggtccgcgccatgctggactccaacggcccccaacgcgctcccaggcggagtcgtgcgcggagtctgcggcgggcgcattacccacgcgggcaggtgcagtggtcccggccgaaggcaacgcgtctccccccgccgcccgcaggcgcatggacccggccgcacgctcccccgcacctgcgggcgcagtggacccgaccgctccgctcgtccgctccctcccccgcgccgtgcacgtcttggttcgggccgggcataaaaggcttcgcggcccagggctcacttggcgctgagaacgcgggtccacgcgtgtgatcgtccgtgcgtctagcctttgcccacgcaggtatgaacacccggagtgcacctggcgggaggacccccttcaggctgctttggcccgatcctgactttagtgctggccgcctttgctttccatccgctatagtggcctcctttgtccttgcgggggaaaccgaggccacagccttgcagcgcaggcctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaaggtgagcgccgcccggagggggcccaggtagaagcggggccgtgcatgagagaagctgggccctaactcctctgtgtccctcctccccagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttgacaactagttgcctggtatatagagttgcagatgcaactcagatgcaactctatctactctatgtacttagttcccaggagggaggctgtgctgccctatttcatgaagatggaaactccagttcaccgaagtgaagggctgtaccccatgacacagctagaggaggatggggactcttaacacaggctctctgctgggtgatgctgcaagttacaagcacatgtgaagccacttagctggagctgtgcctctcaaactcagtcttcccagccatggggatacagtccttgcacccaacccagggtggggtgggtgaggctcccagcggcctactctaaagccccttatctccggcctccagtgcttatcacattgggcccacagggtgaggaccctgctgtgccaggcatcctgaggccccaactctgtctcccctactcccaggatcaacaccccccggaaagagggaggcttgggccccctgaacatccccctgcttgctgacgtgaccagacgcttgtctgaggattacggcgtgctgaaaacagatgagggcattgcctacaggtactgtgggaccctcagcccggctcagggagcgccctgccccccattcctgtgatgctgggaccactcctgtacaatgtcttctctgcccccagccctgtggctagcagcgggtggttggtagtcccttccttgtctctggcagtgggagctatcagctcctcactgggaaccctgatgtcttcaggggcctctttatcatcgatggcaagggtgtccttcgccagatcactgttaatgatttgcctgtgggacgctccgtggatgaggctctgcggctggtccaggccttccagtacacagacgagcatggggaaggtgagcagatacacacatgacacatgggtacatactgagcgcctccgtcactcatgcaaacattcactgcctgtcctcttacctgtccagatgggtgttagggccccaaagaagattcagctcagggctttgtctgcaggatgtttctaatgtggtaggagacaaataacgcctgacattcaaccaaggtggacaaaggggccgggctcagtggctcacggttgtattgccagcactttgggaagctgtggcaggtggatcacctgaggtcaggagttcgagaccagcctgaccaacatggtgaaaccccgtctctacgaagaacacaaaaaattagctggccgtggtggtgcacacttgtaatcccagctacttgagagactgaggcaggagttcgcttgaacccaggaggcagaggttgcagtgagctgagatcgcaccgttgtactccagcttgggcaacagagcaaaactcagtctcaaaaaaaaaaaaaattagcttggtttgtgaagcatgcctatagtcccagctactcaagaggctgaggctggaggatcacttgagcctgggaggtcaaggctgcagtaagctgtgatcgcaccactgcactccagcctgggtgacacagcaagaccctgtctcaaaaaaacaaacaaacaggccgagcgcggtggctcacgcctgtaatcccagcactttgggaggccgaggcgggcagatcatgaggtcaggagtttgagaccagcctggccaacatagtgaaaccgcgtctctgctaaaaatacaaaaaaattagctgggtgcggtggcaggtgcctgtaatcccagctacttgggaggctgaggcaggagactcccttgaacccgggaggaggttgcagtaagccgagatcacaccactgcactccagcctgggcgccagtgtgagactccatctcaaaaacaacaacaacaaaaaaacctgtaggggtggggcagagggacaaagatgggactaaaggagccaaaaagacaggaagatgctgtgtctcatgcctgtagatgctgtgtctcatgcctgtagttccacctactctggagagtgaggcagaagattgcttaggcccaggaatttgagtcgagcctaggcaacatagcaataccccatctctttttttttttttttaagagatggggtattggttaaaaaaaaaaaaaaaaaaaaagaggccagatgcagtggctcacacctgtaatcccagcattttgggaggcctaggtgggtggatcacctgaggtcgggagttcgagacaagcttgaccgacatggagaaacccagtctctactaaaaatacaaaattagcccagcctggtggtgcatgcctgtaatcccagctacttgggaggctgaggcaagagaatcgtttgaagctgagaggcggaggttgcagtgagctgagatcgtgccattgcactccagcctgggcaacgagtgaagcgaaactccgtctcaaaaaataaaaaaaaaaaagaggccgggcacggtggctcatgcctgtaatcccaccactttgggaggctgaggcgggcggatcaagaggtcaggagatcgagaccatcctagctaacgcggtgaaaccctgtctctactaaaaatacaaaaaaattagtcgggcgtggtggcgggcgcctgtagtcccagctactctggcggctgaggtaggagaatggcgtgaacctgggaggcggagcttgcagtgagcagagatcgtgccactgcactccagcctgggcaacagagcaagactccatcttaaaaaaaaagaaaagaaaaaaagaagaaaaaggagagctgggtggcaaaaagaaattgaagaattaagagtaggaaaaacaccagctagaaaatactgaacttggccaggtgtagtggctcacgcctgtaatcctagcattttgggaggccaaggtgggtggatcacctgaagtcaggagttcgagatcagcctgaccaatatggtgaaaccctgtctctgctaaaagtaccaaaaaattagcagggtgtggtggcgggcacttgtagtcccagctactcaggaggctaaggcaggagaatcacttgaacgcgggaggcagaggttgcaatgagccgagatcacgccattgcactccagcctgggcaacagaggaggactctgtctcaaaaaaaaaaaaaaaaaaagaaagaaagaaaaaagaagaaaagaaaaagagaaaatactgaacttggctaggcatggtggctcacacctgtaatcccagcactttgggaggccaagacgggcagatgacttgaggtcaggagttcgagacaagcgtgactaacatggtctctaccaaaaatacaaaaattagccaggcgtggtggtgcacctctgtaattccagctagggagtctggggcatgagaatcgcttgaacccaggagggagaggttgcatgagctcagatcatgctactgtacttcagcctgggcaacagagcaagactctgtctgaaaaaaaaaaaaaagaaaaaatactgaactgggcttggagggtttatcttaatatccacattcctgggcctggaccacttgcttccagcattttcttctgcaacacaggcccttgctttgcttcaccttgaacctggggctgtagccttcatgtgcatccttgtgtcttcccacagtttgtcccgctggctggaagcctggcagtgacacgattaagcccaacgtggatgacagcaaggaatatttctccaaacacaattaggctggctaacggatagtgagcttgtgcccctgcctaggtgcctgtgctgggtgtccacctgtgcccccacctgggtgccctatgctgacccaggaaaggccagacctgcccctccaaactccacagtatgggaccctggagggctaggccaaggccttctcatgcctccacctagaagctgaatagtgacgccctcccccaagcccacccagccgcacacaggcctagaggtaaccaataaagtattagggaaaggtgtgagtctgtgttggtgtgctctgtcctttcgtcctcccctgcaacccccttccttcttcaggctcaggcttgggaaactgaccctgtggttgctcatcttcgccacacggtggcggtcttatcacatgcttagtgcctgctcttttcctgcttgcgctcaaggcggtttcggaggggtagggtatgccgtttgtcccttgcaaatcccaggatgccctacatccagaaatctggccatgcaaggcaaagcccacattttgtcaccagccagcctgggttcaaatgccgtttaagagctgtgatcgtctctgggtctcttcagcagtaaaatgggactgcaaacccagatcaccatgcacgtggtaaaatttgtaggagataagttatgtgaagctcggggctgaggcccctgtgtagggcccagttcctagttcctaagacggcttcctcgagctgaaaggaacccagcccagtgtagtcttatggggaagagggtggggacccagtcttaagagcagaaccaagaatgagagcctgagctacgtgcagagtgcagagtccctgctgtgagctctgccccaccccaggctggaaaggttgcctgtctgcccctggggtgggagggtggcagttaggctagaaggcaggtattagcagcaaggcagggttcccaggggtgcagtttaatattgtgtgcgttcaggaaagtagttttgctactctatgccccaatttcctcctacagaacagggctaatatgctcatttaatccacagatccactattaatgctggtacccacctaataccctctaagggtcactcatctcccttggaatttaatctacactcctccccaaggcccctgctcagtctcccttgacatctgccctgttgtggttcactccattccagacaggctggcttcctgctgttctttcacaggctcacctggctacatgaattttgccatttaagagctgctcccaaggccgggcgcagtggctcacgcctgtaatcccagcactttgggaggccgagacgggcggatcacgaggtcaggacatcgagaccatcctggctaatacagtgaaaccccctctctactaaaaatacaaaaaattagccaggcatgttggcaggtgcctgtagtcccagctacttgggaggctgaggcaggagaatggcgtgaacccgggaggcagagcttgcagtgagccgagatcgtgccactgcactctagcctgggcaacagagcgagactccgtctcaaaaaaaaaaaaaaaaaaagctgctcccagttgagcggggtggctcaggcctgtaatcccagcactttgggaggcccaggcaggcggatcacctgaggtcaggggttcgagaccagcctggccaacatggtgaaaccctgtttctactaaaaatacaaaaattagcctggcatggtgatgcacgcctgtagacccagctacttgggaggccaagcaggagaatcgcttgaatcctgtgggtggaggttgcggtaaactgagatcgagccactgcactccagcctgcctgggtgacagagggagactccatctaaaaaacacaaacaaacaaacaaaaaactgttacctctgatgctgttgttacccaggattttctcaggaccccacttcttcaaatctgttgaaaagtcatggccaggcacgatggctcacgcctgtaatcccagcattttggaggccgaggctggcagatgacctcaagtcaggagttcaagaccagcctggccaacgtgctgatacccagtctctactaaagatacaaaattagcagggcgtggtggcaggcacctataatcctagctacttgggaggctgaggcaggaaaatcgcttgaacccgaaaggcagaggttgcagtgaaccaagatcgcaccactgcactcaagtctgggtgacagagcaagaatctgtctaaaaaaaaaaaaaaaaagtcactgcaggagaag

SEQ ID NO: 14249 - DNA, 12995 bp, Human
aacagcgaggcctgctcccgagagtggccgaaggggtcaatgtgccaggccacacggggtcgcccatcattgccaaatgtgtcctccagaaagcgcagcccaagtgtcatctggtccacgatggcaccgtagtgggtggctgcctcatcgttcatcacccagccaccattggcgaactccaggcgccctgtgccaggacaggcaaggtcagggtcagcggtcagagccaggagtgggagtagggtgggtgatactgggaatgtgaaagcctgcctgtgtacacatttctggcggaaggacaagaggggtcgctcccaggccatagttcccagatatgggaaagaggccccctgcatggcaggcttcccagaggatgcacagcaggtggggctttgtgggatgtataggaggtctccaaatggagagtccaggcaggcggagcgacacgcatgttatacagcttgcacgtggcatgacaaatctcagaaaccagagatgcagaagcagaagctgggctgggcttcctcttttcacttccttggggtaggctcaccctggcgcacaaggtctcgcacgacttcctgtgtggcatttgtctgctggtgccaccaacgggagaagaaggcaatctccacgtaaatgaagcgacgggtgggatctgccagcaaggcagagatgaccgagtccaggatgtactgcacaccggcgtgctggatgtcattcttgactgtggataacagggataaggctctcagggaacagcagagccaagggggttattcctagacagaggagcccaaaccctggatattagggtagcactggccccaccctaatgtccaggacccagagggattacagggaccatggggatcccagggaccagtccccatcctctactcacttccataaaagtactggtccacggttttgagccagcccacgtcatcatgtgtgtgaggcagcaggtgcacgttcagcatgttcggctgcactgtggggcatgtctgcacagggaccccaaacacacataccttgtcaataacccccgaggtcgggggctgcagagtaagtcttgatctagaggtgagtgactcagagaggcctgatctcgcctatgtgcagaggaggccaggccctcccaggcaggacacacacatacatagttgtgctcatagatacaactccactttgcacaaccccacagggcagctctcattcacactccgggaaaataataatagaagtagctgatgtttgttcagcatttgccgacagcagacggccaccgtgggaggtggggtgatgttatccccagtttccagatgaaggcactgaggcttagagaggataggtgacttgcccaacgtcacacactcaggaagtgtaagagctaggctggaatttcaggcagactccagagtcccagctctcagccagcacctccccccacacatacactgctcaccccctgccacctcctgcccctccaatcccacagttaagtgcagacaaagtctaggcaagcatcccggagacacggaggcaggtacaatcagacacagtcctatactcagatgcgcacagccagacctcgcaatgacacaaagcacgcactcagaccacactgtcatatcatcagccattcactagacacccacaggacagacccacccacacctctagactgtattctgggtttcactctgcctcctgtacgtttcagctcggaggccccactcacctcgtatcccccggcccgagcaccggcagccgccagcaacaaaaggaaaaagcagagaggcgggagcggtggccgcagggcgcgggacatggtccaggggcctgctgagtccaggcagccgcgagcgcagacccccgaagcccgcgcgtaggcgcccatggctcagcagcttcctcctggggttccccggccctggaaaggccgggcaaacgccccgcccccagacccggccgggccaatcggggtggggggcggggccagggcgcggtctggaggctcacgggagagaggctgtagccctgggcaatcccgggggtcgttacaggaaggtaggaaaatgccaccctcagggcactggttgggctaaaggtgacactggcgtctcacgggctatgaagacggaatgcctcttaatgccggaattccaagacggaatgcctcttaatgccggtaggagcagaagtgcttttcctaagggggccgggttttcctagccggtgtagtgtgtccatgggaatccagggtgtccgtcccatggaccttcagcgctagggtcctggaaggacctagcttgcctaagaggaggatctgatgaagagtcctatactgtggggattgggacgttgggtaaatacccctggagtaccagggatgggatccagcctggttgagaaggatccctgggtgttccggagagaaaagagggtctgacaagtggggaaggaccccgagtctttcatgcctttcccaattcctaccagttcattctctgataagaaaacaaagcccagggcaggcgcagtggctcaagcctgcaatcccagcactttgggagggccaggctggtgaatcacttgggcctgggagtttgagaccagcctgggcaacatgggttgttttgtagagacgggtttgaaaacacaaaatttgtaattttacacaaaatgtaaaaatacaaaaattagctgggcatggtggcacatgcctgtaatcccagctacttgggagactgaggcaggagaatcacttgaacctgggaggcggaggttgcagtgagccgagatcaagatcatgccattgccctccagcctgggcaacaagagcaaaactctgtctcaaaaaaaacaagaattaactgggcatggtagcacgcatttgtggtcccagttacgtggcaggctgaggtgggaggattgcttgagcccaggagtttgaggctgcagtgaacatagattgtgccactgcactcagcctgcatgacagatcaagaccattttctttcttaaaaaggaaaaaaaaaaaaggaaaccaaagcctagattatctaggtcagcagggccatctggtgagttgccagagggcagaagtcactgtcttgtccctagcacctgacttaagacacaaggtttatgaagtaagcaaatgaacagccagaagcctccagactggggccccacaccaggcctatggggctagagcccttcccgccaggtaggaggaacaccccactgaacagaagaggctgacagccagagtgaaaaactttattaacaacaggtttcaacgagaaagcaaatgaatacccctagaaacatggacagcatctcccccagcagcaggcaggggaagggaggcaggaggggtaagcctagggtgttccctaggaaagggccaggttccctctatccagctgggggcaccgagacggcctcattcagggaagtccaggatggcagctgaaggcagcaggtttagcagccaaagcccaggcctagtggatagacagggtccaaaatgtgacccttctaggctggtatcaccatgggggcgtcatgggctgaggattctgcagataggacatcaccacggcagagatggacagcctgagacaggagagaggtgtcagtctaggatggccaggctggggtccccccaccccttactcaagagtcacttgttctgtagggcaagtctcacatgaagctactcatcatttgcttcgtgtcctccgagctccgagagttggcaaagctgatgaaggagcagtagacagcgacccaagcacaccacttcagctagggaaaggtaagtgggtgggcaggttagtgaaaggcacaacaatgagtccccgaagccacctttccagacaccagatcatgcccactgattccatctgatgcagctgggaccttgccccacccggaattcctcagtcccacctgctcatggcatactctagatacgtggtttctagtcctactgtctggcctgcgtctctcaggaccaagagagactctgacatcccacatgcttaagaccctgccctttttccacaactcctctccaagttgcttcaaagcctggccccactcgcagaccaatctgccacatccccaacctgactcgaatccttgacttcaccaaagactggggctttctcggcccagcgtcatcgcagccccactcccggccgatctcaggtcccgccccatcagcaatgacaagacaccccgcttcattccaaacccgcccccgggcctcgttctcaggtccaactacacccatagaagctcaaccccgcccaccttaagcatgaggccgcacatgctgaagatcatgcccagcaggttcatgtagtccggcgtcgggtcgtccaaggccgggttacattcgctcggcgggggcttgtacctgcgacaggctcgagggtcaggggcgctcaggtcctgcccccgggatagacaggcgcttcccagggccccgatccacacccacaacccgaacccgtgcccacgacgctggggtcctcacctcagcactttgttcggcctccgtgggtccgacatattgttagtggacatagcgagtcgaaggccagatcacgcctcttccgctgcaggaatcgcagcttccggcgtgcaagctgagggcggattttagagtaacacccgaggccctcgcatttccgttcctcatgacagaggcttggactccccttacccagagaacggagatttaggagaagccagaagtcttcctttcaaagggaaaatggggaaaagaacctgaaagcgggcttcaatagttccaacccgatcaccgaaatgccaaaatgatgaacccggaagtgataaacaggaagtaggtcaggaagaacaataataaggttacacccaagcgtgggtttctaaggcgcggaattttccgtacagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatggtgagcgccttcgtcttcattccgggtcctcctcccgcctcctgagatcgacggcccagtaacccccgcctggtgttccccagtggatggcaattactgcctgacgtgcggcagtgacaagacgctgaagctgtggaacccgcttcgggggacgctgctgcggacgtacagcggccacggctacgaggtgctggatgcggccgggtgagccggggaccaggctgggatgggagcgctgaggctgggatccgaggtcgatgctgatcctcctcctcctttactccagctcctttgacaacagtagtctctgctccggcggcggggacaaggcggtggttctgtgggatgtggcatcagggcaggtcgtgcgcaaattccggggccacgcaggggtgagtgaaagcctggagaccctcatttgagtggaggggacccgtattagcgcataggtggtgacacggccacccccattacaccgtaaggatcccttccccagatgacgatcccccactccgcatgccaggctaggcagtcaccaacccctgtccttgctgttcccccaaaacctttcacctccccttcgcccttgctttaaccgacactgggaaccctgcctttatcccagtcctccaaagtccagcctcctctgagtggcaataactttctcagaaggtgaacacggtgcagtttaatgaagaggccacagttatcctgtccggtgagtctggggcctaagcacgggggcccagggtgctgccctccccctccaaacctgacctcaccatcatgctggcctcacaggctctattgattccagtatccgctgttgggattgccgctcacggaggcctgagccagtgcagacgctggatgaggccagagatggcgtgtccagtgtgaaggtgtcagaccacgagatcctggcagggtgagtggagccaggacctggtctcaccccaggtgctacggggaatcatagctgcccccatgctcagattaaaacctactctcagctgggcacagtggcacacagctgtaatcccagctacttgggaggctgaagtggaaggatcacttgagtccaagagttcgaggcaccattgcactccatgctgggtgaaagacagactgtctacaaaataataataatctggccgggcacggtggctcacacctgtaatcccagcactttgggaggccaaggtgggcagatcacttgaggtcaggaggttgagatcagcctggccaacatggtgaaaccccgtctctactaaaaatgcaaaaattagccaggtgtggtgacgggagcctgtaatcccagccactcgggaggcggaggcaggagaatcgcctgaacccgggagttggaggttgcagtgagccgagattgtgccactgcactccagcctgggcgacaaagtgagactccatctcaaaaaaaaaaagataaaatgatttctaaaaataaataaaaataggccgggcgctgtggctcatgcctgtaatcccagcactttgggaggcagaggcaggcggatcatgaggtcaggagatcgagatcattctggctaacacggtgaaaccccgtctctactaaaaatacaaaaaattagccgggcatagtggcaggcgcctgtagtcccagctactcaggaggctgaggcaggagaatggagtgaacccaggaggcagagcttgctgtgagccgacatcgcaccactacactcctgggcgatagagcaagactccgtctcaaaataagtaaataaattaaataaataaatacataaaaataatcataaggaagaatttttgttttttttgagacgcagtctcgctctgttgccaggctggagtgcagtgacgtgatctcggctcactgcaacctctaacttctaggttcaggcgattctcctgcctcagcctccctagtagctgggactacagtcgcgtgccaccacgcccagctaatttttgtatttttagtagagacggggtttcgccatgttggccaggagggtctccatctcttgacctcgtgatccacctgccctggcctcccaaagagctggaatcacaggcgtgagccaccgcgcctggtggaaaaaatatattttctattcattaagtggaagtgaagagatcgtcataaagatcttcgtgttgagaaagcagaggaggaggaagaggagggattgatcttggtgtctcacagctgatagaggcagaagaaaatccacatataagtggacgcgttcagttcaaaccgtgttgttcatgggtcaactgtactttgaaaagtgctccctctggtggctgtggggggtgcagggagaccagaacagtctagatgctggtgctgggtagtggggaaagtggtgggactgagtactgaggaggaggagctggagaatgcaggaaaagggggaattgggccaggtggggtggctcacacctgtaatcccagcactttgggaggctgaggtgggcggatcacctgaggttgggagttcgagaccagcctgaccaacatggagaaaccccgtctctactaaaaatacaaaattagcagggcgtggtggtgcatgcctgtattcccatctactcgggaggctgaggaaggagaatctcttgaacccgggaggcagaggttccggtgagccaagatcatgccattgcactccagcctgagcaacaagagcaaaactctgtctcaaacaaaaggaagaaaagggggaatcagaaggactccaagggcttggaaagggggtgtgggtcttggaaatgatggagtaggacgtaattggccctgggcctgagtctcaaggccagagcttcagaattccactcctgtgcactggaagagcaggcccactgggctgggaaggcacagggctgcctggagccatgtgagtgtagtcaaggttcccgctggatctaccctctcctgcagctccgtggatggccgcgtgagacgctatgacctaaggatggggcagctcttctcagactacgtgggcagtgagtgtggctggggatgtgggacaggcagggaagatggggggccaaccaggggcaccccaccctcactcacctacccacccttcccccaaggccccatcacctgcacctgcttcagccgggatgggcagtgcaccctggtgtccagcctggactccacattgcggctcctggacaaagacacaggggagctgctgggcgagtgagtccttgtggtcgtggggatccccttccctcctctcccacccctggagaggaccaagccccccgatcctgtccacccttaggtacaagggccataagaaccaggaatacaagctggactgctgcctgagcgagcgtgacacacatgtggtcagctgttctgaggacgggaaggtgttcttctgggacctggtggaggtgaggtgcccccagccctacttcatacctagatgcctgccccatctcagccctgtccttacctcagtcactccagggcctgaaggctaggatcttttttttttttttttttttttttttgagacaagtcttgctctgtcgcccaggctagagtgcagtggcgcaatcttggctcactgtaaactccgcctcccaagttcaagcgattctcctgcctcagtctcctgagtagttgggattataggtgcgtgccaccacacccagctaatttttgtatttttagtagagacagggtttcactatgttggtcaggctggtcttaaactcctgacctcatgatccacccacctcagccttcccaagtgctaggattacaggcgtaagccaccacacccggcccttttttctttttttgagactattgcccaggcaaatgcagtggcgccatctcagctcactgcaacctcttccccccagggttcaggtgattctcatgtctcagcctcctgagtagctgggattacaggcccctaccaccatacctggctaatttttgtatttttagtagagacagggtttcaccatgttggccaggctggtctcaaactcctgacctcaagtgattcacccgcctcggcctcccaaagtgctgggattacaggcctgagacaccgtgcccagcttgggctagagagaagatgaggcaggaagggcattccaggcaaagggaacagcatatgttaagaggtgtagcctgcgcatgcatcagtcaggaaacaaaggcttcagggtggcggcaggtgcggcaagatccggggtcaggctgggctgcagatgccaggccgagcaactggcactgacccctgggcaagggggagccgacggccatgtctaaccttgggtgagatagggctgcagtcattcaagaaactggagctacatcttagcatccctgtgcatggtttcaagccctgagccctgtccttgacatgtcccagcctggtggggagtcaggccagaaacagaccatcctggtgtagtggggtcagagccgggggaatctcggcaaaggagacatcagcgctgggcttggccaggggaactaaggcccataagaggatggagggaaccgggggggccctgaagacttggcggacaagctcttgctttaggaactaaggtagcaagaatgttccacctatttcttatgggcccagtagaacagaagttgccttggagggcaggcacatcaagggacattttcaaggtggaaagaggaagcatggcttgcttgaggaactgtttacattgtgttgggaccaggggaagtggggatcattggggctgccaaatggacaggatggagcccagctggtggcagggaacaggcaagctgtgagcaaggcatgctccaaacatggtagtggcagaaaatcagcagtctctggacatggtctagaagcagagccaagaggaataactgatagaggaacatgtggtacaagaaaaagactcccggccaggcatggtggttcacacctgtaatcccagcactttgggaggccgaggggggtggatcacgaggtcaggagatagagatcatcctggccaacatggtgaaaccccatctgtactaaaaatacaaaaattagctgggcatggtagcgcgtgcctgtaatcccacctactcgggaggctgaggcaggagaatcgcttgaactagggagtcggaggttgcagtgagcccagatggcgccactgcactccagcctggcgacagagcaagactccatctcaaaaaaaaacagaaaaagaaaaagactcccaaagccaggcatggtggctcacacctgtagtcctagcactttgggaggccaaggcaggaggatcacttgaggccaggagttcgagaccagcctgggcaacatggtaagaccccatctctgctattttaaaaaataaaaaatcaataagaggctcccaagacttgcggcctgaacacctggtaggacagagctactgaggggctcagtctgaggtagattaattttgcagtgtctaggaggcaattagaggcaggtggctgaaggtcggggagaggtgactgagggcttcaggcaggactgagatggggggtgcccagggacctcagaaaccagggtacagcccagccacagataaccactccctacccctcgctccacagggtgcgctggctctggccctgcctgtgggttccggtgtggtgcagtcgctggcctaccacccaacagagccctgcctgctgaccgccatgggaggcagcgtccagtgctggcgagaggaggcctatgaggcagaggatggagcaggctgaagccaggggacccaccaacaggaccaaggaccgagacacagacatggaaggacttcagataccatcttattctagagacgtagctgaccaaaaagtaggggaggggctgggtctgcaaattaataaatagaagagggggtaagaccttcctgggaccgcagccgctcagtcctcgttcttctcatgcatgaaggcatccatcttctgggcaaaggtttcagccacaagcagggggaagaccagggaggcgtcagcatagacctgggtaggggggaacctgggtaagccatgggacccacactcatcgtcccagagaccctatgccccacccagccagcgcttaccttgacgggctgtgcatccacccggatcttgccccaggagacagcctcgtctggtcgggcacctgagtcagagccatcaaactcctgggctgtgttgatgtaaacagcgtagtcggccccgttccgctgtggggaggcgggggcacggtgggcccagtcagccagtcacaggagacagacagacacagagggaggacaccgtagccaaacaggctgagaggtgtgtcccagatgaaggaagcccttcacagacattcgctcccagacagggcccatgtcaatgtctggggtcactagagctgctgggcaacgatggctgtgtttccccagacccaacagccaggtgtcaacaaccctgccccatctgcaaggcaggagctgccagcaactctatcttcagaagccctccaaatccaaccaccgcctgcctcctgatccctgcatggtcaccactgtcctggactggagttctcactcacctgccaccatctgttcaccacatggccaccagggggagcatgggaacccgagtcaagtcctctcccacttctctcagtgcaaaagccaaagccccgcctcagcccacagggcccagcaggctccctgtggcacctccctgcatcacctcctggccctcaccactccaccttcccctcaccaggtacccagctgttcctggattacttcaggcgccccagagcctttgcaatggctgttccctctcctgggaactttgcaatccagaagctcaatgctagtacagcagcacaaactcctggcacgggagacaaccacatagctcctgggagatgcctccccaaacccctgctcccagctcacacttccagaagcctccttccaaaacctcttgttggacagcacccctttctcttctcatgccatcatttagtattccccgtagcaatgactgccccctgacgtggatgtcacttgtttgctatctcccctactagaacatcagtcccggggagcagggatcctggcctgtctagttcatgctgtctacccagcacatggcataggcccaccacacagcatgtctgcagagtgggccgaagcgccacccccactcaccatgaggttggcattggcaatgtggtgcttgaccacgcccccgcccagaatgatcatcccagtgcacttggcaaagatggcctgtgtgttgatgagcctcaggtctgggggaagagcgccgaagtcaggccttggactcagccagccctccttcccctctcctctgtggccctagcgcctcaccctcaacgatgtccaggaccaggcccgggttcttgtaggaatggaagaagatcatgtcgcccagcgagccgtctgtaagtgcgggactaaacacagggatgtggttctgcagagaacatgacaggacagtggctggagctcagagcctcgtctccatgctggctatatgactatctgactgtggatggggtgcctaatttctctaggactgtttcctcaattataagcataacagaaacacctctcacagatgaggcctatatgagaaaacccacagaaaacacttagtatagtgcctggcacataaagaaccagcctattcttagcttgctgagctgtttctctctctttttttttattccctgagacggagtttcactcgttgcccaggctggagtgcaatggcactatctcagctcactgcaacctctgcctcctgggttccagtgattctcctgcttcagcctcccgagtagctaggattacaggcgcatgccac

SEQ ID NO: 14250 - DNA, 12995 bp, Human; identical to SEQ ID NO: 14249

SEQ ID NO: 14251 - DNA, 12995 bp, Human; identical to SEQ ID NO: 14249

SEQ ID NO: 14252 - DNA, 12995 bp, Human; identical to SEQ ID NO: 14249

SEQ ID NO: 14253 - DNA, 24497 bp, Human
ggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgattggcccggccgggtctgggggcggggcgtttgcccggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgcgtgagccgggacgggaggggtggatctagggcagatgggctttagagggggtagttggaaaatgtttttggaggactatacaggagtgaaattacgtgggctgcgaagctgggtcagcagagagaacaacgcatctcgagggggcttggccttaagtgccgtgaccacactaggaccagccaggggtgtttctgtgcaaagtgggtgggtttggagaaggcctgctgtgacccatgccctctctgacccccgcctccccagttccaggtcatcgtttataatcccctggggcggaaggtgaattggatggtacggctgccggtcagcgaaggcgttttcgttgtgaaggaccccaatggcaggacagtgcccagcgatgtgagcccaaacaacgaatattcccccgctgggactcctcccccagtgggcatttcctcatcgcccccatggatatcgcctgcttccatgaatacctcccactcatgcatatctcttcccccctcttgtatcttctccctctgccccttaatatcagtctccccttgggaacatatgcctcctgtgagtggtcctcccttttttttttttttttgagacggagtctcgctctgtcacccaggctggagtgcagtggcgcgatcttggctcacttcaaactccgcctgctggattataggcatgagccaccgtgcctggctggtcctccattttaataccccgcttccccaggaaaatttattgctgtttatggacatctccttcattccagaaaacgtcctcccccaaacctcttcctcccccgagaacctgcctcaagggtttcttcccctacttcctccttcactcccccgactccatggtctctccaccctcccggtgggtttttttttccacctggtgaatcttctctgcaatcatttccttggaatctgactgtccccccaccacacacacctccatttcctttccccatctcaggactcttttccttccttgagttttttgtctccatgcatgtatagctttccatgggtactcttgactcagtttccctcctcctttatccgaggtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgaggtgagaccccatttcaatcccctttcctgctcctgtgacaaatttgaagtgtcatggtgagctgtgtggactctgggtcagcaggtccctaggcttatgacctcctgtcacaactcccctcattgtgtgtccttgagcaagtgacctttgtctgagcctcagtgtcctttcctgggactgttatgaggacccagtgtgatcatgggtgacacttgacagacatgtcagagttggtggcaggtggtggttcgcaattttggcagggacgtttcagggaaggtgttcccgataaaggtgacatttaagatatgacctgagggagggagccgtgtggctatttgaaggaagagagatccaggtggggagagaataacaggcataaaagccttcgagcaggagagtgtgcagaattccaggagccacaaggagctcagtgtggctgaagcagggtgaacgggtgacaggtcagaccttgagggccttgaggaccaacaggaagactttggcttttgccagtcattgttgctcatgtgtctactcctagctctttgggaggctgaagcgggaggatcacttgagcccaggagttgtcccagctaattgggaggcccagatgggaggtttgtttgagctggggagttcgaggttgcagtgagtaatgattgtcccactgtactccatcctggcaacagagtgaaaccctgtctgaaaagaataataataaaataggccaggcatcgtggattatacctgtaattctagcaccacgggaggctgaggtgggtggatctactgagctcaggagtttgagaccagcttgggcaacatggtgaaacccagtctctacaaaaaattagctgggggtggtggtacacgtctgtaatcccagctacttgggggctgaggaaggaggattgcttgagcccaggtggcagaggttgcagtgagccgagatcatgccactgcactccagcctgggtgacaaagtgagaccctgtctcaataaaataaaataaaagaagttctgcagtaggactgttcatgttaggaagaaaacatctttttcatatttttattaaaataaaataaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccagcctgggcaacagagtgagactccgtctcaaaaaaaaaaaaaagaaaaaaaaagaaaaaaagaaaaggctggggtgggcacgttggctcatgcctgtaatcccaggactttgggaggctgaggctggcaggtcacctgaggtcaggagtttgagaccagcctggccaacacagtgaaacctcgtctgtaccaaaaatacaaaaattaactgggcgtggtggtacacacttgtagtcctagctactcgggagggagaggcaggagaatcacttgaacccaggaggtggaggttgcagtgagccgagatcatgccactgcactccagcctgggggacagagcaagactctgtctcaaaagcaaacaaaaaaaaaatcaggttgaatggctgggtgtggtggactgcttgagcccaggagttggacactagccccaggcaacatagtgggacccccatctctagaaaacaaatttaaatttttttttttttaatttagtagagatggagtttcactatgttggccaggctggtatcaaactcctcacctcaggttatccacccaacttggtctcccaaagttctgggattacaggtgtgagccaccacgctcggccctaaaaaaattttaaattgagaaaaaaaggggccaggcgtgttggctcatgcctgtaatcccagcactttgggaggctgaggggggggtggatcatgaggtcaggagttcgagaccagcatggccaatattgtgaaaccctgtctctaataaaaatacaaaaattagccaggtgtggtggcatgtgcctgtagtcccagctattcaggaggctgagtcaggagaattgcttgaacccgggaggcggaggttgcagtgagccaagatcacgccactttctgcactccagcctgggcgatagagcgagactcagtctcaaaaaaaaaaaaaaaacaaaaaacccaggccaggtgcagtggctcacgcctgtaatcccagccctttgggaggccaaggcgggtggattacctgaggtcaggagttggagaccagcctgaccaacatggcgaaaccccgtctctactaaaaatacaaaaattagccaggcatggtggcatgtgcctgtaatcccagctacccaggaggctgaggcaggagaattgctggaacccaggggcagaggctgtagtgagcagagattgcgcccctgcactccagcctgggcgacacagcaagtttctgtctcaaaaaaaaaaaataaaaatccggctgggcacagtggcttatgtctgtaatcctagtactttgggaggccaaggtgagcagatcacttgagttcaggggtttgagaccagcctggccaacatggtgaaaccctgtctctactaaaaatatgaaaattagccaggcggggtggtgggcacctgtaatcccagctacttggatagctgaggcacgagaatcacttgaacccgggaggtggggggtgcagtgagccaagattgcaccactgtactctagcctgggctacagagtgagactcagtctcaaaaaaaaaaaaagaaaaaagaaaaattaaaaaaagaaaacacacacacatacacacacaaacccatctgtggacccttttctgcccagcacatccgggcaacgtttgatcctgacacagggctgttgatggagattatgaacatgaatcagcaactcctgctgcctgttcgccagaccttcttctggtaagggaagatcaccaggcctgagggtggggtggtggtgctcggcatggagctagggccccttacctgactctcacctgccccaactccaggtacaacgccagtataggtgacaacgaaagtgaccaggcctcaggtgcctacatcttcagacccaaccaacagaaaccgctgcctgtgagccgctgggctcagatccacctggtgaaggtcagggactaggaatgatgagtgggcagttgggaatggggaagttatggagcccaagagggtggtgggccatgtgtagagtgagggtaggggaggatttacttttccttcagatcagtgggctaagacccacagatcagcgggggaaatatttgagggtccttccatagaattgatattcatagctggtcgtatgagagtctccccataggacacatcatacaaagccattcacatctgctgtggacgtttacatacttagttttggaaattgggggtggggcattcccacttggcccatgaatcaggagagccaaatatcactgcttgaagaattcaccaaagtctgtagtaagaggagcttctatctggagtgaatatttgagagtccacccttggattgattgggtttgggtgagtctcagggtgaatgcctatgggtgcatctggctaggaacagtggtttcccagggcctctcattgatgtttgactttcatagatgacaaaactcacatttgtccacattcaagagcctcgcgtttcatgtgagtccctttgagatgaatgtctgcatatctgtatatagttttgcctgttctaacagagttacccaaattaactgtgactagaataagatagaagattattttcttctaacaaaaagtctggctgttagtccagagaaagtggggtggttccataatcacccaggacctcctcttctatcttgttgctctgccttccccaatattcagtttccacctcatggtccaagatagctgctgaagctccagccgccacatttgtgtttgagtcagtagcagagggacaggggcaaggaacattgttgacaccacttggatcactttctatggggcaaactggtcactcagctactgatagcctcagggaagactggacaatatagtctttatcccaggtagccatgtgccaagctagaatcctattctatggggcaatggtgaacaggaggcgtttatgccacgctcaagagtgatgtggtaagccagatgcagtggctcatgcctgtaatcacagcactttgggagactgaagcaggaggatcgctgagcataggagttcaagaccaggtgggagcatttgctgattaggtgcctacatagtgatgccctgtctcaaaaaaaaaaaaaaaaaaagaggccgggtgcagtggctcacgcctgtaatcccagcactttgcgaggcagaggcaggcagatcatctgaggtcaggagttcaagacaagtctggccaacatggatagaaaccccgtctctactaaaaatacaaaaattagccaggggtggtggcaggtacctgcaatccctctactcgggaggctgaggcaggagaattgcttgaacccaggaggcggaggttgcagtgaggcaagattgtgccactgcactccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctcacgcctgtaatcccagcactttgggaagccgaggcgggcagatcacaaggtcaggagatcgagactgtcctggctaacatggtgaaaccccgtctctactaaaaatacaaaaaaatcagccgggtgtggtggcgggcacctgtagtcccagctactcgggaggctgaggcaggagaatggcgtgaagccgggaggcggagcttgcagtgagccgagatcgcgccactgcactccagcctgggtgacagagcgagactccatctcaaaaaaaaaaaaaaaaaaaaagagtgggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaagggaatcaccccttatctgcagcatctcaaagctgcctggggttggggttgactgccctctactttcacccttcaactcccaggatggaaacatgcagctgactgtgctgactgaccgctcccaggggggcagcagcctgagagatggctcgctggagctcatggtgagtgggtcagagccccatccgagccagggtcctcccaacctggacccctgctggaccttgaaggctgtttctggcccagttctctgctttcaggccccactaagctgaggactccgtttctttcttttcttctctttgagacggagttttgctcttgttgtccaagctggagtgcaatagtactatctcagctcactgcaacctctgcctcctgggttcaagtgattgtcctgcctcagccttccgagtagctgggcttacaggcacacaccatcacgcccggctaattttggtatttttagtagagatggggtttcaccatgttggccaggctggtctcgaactccttacctcaggtgatccactcacctcggcctcccaaagtgctgggattacaggcgtgaaccaccgctcccggccaaggactccatttctgtgtgtggcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcaggtgaggggcagcggggtaggcagagaggaccggattgaagtctaccagggagccgggtttgggtgcggagtttcctaggctcagcggggatccatttggccataattagccccaaaccctcgggccaaccccatcccctgggcagtccccgcccagtgccagcccagtcccaacccccctggactgtgtagaggcacagccctagctcatgcccctaaaccaccaactcacctccggccccgcccatttcactttagccccgccctctcaccgcccccaggctctgtcctgcctcacccagccccgcggcttcagccccgccgtaactcccaaagtctcaggtcacatcagttctgctccatcgggactcgaaccctaagcttgggaccgacccatctccccattggctcagtcctccctgtcacggccctggccgctcctctcggctgagccttgcccctctccggcgaaaccccgcccctacaacctagccctgcctcctgacctggctcggccccgcccttctccatccaggccccgcccctctccaactcagccccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggagatcggagagaggcaagagagagggagagaagagaaacctggctttgccccaactcatctgggcccatccccttccccgcaggacctgttctccaccttcaccatcacccgcctgcaggagaccacgctggtggccaaccagctccgcgaggcagcctccaggctcaagtggacaacaaacacaggtggggccctggtcaggggtagggaaggggtggagtcttacctggggccggcaggtgggggcaatgtgtgaggcatgggatgttggccaggacccaaaaaggtcatgagggtatggggcagagtccagacccaggttaggggcttaaaggatctgaaatgggtgcggcaaaccaggaatgggtcttgaggtttgtgggtgctgtttagtcccaagaacaagatttgaaaatccccatccatgtctagttctgggagggtgttcatcacccctggggtcagattgagggtacgaggacagtggccagattgagggtatgaggacattggacctgggggtggtattcggggccggggaagcaggttaagagtctgggattgaggccctggagacagattcggggatatgcagctgtgtctagacccaggggaggaagcatcgtggggtgagtcagaggaagtctgcacctcctcactcctccttccccctgcacctctccaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagtgtgggttttttttgtctgttatttgcttgttagagggggacagaatttatgacccagagccgggtgtggtggcttgctcctgtaatcctaacaactctggaggctgaggagagagaatcacttgagcccaggagatctagactagcctgggccacaaaatgaggccctgtatgtacaaaaaatttaaaaaattagctgggtgaagtgtctgtattcccaactacttgggagaattgcttgagcacaggaggtcaaggctgcagtaagtgataatcacaccactgcactccagcctgggcaagagagccagatcctatctcttcgtgtgtgtgtgtgtgtgtgtgagggacagagtctccctctgtcgcctaggctggagtgcagtggcgcaatcttggctcactgcaacctccgccttccgggttctagcgattctcttgcctcagccttccgagtagctgggactacaggcgccccccaccatgcctggctcatttttgtatttttagtagagatggggtttcaccatgttggccaggctggcctcaaactcctgacctcaagtgatccacctgccttggcctcccaaagtgctgggattacaggcatgagccactgcaaccagtctggatcctatctcttgaaaaaaaaattaaaaattagaaaattatccagataggatggcgtgcatttataatccccagctactacttgggaggctgaggtgggaggattgcttgagcccaaaagtttgaggctgcagtgaaccatgatggctccactgtactccagcctgggtgacagagtgagaccctgtctctagaaaaaaaaaaaaaaagtaggcagtgcgtggtggctcacacctgtaatcccagcactttgggaggctgagtcacatggatcacaaggtcaagggattgagaccatcctggccaacatggtgaaaccccttctctactaaaaatacaaaaattagctgggcatggtggcacacacctgtagtcccagctactcaggaggctgaggcaggagaatcacttgaacccaggaggcggaggttgcagtgaggcgagattgtgtcactgcactccagcctggtgacagagtgagactccatctcaaaaaaataaataaatacaaataaaaagtttttaagtgttctggggtcagtttgcaagcaccaacagcatatgtttcttaggccccctctgatgacaaggactggcccagggtggacagggaagcccagggagggtggtatcatgttggtcctctaatgtttcctctgagaacccctccaatgggccagttagcatgggccacctagggatgccagggtggggtgccaggggacactctgctgtggtcccacttggggcatggtcaccagatgtgctctttttcttttttttttttttgagatggagtctcgctctgtcgcccaggctggaatgcagtggtgcgatctcggctcactgcaagctctgcctcccaggttcacgccattctcctgcctcagcctcccgagtagctgggactacaggcgcctgctaccatgcccggctagttttttgtatttttagtagagatggggtttcaccgtgtaaggcggaatggtcttgatctcctgaccccgtgatctgcctgtctcagccttccaaagtgctgggattacaggcgtgagccaccgcgcccagcccagatgtgttctttttcaagtttccttcttgacggagggctgggccagcttgtgaggcctgaaaagggctccctgcacctgtctgccgtattggacctgttactggaggtatcacccccaccaaaaatatttctaagtccctctcctatggtagtgactggcctgggctgagtaaggaggactgtggagtactcttcaggctcagccctggtcccacatgcgtccctgttttaacatgtgactcctccgcagaaaacttttataagtccctctccagg

SEQ ID NO: 14254 - DNA, 26140 bp, Human
gctgcaggacccagcctggtgggcagcggcagcttctaggagggatgcatttccagcaaggcaaggtgaaaacagcattgtaggcaggacataaaagcataggaactgtgggaatcttaagcagctgagttcagagtgccaagagagaggctgaggctgagaggctgcagggctggtcacgggaacactgtggcttggcttatgagctggcctgggttggcaaatagcaccatgtgtgcttccacatctctcttctgtgtccacagtagataacatcagtcaccattgcccttccctgctgcaccagggtttcatcttagattccttctcagcccagagtccgagacagctccccgtcccctctccccgccggtagatcagacttggcacttggaatgaaacccatttgtcatccttatttttggacactgaggaaccattaatgggtttcaggcggcagtagcatggttagatttgaattttagggcgggtcacagtggctcacgcctataatcccagcactttgggaggccaaggtgggtggatcacttgaggtcaggagtttgaaaccctgtctctactaaaaatacaaaaattagctaggcgtggtggtgcatgcctgtagttccagctatttgggaggctgaggtgtgaggatcactttaacccgggaggtagaggttgcagtgagctgaaattgcaccactgcactccagcctgggcgacagagggagactccatctcaaaaaaaaaaaaaaagaaagatttgcattttagggtgactagtctagctaaggaggagagcaggctctcagcgagtgagcagcaaggggctggtgtggtggtctaggcaggagtggctgtggggatggagaggtacggacttgagaaataatgatggcgatcgagtcacaaggattgaagggttgttgaggaacagcacacatcaggatgacgctctggatctggtttagccgctggaattctgtcttgggggtttttccctcccggctggctatggagtggggcgtgagcccccaaaccctcagtgcctcagaaggcaagtcctcacacacagaactgctaactgtgtgaggcggtgcatttgttcattagctggatgtcacctttccacaatgtatatctattttaaaacattgtgttgtacatgataaataacatatacttttaactcaatttaaaaaattaattaggccgggcacggtggctcacgcctgtaatcccagcactttgggaggctgaggcaggctgatcacctgaggtcaggagtttgagaccagcctgaccaacatggtgaaaccccatctctactataaatgcaaaaattagctgcgtgtggtggtgcatgcctgtaatcccagctacttaggaggctgaggcaggagaatcgcctgaacctgggaggcggaggttgcagggatctgagatcgcgccattgcactccaggccgggcaacaagagcaaaattccatctcgaaaaaaaaattatttaagaaaaaggaaacgagtcctcgtatcagtggatccccgcctggctgcatgggagaaggagcaactgaagaacacagcgcggcccgcgttcagagcctctgagggctcagcgctcccgcctgcctgggggctctcaccctctgagatgcccacactcccactcacccagcttctctgccgctgctgctccactggcagtggtgcttggcatgaagatctctccgggcctcagtgtcctcatctgtaaaacaggaacaataatgactccttcaagggttttgggaggaagtggtgcttttaagattttacaggggtttgcgaatcttggtattagggctggggtgaaggcccaagtccacttaggattttgataagggttagggatgggtctggagtttcagaggctgcccgcagggtttcctccaagacagggtcctgtgtcctctgggcctgcagctgctaacgccccctatgcctctcctcctcagctcaccgtctacctgggaaagcgggactttgtggaccacatcgacctcgtggaccctgtgggtgagtccctggagggcgagaggagggctgggggaagatgtggctggccaagcctcccagaaatagctctcagctctccagaggggcccggtgccaagaacgggggtgaatggcttcctgcttcaggcagcaagcatttactgagcagctactttcccactcaagtgaggactgcaagaagagactgtgggaaggactgaggtgacaatcagggaaggcgtcctgatgatggtaagaagggtgagggtgatgacgacagacaccgccacttactataaggcgtgtcatgtagcagacagtgggggtggctatgatgactatccctgctttccagacaaggagaatgaggcacagagtggctcagtgacttactccaggtcatagagtgagtagatagaggagcccggttcaaacctggcagagtctgcaaaactctttgttctgcttccttgtgatggcaaagagtgggagacagagggagaacccttcttaggacttgtgaaatgggggctgtcctcatgtacatggggttcctgctagaagctgggctgtggctgaaggcaccttccaagttcttgttcaagttcagggttttgcaatttctgcatgcttgacattttggattggatagttctttgttggtgtggcctgtcctgtgtgttataggctggatagccacatccctggtctctactcattcgatgcccagagtacctcacgctccagttaggccaactaaaaatgtctttaggccaagtgcggtggctcacgcctgtaatcccagcactttgggaggcggatcacccaaggtcaggagtttgagaccagcctggcccacatggtgaaatatcatctctactaaaaaatacagaaaaaaaaaatagccgagcatggtggcatgcacctgtattccctgctactggggtgggtgaggcatgagaatcgcttgaacccaggaggcagagttgcagttagcgagatcatgccaccgcactccagcctgggtgacagagcaagactctggctcagaaaaaaaaaaaaaaaaaaaaaaaaaaaagatgagcaaatcaaagtgaggcctagtatggcctttcccatcatgtccctgtgggctgtcctgggtccagggcaggagtgatttgtgtggttcctgagccaaggaagcgagcccggctgcaggcttcagctcaccaggaggaagacctggggaccctgggctcccagggccagggggctgtcagcagagcccttcatggcctagagcagaacacccccaattctcccctccagccctgcctgggatgctgtttggtgtcttctgaagctcagtgtccctttgccattggcatcttctccctgaggtggcctctcagaggccgggagcaggcatcctggtgttcacctgtggctgcttcatgttgtcatttccagtgggccctctgaggccagggttgtccatgtccattggcctactaaggacagcagcagaggtggcccagagactgggagaggacaggggcaggaaaccagcccccaacacacgcaggcaccctgagagctgttcagcaggtgttcacagagcaccccctttgtgccaggccccttgtgagccctggtatccccgagaactctggggcactgtgcagagctgatcagggactcactgtgagagattcttctcccatagtgacgctgccatttggcttgatctgatcacaccctccctatgcttaccggttccccaccaaacctgcacacaagtccaagcccactggcctgcccaacaggacattgatgatccatcctggccctcctcttccaccagcagtggagtgacaatgggttagagggtagggggagagagagaggaaagaaaggtttggccaaagatagacaggggatgtcagccaagggggtgaccctgagccagtgtttctggcctcctggggtgctgagcagagatgtcctttgtgtccagctggactctgcccccaagggcaggcctcagggcactgaggcgccttccacaatctgcagagtgctctcgagtgcttggcactgtctaagcgctgtacacatatgcacattcacacatgtacccattcagtcgtcacgggagccccatgagggaggcactgcagatcacaacccccaatccacatgtgccaagcccaagctctgaaaacctaacattgcttccaagtttaatgcagaattcatttattggcaaacctgacccaaactgatgcgaggctatttatgccttatttagcctcttggtgagaatatttgtgttttcctacagaggtattaatggctttaataataaggtacagatcttgcagaggtcattacagaatatatggaacatgtaccattttgcctattttattttattttattttgagacagagtctcgctctgttgcccaggctggagtgcagtgggatgatctcagctcactgcagcctctgcctcccaggttcaggtgattctcttgcttcagtctcccgagtagctggaactacaggggcccgccaccatgcccagctatttttgtatttatagtagagttgatgtttcaccatgttggccaggctggtcttgaactcttggcctcaagtgatccgcccacctcagcctcccaaagtgttgggattatgtgcatgacccaccatgcccggcccattttgcctctctatacttcgcaatttctaaagtccaaagaatacctggttctaggagtttcggacctaggttattattcttactagcagatgaagaaacagaaatggtctctaacctgcctaaagtcaccagctgggtctgttatactggcctgggatgggggaagggtggagcgtggtggaggtgggcagtgccaccctctaggtgcccgcctttccatttttctcaggatgattttagatgaacagatggttggatctgggcttgggctggtgtttggggcacagaggtttgggagaccaggttgggagagaccgcttactctctgtcctttccccagatggtgtggtcctggtggatcctgagtatctcaaagagcggagaggtaggctgtggcccccatccccagcctgtcaagggccgcctcctcttccccccggacctctagcataggaactccctgcccatccccactggttcccctgaaagccccaacaaatacctctacagatgccgttgcctcctccagcctgggacggccctgccccaagcctactttgggagaaggtttccccatgccctgagcactttcacatcaatatgtcatgactgtggcaaggctggggatgccagcagggtaggagtaggttcttctttaacagaacagaacattgataccggggcagtatcaatgcgcaggaagacaagagtgcagactgagctgtgacaagacgcttgccgtccagataccacccagcacttgccctgcccccacaactccctgctccttccccaggtcccctacccccaccccaggcctgccagactactccagcccccgccaagcctgtcagaccgtttccatacccctccacatatgccctggggagaggtgggagggggaaggacagagctggctcagcaggcagccccctcctcctcccaggggccaggccatggcatccttcctgtactcactaccagccctcctggtggagacagtgcagccatccccacagagcttgggacaggcttggggcctccagtggggcccgtcccagggctgctgccggcactctggggggctcgcttgctgctctcccaggcccctcctcagtgctcctcgctccccacagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgaggtcaggaactgccatccctggggccccattccagaaatgccacctctaggaagccctctggggtgggcataagagggcggtgagggtcagctgctccctgccacccagtttcccagtgtatgctgggacctggggcactgtcacctgtgttacctggtaagtgtctcttctccagcccctgctggggtttgtcacctgtacctttgggctactcctcagacccttctgaggccaggtcattggtgggagaaagcgggtgctaaggggcttcagagaaagaaagagccctttctggaccctgcatcactgcaaggggtttcccgctcagatcagctccccacttgcccggcagcaacccagctcgcaagagagggatggcaagtaggtgatctgtctgccccaccacctttcaaatcagagactttaagatgctggatttcaaaatctcaagtttcttaggctctctgattctgagattcagtgtggtctctccctttcttggaggctgagagagtggagagggtcatggagtcaccttttccacgtagacatgttagctccctatggctgctgaaacagattgccacaaactcggcagcaattaaaacaacacagatgtatgagcttacagctctggaggtcagaagtcccaaaacaggtctcagtgggctaccatggaggcgtggcagggctggctcctctggaggccctcggggagcgtccaccttttccagcatggctttccttggctcacagtgccttcctccattgtcaaagccagcagtggccgttgagtcttttgtacatcccatcactgtggctcagacatttctgccccctgcttccacttctaaggactcttgtgattatactaggcccaccaaaatcatccaggatacggtccccatctcaaggccttaattggatctgcaaagtcacttttgtcattaaggtcccaggtttgggcgattagggtgtggacatctttggggaacattattctgccaaccacagtagacatcatagaaagatctatttaaaccattgctgcgaggactgggctgggccaaaccctttagataaagaaagctctttatctaaagagttttagatggggcatggcttggcatggtctgatgggatagacatggcctgtcccctggggcccttggtctgatgggtgtatgggagtgtctgggctgcaatacatgagacaggacagtggtggatgtgacaggtggctcgttctgtcctcttcttgacagatccctccaaaccttccatgttctgtgacactgcagccggggcccgaagacacggggaaggtaggtcaccccaaggggaccatctctctggctccaggagtctcatgtccccaggtccctggctttctccctgggaggtgctggacacacaggaccactctccctgttgaacagtctttgtgtctaggctaagctggtcccaccttggacaaccagtctctcttcagacagggcagcaggtacggggtcagcctcactctcccattcagtgatgggtctggaggctctcctgggtggcgttggctgcaacaggaccaaagtgttctgaggacctacacctggcctcatgtaacccctggcaacctggaatcaaagtgcgatcatccccatttcacagatggggaaactgagggttggagagaagtgacaccactagctccagagctttgagcccagcttcctcatctgcaagatggagataacagcacgtgcctccttgtcttgttagaggaataccggataagccacccagggccgggtgtgcacacagtagtaggcgcccccagtctgctcaggtgcctgttgctatttctgggcagctgcctggatgaggacggccacccagactgaggcaggaatccaaagagcagagccccgtttgggtggttcgagatgtcccatgtcagatggaggaggcagcacagcattggggctgagcacaagggcgttcccccgcttcttccagaccaaggaaggctgggctgtgggagcttggtgttcctgtccagtgtcctcgtttgtaaaatgagaggtgggctggctgtgtactggggaccctgcttctccaaggccctgtggtcagtgaccccttccccacaggcttgcggtgtggactatgaagtcaaagccttctgcgcggagaatttggaggagaagatccacaagcggtgagtaggatgccagggtgtgggccgcctgctgggtgagggagggagacaggatgggcaaagtccaagaggagataagtaacaatacctggaagtgtgtgaggaggggcgcacattccagccttggaagggcactctggaagctgggaggtcacggagggcttccttggggaggtggcttcgactgcctgggttcaggctgcagcatcttctcctttgcaccattgtggcagcttcctccctcatctccctgcctctcatttcatcccctccagactgcatgtctttttaatttgttttggaaaaaccctaaattcagattgtgttaaacagtgagcaggctgtttcctgaccattctcattttccagttttcctcctgggaggcgttcagcaggagtggagtgtgtgtcaatggcagcttctaagtgaggaggaagtggagatagtgaacccatccaggggagagtgacagggaggtcggcccacatctaagagatgggaagcgttctctggagaagaacagcccgggcagacagagagcccaggctggcagccagaaacagctggcccggatgtctcatgcctgcccctcctgggtcgggctgtgctctgtctgcctcctggaatagctggtgggccctcgacgctgatgtgcctgcatccagaggcactggtcccagaggaggttggctgagggcacagcagcctttttagggcgtgggctgagtttgccacctggtggctatagggtgtattgcatgcatttgcatctgcagccctggcagctgtgtgtgaggagatgggacttttctcccttgcttctctgtctcccttttcctcttaagacctgagaccagggaagaggaagggtgctgtgggatgtgggaggaggcttggtaagcacaagaaagaggaggtgacatcgagagccacccctctcaccctaccaccaatgggacatttaaaatccacaccaaggagttactaataataatgatatagaagctatcatttatcaagggctgattaggtgccagacaccatttacagtgctgggctgtatgaactaatttaatcctcacagcagctctaagaagtacgtccttgctgggcgtggtggctcacacctgtaatcccagagctctggaaggccgaaggcaggcatattacttgaggccaggagttccagaccagcctggccaacatggtgaaaccccatctctattgaaaatacaaaaattaggcaggtgtggtggcatatgcctgtaaccccagctactcagaaggccgaggcaggagaattgcttgaagctgggaggcagaggttgtagtgagctgagattgcgccactgcactccagcctgggcaacagagtgagactccatctcaaaataaataaattaataaaaattaaaaaaggagaaaaagaggtaggtccttctgtcatcaccctttacagattagggaacagaggcagagagaggttaatgtacccagggccacatagttagtaagaggagagctgggagtttgaccctggctccctggttacaggcaatggaggcagcttatctgagcaacggagatgccggcattcccagcatgccacagagacggcctcaccaagtccccctccctcaccagatcctcatttgctccctgatcccctgtaatcttcatggagccagtctcatccatgggccttctcccctccctgggcttgtccccttcactggcttgcatccccctgactgaatccacgcctcctccctgaaccccaacgcctccccaagccccatttcttcttgagaccgctgtcccctctgcatagttttacataatagatatctggcagttgtttattatatggcaggcacagtcataggtgctgagagtacagctgtgaacaccttagacacaaatttctgtccttaaagaacttacacaaatagtgtcctatgtcaccaaaatagatgacagagggacactatttgtgtatggtgacatagggagtcaggaagtgacaatgttacctatttggtgacatagggaagcaggaggtgaaaaatgtagtccctgtttcagcatcctgctgggtaccaggaccaaatgaagtgcagccacagggcacttctgggacagaacaggggaggatggaatggagccagatggtgacagacccctatgctgatctctgcagtttggctggattctaaggtgatggagagccatgccagtctcttgagcaggagaatgatgtgaggctcgcaaggagaggggatgaaggcaggtgaccctggtcctctttcactccgcccatctccattaggaattctgtgcgtctggtcatccggaaggttcagtatgccccagagaggcctggcccccagcccacagccgagaccaccaggcagttcctcatgtcggacaagcccttgcacctagaagcctctctggataaggaggtaggaggctcggacttggcagggggtgggggctgctccaccagggcctgggcctcagatcccagctctctcctggcctgcaaggatgcctcaggtaggagcttctatccccagcccaaggaccacaggggtcagggaatctgagacctctcatgggggatttggagaagcctcttgggcctaaaggagtggcaaagggggcatgaacttgagagatgtgatggacttccgaagtgaggagcagaccttcctgaaggtcctggacatctcccccacacctccaccagctgcctgcctcaggccgagtgctgaaggtcaaccagcattgcagagggggcacggtggggggccgtgaccttcctgccaaacactgagcatcagggcgacaagccctgcagaaggaagggcctcccctcaaactctgaatcaaacccagctgactgctgtgagcttaggctggcccctcctcaaggtgtgggcaccccctctctctcggggcatggctgaagggaagtgccttggggcaagatgcaagttgaggtctttttgtagggattcagagctggctccctcagtgagctggtgagcccatcctcacctttccctgcttcttccagatccttctgtggacagaatttagagctggcagggacttcagacatcacctagtccaaccccttcgttgcacagagggagaccctgaggcttagataacctacccacggtcacactgctttcatcatcgtcaatgttattgttgttattgttgtcacaattactgctggccaagccagggctggagcccaggactatcaccttccaattccgttatctttcaagggtcccaccagggaactgaaggctaatgtgcttggtggctttcatgccaccttagcagcagtgggaagtggctgatgaacttggggcaaatgtcacaatgccttgggggattcggagaagcctcttgggcctaaaggagtggcagagggggcatgaacctgagggatgtgatggacttcagatgggagcagcagacccttctgaaggtctgcgcaaggtctggggaaccccagaagatcgcgtgggggcttttctccctcccctttccctagaaccttgctgtcctcccagccaaccccgtcccttcttatgccccccagatctattaccatggagaacccatcagcgtcaacgtccacgtcaccaacaacaccaacaagacggtgaagaagatcaagatctcaggtatcccagacagagggtcagcttaggggacagcgagaggcaatcttcccaagggctgggggtggctgaagtatctccccttgttaacagccttgtataaaaaatagccactgaagcccagggcctgctctgagccacagggcaaagcttttgagttgggtaaggcaggctgcttattggctaggtaatgagtttgctctttaagccacctcttcagtttcttgggttctggacaaagctgtccttgaggggaaggctttggttatggaaggaaatgggtgtgtttggggctaccctttggatgtaagacaggggtggtcttatgcagaagtccccactggtggcctctggccattgcctggggctgaatatccccaacccggggaggggacgcctgtgagactccatgggagctacattcccgactcactccaccttgattcctctccctccctagtgcgccagtatgcagacatctgccttttcaacacagctcagtacaagtgccctgttgccatggaagaggctgagtaagtgggcacaagtctggccttgggcgtatgggattgggtgggaaaaagagaagctctaggtgtcctgttacaggtccaggtggctcttctccacctggcagagggctgggcctcagacttccttgccactcagagtagatgatcccgaagagccttttagaaaccatccacctgatttagcttcaagaaaatgcatgctacagtcaaggaagagacccactaaaactagagtgacaaaacaatagctaatgaatgtaaggggattggggttgtgagaagaaataattacgttgtacaagaaacctaggttgaagggaaatactttgttcttggcttcctggtagccagggcaaagtgggtaaggcactaggtacacagctcttgtctgataaaggggtaatccaactcattgggaaaaaggggttgtgtgtgggagtgcagagaataattacacacaaaaaaatcatctaggtttgaggagaactgctatggttgagcatggatcgaactttgtcccaggcttgttggcagctaaggcaagtggagagatctgaagtgaaacatctttacttacctaaaggaagtaaatgctcccattcaaagacatacacattttttttttcctggccctgcaagtaatttcttggggcaattatacctgatataattttacatgtatatgtgtatttgtttatgtataattccaatcagtatttcttgcaactgaaaatatttttaaaatgttactacatggcctttgaaatagtttttaatgtcctataggtgaacatgctatgattagatcaagctttctctggttactggatatttttcatatccactgttgattttttcaaaaaaatcagagctatgaggcatagattcctgatggtaaagtgaagtgatctagaaccagagtaacatataatccctaaagagtagaaaatcccaaccactgcagatggtgccagcgtctgcataacgaataccagcagggatggctggggaggcatttgcactcacagacttgtttacttctcaggaagcgctgtggggctggggttgctgctgccccagtatgtagaggaggaagtggctcagagagatgtgacttgcaagttagcaagcagcaaagctggggctggaacacggtcgtccgactccaaggcttgttcactatctgctgcatgacagctctctcattggaaaggatgggggatagagcaaaagcaagtaaaaattggacaatcaaaacaccctatatatgatggatgtgatcaagcaagtaaagttttaattgttgagcctagatggtgggtatatgggtgcccaaatagcttcatttatggtttatgtgtagctataattttttctttttaaaatgtgtttagagacagggctggtgctcacgcctataatcccagcacttggggaggctgaggcaggcagatcacttgaggtcaggagtttgagaccatcctggccaacatggcaaaacctcatctctactaaaaatacaaaaattagtcgggcatggtggtgcgcccctgtgatcccagctacttgggaggctgaggtaggagaactgcttcaacctgggaggtggaggttccagtgagccaggatcgcactactgtactctagcctgggcgacagagcaagactctgtctcaaaaaaataaaataaaataaaataaaataaaataaaataaaataaaataaatttaaattaaatttgtttagagacagagtttcactctgttgcccaggctggagtgcagtggtatgatcatggctcactacagccagcctcgaaatcctgggctcaagtgatcctcctgcctcagcctcccaagtagctaggactacaggtgtgcaccaccatatcaggctaatgtttaaaattttttgtagcgatggggtcttgctatgttgcccaggctggtctcaaactcctagcctcaagcaatcctcctgttagcctctcaagttgctgggattacaggcatgagcaactgtgcctgctgtggctgtacttttttttttttttttttgagatggagtcttgctctgtcacccaggctggagtgcagtggagcaatctcggctcactgtaagctccacctcccaggttcatgccattctcctggctcagcctcctgagtagctggaactacaggcgcccaccaccatgcccggctaatttttttgtatttttagtagagacggggtttcaccttgttagccaggatggtctccaactcctgacctcgtgatctacccgcctcggcctcccaaaatgctgggattacaggcgtgagccactgcacccggctggctgtaattctttaaataaatgtgctttttagcactgtgctgcttgactaggataatcttttagaatatccgagattcagtcctgtttgtgcgtagaatgtagatgtgcctcttttgagtggcagtggtctccttgcccgagctgggctggcccaagtggtccgtgtgtctgggggacagaggttgggagagggagacttggagcaggctcagactagatattctgctgggctggagatcagggctggggttggctctggggagggccatctccacagctgcttcctttcttcccagtgacactgtggcacccagctcgacgttctgcaaggtctacacactgacccccttcctagccaataaccgagagaagcggggcctcgccttggacgggaagctcaagcacgaagacacgaacttggcctctagcaccctgtgaggacctgccctcctagccctgggctcctagtgcatcttgcctgatggggccacaccctccttggtccccccagttcaaagacaaggctcaggctaccctctccatagccttgtcagggcctgtcctcaggtgcttgacttgtcagggaagctgcctccttactcccaaccctacccaggggtgactgagagaataagatggaccactaggccagctcactcaggcagtgctgggctctgctaccatgcctgggggagggcaacctgggaaggcttcctgcaagaggtggcagcttctgacgtaatgccttcagtcagatggggtgtccctgaggagagaccagggtggtgagctgggttagacccatgtgcccctccaagtcaggggtcccagggcatctggtcactcctgctgcacagtcatcgtggacgcctctaggctactctgctccagcagagccctggctatggggatgccatcttgccctcttgccagtgtggtccttcagtggggctttggcctacgtctagagcagccgccactcccagcacagactcagctctcttcagcagcccctgcacagcctcccacttacctgaagctttttgccctgtctccaccctggctcacaccctacccatcttcaagacccagctgaagcaccacctctgcggagaagtccttctctgatggcccccaccccaccccagctgcctcgccctctgtgaactccccgtgtggccctttctgcccatgggttgctgagagaagcagaatccatctgaggggaggaggagcctggccctcatggcggggacgctggcctgggcagggagaggggctcagcagggccacacagtgagcgagtctcacagtcagacttggaaccggggctctgggtccctgctacctaagggcactgctcgccttcctcatctccactgggctctattggacatggtagctgagtggctagccagatgggggatggacggccactgccccccagcatacccacccctgaggtgtctcgcccacctggcaaggcccctgaactggctcccctgtgtcactttgcaggttgagggaaggtgccaaccgtgagatcctggggatcattgtttcctacaaagtgaaagtgaagctggtggtgtctcggggcgggtgagtgctccagccaagcccaagaccccggagtgcagaggggagcgtcccaggtgcccacaggcccctgccccattctgcctgtttgcagcccttttagctgcatccaccttggaggaggaacctcctgtcccttcttttcctcccttctgttcctctttctcccccgcccgctttccctctcttccttccttggccctcagcccctctcttacccccacccatctctttctctctctcctcctcctctatcctaggtctgggctcgcactgaggattggccatgcccaggggacggcgtcctcagagtctttgctgtggggtccccaggggtgccatctccttatcacactttgggcatagcacccacccccatgcatgcccaagctgattttctgaggaaacagctaaaagggctcagaacccagagctggattggggatttgctagtcagctttcccattttacagatggtgaaacagaggcccagacagtgccccaaacattgcctgaaatctcctctcctaactcaggtcatagtggtggaccagactgccctgccctggagcatagtttggtggaagctcagggagaaaaacaaacaaacaaactactgtgtttcttttttgtaacttaattcataaatttctatgaaaagattgaaaagctaaatcccattagacattgggtctccttgattattagaagaatgcctcttggcaggtggcagtatgtaatcctgaccttatataataggacatctcaaaattacaaatcccaaatcctgtgtctggtgacctttcaggacccacagtccctcaaacattcttggcaaccccggagtccttccctctgcctttagatagtccggcctcccttgggacaggcagcactggggttaatttttacactgccttgacagatgaggatcctggggctcaggggtttgctgagctgggtctggatcccagtccctcggggcagggctaatgccatttcggtgtatccctgaaagagcagtcagggctgtgcaggggggtgggtgggagtgtgtcccgtgggtcttctctatccgggggacagcagaagtggtgaatgaatgtgctttttgttttcttcctctctgaactctctcctgaccacttctcctgcctcctctgacccacccagcctgttgggagatcttgcatccaggtaaattcctcccttccacctggttcacccaccttcctggagggcctggagcccattggcttgactgaccagaatcacagggcactgggttggaaggaatcttagtggtcatttcagatagccaggttcaggtgtgagctgggagacacaatttctccttaacaaacctcaccttgctcttccatcccacctgagtgacagggatctttacagagagcaaagcctgattacactgatacagggagtggcccccaagagagctgtctgaattactgatcacctgaattataggagcttttggagaaatgcagacttcatggctttcaaacttctacactagtgaggagggaactgctggccaagtgttgctaaggagaggtcctcaggagatcctattttgtaaacaaggtctccttgcagccagctggatgcacttatattccaaaaatgcatgtaccccaaacacagcagtttggcctccttctgtcacaagatggcagtgtggctcatcctaagaaatcttaaactaatttgacaggtgaaattcattcaattcaattcagttccatatcattcagcaaagatttcctcaacccaggcttgcgtccaggctggtgctgagtgccagagtcccagagaggaatcagatgtggtccctgaccttatcgttcctggcccggtagaaggttaagatccagattcttccactaaaatgttggcaaacccagtcttccaccagctccattctgaagcaatccccaaagcaaaaggaaaaaaaaaagagaaggaaaaaaaggccaaatagctctgacagccttataaaacccccaggttcccaatgaggggacttaagtaacgattctggcaggcacaagcttcacatttttatttttattttttattctgagacaaggtctgattctattgcccagactggagtgcagtggcacaaacttggttcactgtaaccttctctgcctcctgggtggaagccatcctcccaactcagcctcctgagtagctgggactacaggtgtgctctactatgcccagctaatttttttttttttttttgagacagaatctcactctgtcgggtaggctggagtgcagtggcacgatcttggctcactgcaacctctgcctcccaggttcaagcagttctctgcctcagcctcccaagtagctgggattataggcacccgccaccacacccggctaatttttgtatttttagtagaggcaggatttcactatcttggccaggctggtcttaaactcctgacctcatgatccacccgcctcggcctcccaaagtgctgggattacaggcgtgagccaccgcgcccagcctaatttttgtatttttagtagagatgggtggtggtggcagtgtctcaccaggttgcccaggctggtctcgaactcctgagctcaagggatctgcccgccttggcctcccaaagtgctaggatcacaggcgtgagccactgcgcctggtcaagcttcacagtttaactcagctctttagctgcctcatctcccagaagttcccgtggttctagaagacaggctttgttccaagttgagctcagtgagactcaaagctagaaagtgctgcaccagcgggtggcgaggctggtggaacagacctttctaattgcacggcttgtgcctctgaccactccattccctgtcccttcctctttcccaactgggctctggacaacaagatcagtgggatgtggcttgtgcctgtaggcactcgcagttgggtggtctcctagggtgatgtcaccccaagccgagaggagccttcagggttgcttttgttagtctcaattctgctactgtcacacagtgatcaagggtgtggttatggagccagaatctaataataaccattaatagctgtgtggccttgggcaagatattttaatctcctcatgcctcaatgtcccagtctgtacattggggataataatatggttgttgcgaggattaaatgagttactctatggaaggggcttacagtaatccttggcacagggtcagtaccatgtgaataccttctcttattctgtccatcagggccaagtacagagaaagccccatcagaagcactggctggtggctgggtcttcccggccgctttcccctgcatccccacagtgtaatcagccttgggccctggggccatcctaaacctgactaaactgacctcaacagtgcttcatccagattgcaggggtgctagggtcacctgagcacttttacaagagcaccctggaggtgttgggagatgggatggcgtgagggtgggaggagctccgacctggaagttgggaagggcagtgtcaggggaggcgagggtggctgtggcgatttgaggtgggggggggtcccagggcacctctggagccccgcagtgaccacggtgcatgctgccccgggcaatcctttcccacccctgggcctcttcccagcccgtgggaacccagagagccttctcaggaaagaggaggcttccatttctttttgggaccagaggaagtctcctcgtccagctcccaggcagaccgaggctccgagtggcagaactggggctggagggcatcttttggatctacctcctctgacggcaaaaccctctgcagtcctcggactgacagggcatcgacatcaagtctcacagcctgtgagtccgctcaaggctcactgggtctgggtctctgtttcagcgacgtggccgtggaactgcccttcaccctaatgcaccccaagcccaaagaggaacccccgcatcgggaaggtgagcagaatctgtaggtctctggggtaggggttctctagcagctgccacgtgaccctgtaacccaccccgccccgggttcgccctcagcccagtcacccttttctcgggtccccagatcttttgtggggtccagaactcgatttgcttctgaccccaccaggagacagtgaggcgtggctcctgttccccatgggagagggaggccaggagtggagaagggaactcattggccatgctttgagcctctatcttgcacccaggcatgggctggatcccgtttggaagtaggggaaggggctgcttggataagatgaccgttggacacgctattgtcatgtttttcttcttcttttttttttttttttttttttttttggttttgagacacagtctcactctgttgcccaggctggagtgcagtgacgtgatcttagctcactgcaacctccgcctcccaggctcaagagattctcctgcctcagcctcccgagtagctgagattacaggcggctgccgccacacctggctgatttttgtatttttagtagagacggggtttcaccatgttggccaggctggtctcaaactcctgacctcaggtgatcttcccgcctcaacctcccaaagtgctgggattacaggcatgagctaccatgcctggcctggcctgtttttcaagtgatagcagattggtcatatttcattgaatctgagactttcagtggagagagacaacataatagtaggtacaattaggaaaaaacttccatggttaaactgtgcagtgccatcgacggtaagacacactccaaatttggagatgttaaaatgtgaaggaaaatataaaaaagattgtcttagaattggtgaatggcatgcatgcaaggaattaatgtaattcatgttggagacctgtcaaaagaaacagaagtttagaggattttctgttcttctggggctgcagtggggatccggggccctcctggtgccatcctccctgcctttcagatgatttggggtgtttcagtaccaggaatgagtcctcccccatctccattcccctttatcctttgcccttctcatgttagtctggttgtcccagggtgggggcctgtgcttactcgccccgtgctcatccactcactaatccctggacaccctgcccacccaccctgtgtttagttccagagaacgagacgccagtagataccaatctcatagaacttgacacaaagtaagctgaaccctgcctgcagacatccgggggtgggccgcgggtgggcggggtggagggggtcatttgcatatatgcttattaactcctgaggagccgctggtctaaccccgtctgctgagagccacctctgctcgcctcttcagcaacccgcttgcctgcatgtgacttgaaggaccctccgtgcctgttcctcttcctcctgccttggtggggtctgtcttcctccctcgtccttgcacgtccgtccgtcagtccgttcgtccatccacagcgcctgctcggctcacacagggctggtccatggccctgggctcggctctcctgtcctgcccacgccaaccagtggaatcaggctgtggggtgggcaggggactggggatcttgttgcttctgactcctgaggaccaaccgatgtggatttccctgcagtcaaaggccatcgagtcaccggacagtggccagagggggaggacctgggccgactgcgcggaccgcctccaggtccaagtggctttcttgctccagctccaaagccaatcttcccttgtcccccaggagaaatctggggtgtgggggtctcaggtcaccccatgaggatgccccatgcactggctgaaccctgttgggcaggggacccaggtggacacctgcatggtcctaaatggacatgtttcatggtagaagggaactcgctgttcttaaaggcagtctagtcctgaaaccccactcaagcctcccctttcctcacgaacaggtcctctgcccccctatttagattcacatcctcctaccccagccttcttctgtctgggatcccccaaggtagaatctgagctgacacttctgggagaaaggttcttcatggtcttctctttcattaagccaaactactccttgctgtccagaaacgggaatgcttcctaagggtagttttctgggtggtggggtggggtttgccgggcctattcttgggggattcagaacatgctgtgaaactactggtggcctggcctctcacagtgggaataagtccttcctctggctacagagccacactgctccccccacctcctaaagaaccaggttacttttctagccctcaggcacaagagtcaaattcatgcccctctctgcccctttcatgactggcccgagtcctgatgtgactgtccccactgccacaggtggcatccacatgtgccagccagacaggcctttctgctcatggtcagccccagaggccagagacctcagagagggtggttctccccggccccagagccatactctgagtcacatctggccgggcctctggataagcctactctccctgcccctgcaaacacaccacattttccttgtctctcccaccagtgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttcccctatccctaactcatgcatggaaaacgtttgtcaggctggtttcccgagcctcctgcacctcaacatcacgctcacccttttgggtttagcccagtgttatttagcaaatttctccagctgcagggaaggatcagagcactatcttttttttttttttttctcctggagccaggactgcacaaggcaatggccaaatttagttgaattcagcctaccatcctttgctgatgactcagctctatgccaagtactggagccacagagatgggtcagtcccagcccctgtcctcaggaagcccatggtcagggaaacgttgtagggataagtaatagagggcagttgccttcagggctcctggtggctgctggtccctatggtgccttgatgtgaattagaagacggtgccctttccaggtggattcagacctacactagaacgcacagctttgggagtgacacacaggttggattttagcaccccttgccccttggccagaggtgccctgctgcacggccatacgctgcagcctcgagggacacacaggccaaagtgtttccttcagcctcttcctggagaggaagccgcaggtcatgtttccaagcttctggtcaactccaggcaccacctcccagcccccaaacatggccgagccagtgcttctctgc

SEQ ID NO: 14255 - DNA, 26140 bp, Human; identical to SEQ ID NO: 14254

SEQ ID NO: 14256 - DNA, 6375 bp, Human
tgcttcctggtgcatccttcatccgcaattcatccttacctgtgcttttgttgcctccattgcacagctgaggaggccagggcctgcggaggttgagagtgtgctcagggagcccccggagcaaagtggaagccagattccagatcagttctgctgggaattcccagctcccaaaagccctgctggctgtcagtccccagtcaccacaagcacctatcctgtgtgggtgggcctgcagttctgggagatatatcagctgcctgcagcgtcctttgctgaactcacagcaaataggagagacagggaggggtccttgggaagccctaaattgagcttgctgtgggagtcctgggaagaaaggagcctcatcctatcaaaagccgggggaagacatcagagtccctctgctcaggtcagctggcacaggtgggtctccaggcctgggtctcacttccccagagggtgtgttcgggtggccccaggctgagggaggaaagcccacctcccatgtcattttgcaaatggggagtcagggacctagagatggaaagacaacacagcaagtgagggatgggttctaggtcccctgcaccctgcaccctgcaccctggccaacgatgtctatttggcaccagatctgcaggctcatctgggggaccccaggacccagaggcagccgggttgcatctcgaagctgtgagctgcagcccaggaaggtccaggtctgggtggcgctgcccaagcaggctgcaggcccaaggaggaacaaagatcctctcaaggggtgcggagctgaggttccggtcctgccaaagccacttgatgacccccaagtgcccccctttctgcacctcagagaagagccctcaagcctcccaggtcccctccaggggcacgaataagccccagcagggttctgaaggggtcccaggaatctccctgtggggatgcggtggaggtggaggaggctgcggtggcctggggacatctctggtcacaggtgctggtggtatgagagatggggtaggcaccaagccccctgcagctgtggctaggcgggcctgcaggaagggccaggcaggctcctcagggaccacaaagaacaggggttttcacacctaggtgggcctgcatctagctaggacagtccccatcaggccataatgggcacagtgggaggtagaaccatgagtgagagaggggaggcttccagaggcctggcctgggtccctgctagattgagggctctggctatggtacatggatatttctgctgtggaatcaaaggagcaggggatgctgaatatcccctctggccctatgccctgctacctgtcctttcacggaagggtgtgtgtgtagggggtgcaggaccaggcctccctgggtgcatctctgccaccttgccctttggctcaggtggacctccaccaggtattcagaactccagcccagaaacgcgccaagcctgtggggccaagacctagggggtgggggtggcctccctcccgcctgtagccaaagggtcctcccttgcccagccaggccccggtgtcgcttactgctcttatccacccctccttcccaggccggtcctcaaggccccagcaaaggaaccaagttcccgtgagcctccgaaaggcgaagggcaggcagcagccgctggcttctgcgcccactaggagcttcggatgcccgagttagggctgcgccaaggcggccggagcagagagggagacggggacggggacaggcagggacaaagtgcaagaggcaaaactggctgaaaagcagaagtgtaggagccgccaaggggcgggacgaacaggtccgtgggccgggcggagccaagggtgggggccggggtccctccaggtggcactcgcggcgctagtccccagcctcctcccttcccccggccctgattggcaggcggcctgcgaccagccgcgaacgccacagcgccccgggcgcccaggagaacgcgaacggccccccgcgggagcgggcgagtaggagggggcgccgggctatatatatagcggctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcccgcccgaggtcggccgtgcgctcccgcgggccgccacaggcgcagctctgccccccagcttcccgggcgcactgaccgcctgaccgacgcacggccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagtgagtggcgcggccaggcgcgaaggggcgggggcggggggcaacggccgccgggccaacccgctcagtcacactctgagaccctcggcgggcacctgctcgggggccccgggaaccggggcggactcgggctccggtcccttctgacgcggggctggggacgcagacactcttggctccggcagcccagcgcaacccctgaggccgggcgccgcctcccgccttcagaaactcgggctccgagcgccgaattccagcgccttcgcccgtgggcacagggcgcgcggtgcagccacagggggcccgagacacgcgccccggcctggcccaggctggggaaccgctggggtcgggctcgcgtctgaaggtccgggactgggtgcggccgccgggggtcccctacacaggcaagctaatctgagctagcgcaggcttgggctccggaggccctagagggcagcttgggctctggaggcccttgggggcggctgcgccgggaaccctggccctttatccccaaccccaccccagaaatagggtccccggaggcgaacaagccgaggggcggagtgggccagggatcacctgccccgcaatgacctgcgccccgcccccaggcctgctggagctctcgcccgtggagcggggcgtggtgagcatcttcggcgtggccagccggttcttcgtggccatgagcagcaagggcaagctctatggctcggtgagtaccgcaggggtctggctaggcacctagttgggaacagcggacatggctagcaggctcgtggcttctccagccccacctgtgcctgggtcttggaggggtggcagggtcaccaggtcacgggaccggcaggcctccccagacaaaggaagcagccccaaggcaggaacaatgaggttcctgccatccctgagtgggcccctcccagaccgaggaaagggcgctattgagagcccttcccttctctagtccagaggggtaggtctcagtgttggaactgcgggcttgaggctggacacggagggaatgaattctctggctgctaggtgcagggcaggtggtgagagcaccagctgttgtgggctggccatgtccccttctcaccctgtgtgggtcttgacaccttaactgctcagcagagacatctcagcccagggtggggggtgggacagaagggggttctgacccctggcttcaggctgggtaccttgcccaagaggtgccccagccctgacactgccctgctttgctgcagcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtgaccctccagaggacccttgcctcagcctcgggaagcccctgggagggcagtgccgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgtcaaaagttgtcacgagtgtgctgctattctgtgttttaaaaaaaggtgacattggattccgatgtcatcccctgtagtatggcgtggagcatctctgtctggaaaggcccgcctgaggcttgggcagccagttcagggagctcccaggcttggctctcggctagcatcctcagaggcccactccctttgtgccctgttgctattaatcgggacatatcggtttacttcgggtacagaaagtgcggtgttgaagtcctcgctgccactctgtttttagatctgccaagactgacctttgaactttcctgtagtcaatcttcctcgatctaccagatgggagagacccttggacaactttataaactcctgtttgccttttttggatcagcgacagcccccatcgctgtgactattggggaaaagacgaagctctttcataaattccatggagaggaatcaatatcccactggaaggctagaaatggacaagatagtgtatttgcaatcacaaacaaaaccctagtgatgaaaaataatttgtgatggcagatgcttctgatggtgtgatagaatatgtttttgaaaacaaaccatcgaaccccccgccccacccccaaaacgggcttccctgtgtttagggagctttgggctagaactagctacgatttttaggtgaaatgtccttgtaattgtacaaagcacttggtgcagtgtttgcgtggagcagcctgctgctttctgatgcattccctgtttaagtgcgtttaacatctacctcacaagccctgaaaccccaggcaaaacccacagaaagctcatacccggtgcaggagtttgccatcccaagtggctttttttccatatgtagccaaaaaggattgcagatagcgtcggtgcgtcccattcgaaccttgtcacgtttgagctatctttaccctgtgatttacttttagtaagggtgatcatggtgaaaatatttgcagacagctgttacagtacactatatggtcaccaagtaaccttatatttttctttatatattttacaaatgtaacccctgtcattgaagcaaccgtggaagaggcagggtcggtgatgtttaaaaaaagttccgaggtgatggcaaacatttaattttaatgaatgactttttagagtttatacaaaatgaccttagcttgctaccagaaatgctccgaatgtttcgtcaagactttaatactctcctaggatgtttctgaactgtctcccgaattaactttatgggagtctacagacagcaagactggaaaatctgattggagtttttgtctttcacattccttttgaaaactctttgttcgaatgcaaatcatcgacttaaaatactattcttaaccaaggcctggaagaaagaagacacttgcaaagccgctaagacaggaccacacatcttaaactgctgttcctaccatgcactaaactgtttttaagttttaaaccacaccctaggctccaggagtgttcaggaaagatggtgtttgtaggtctccatgctgtttggcgttggggggtgtggagggatcatccgtcgactttctgaattttaatgtattcacttagtaacaaaccatgattgtcttaaatgccttaaattattatgagatttcttgtctcagagcccaatcagattgtcaggaattaacatgtgttaggtttgatcacccttgaccacttcttatagatatttcttcaacaaatcatgtgtgatgcctgtaggaacacaactgtacctttaaaatattgttttcatattgctgtgatggggattcgaggttcctgtatgtgccactgttttcagaatctgtagttttatacaggtgccgaccctcgttgtgatgtatgtgctgtgcacattgacatgctgaccgacaatgataagcgtttatcgtgtataaaaagacaccactggactggatgtacacaactgggaaaggaattaaaagctattaaaattgtgc

SEQ ID NO: 14257 - DNA, 29321 bp, Human
ttggccaggcttgtctcgaactcctgacctcatgatctacctgcctcagcctcccaaagtgctgggactacaagcgtgagccaccgcgcccggcctaaatttcttaattctaattggattgctaccctctcttcctcttcttcaacatggcaacacattaaggtataggcccttagtctctttttatttatttttgagatggagttttgctcttgtcgcccaggctagagttcagtggcacagtctcagctcactgcaacctccacctcctgggttcaagtgattatcctgcctcagagcctctcgagtagctgggattacaggcatatgccaccaggcctggctaatttttgtatttttagtagagacggggtttcaccatgttggccaggctggtctcgaactcctgaccgcaggtgatctgcccgccttggcctcccaaagtgctgggattacaggcatgagccaccacacccgtccccttagtcttttaagaaggggcaatgaacattctcaactaaatgttggagcttctttacagctttcctccatgggggatataccgctgggattgaggaggggccattaggccaggggaaacatcaatagaacctgattcttcttccacaacaccccagatgttgggcctcaaacaagctggggagggtggagatgacagacactgcctacccttcttgtcatcttgtgtggtccccatcatgcaccaagtggcatacctttcataggacagagaacttccctgagagtcacattcctggatgaaaaattgccctccattggcatgtgccatcatagaataggtcgtggaaggaccgtttggttctaggaggaagagagaccagtaaaaataagcaccctttctctctctgccctactgccagaactgcctgttctcacgtgacccaccttggcagttacccaggatgacttgctcgctcccattttacagtagagaaaactcaaaactgttgccccagagtcacatttggagctgcggcagggccattctcgccctcttgctttccagtttgagttctagatccaaggctgtccaggagagccaactggtttactacaatggagtcttggagtcttctgccctgcctagctagggctggaagaggatcagcctcagccttgtgagtgggtggtacaggatgatttgacaacttaaggataacatgcaagccatagttgcaccctattactgggaagtgtctagtgtgctggcaaaaccaggagcaccaatcagtacccaagttataaaaaataaaatagccctctttgaggcccacgaagcccttgcttatatgggacttaccaagtttaagagttgcgtgcacaaggaatggaactccccaacagtgtaaaggcaaacatgactgaagctttcttctcacttattctatcctgacataaacattctgaggagccacaggagtacaggcttggctgggatgagggacattcagaggggcttgggggttgctaaacaaatggcaggtgcgccacatacaaaaacacaagacacaaagacactgaacctggaggggagagactgaaatggtcagacaactggcatgctgacagtctgacatgccccagcagaagcagcagaagggaacagcattgacctttgggagagtgacaggatgagagcagagtggccccactggttgctgcttgggtagtgctggcgctgagaaataagggatgctgattgaggtggaggtgtgtttttgtgtagtatgactgagggttcctgcaggcagtgcctcagtttctccctttgggacaaagtctcaagctttgcgggtaaagtttgggctagctgccctggaagatcacctgtctgatagcttgcaatctgaggtgtgtgtgcgcgcccgcgtgagagagagggagcggaacgtgcctgagcatggggggaattgggccatgccccaggacttgagccatctctggcacaaaaggagttaatggcagggaccgcgcccccccgtgtccgggaacgcgcagcgcgccccctcggtgcgcgggcacagcagccaggctgccggagagctgatctcggggattcgggtgcggagcccttggcctggaggcgatatgggtggtccgtggcccggttcagtcgcttgcagcagcccggggaacaggtgaggccgcctgccccggtctctcatcctctagctgcccataccttgcccccatcctaacccctcccaatcccaggctcctccactccccagccagtggcccccatccctctcaaccccatgttctccatcggtacccctgacccccgatcctcccccgcttctgttctcccttctacctcctccctaaatcccgcatccctaacatcctcccgcccatggtccctctatttccacagcccatcccgcatgctcatcaaaatacccctattgagggcccccagccccatcccgggattgcacattgccagtcccccctcccctgcagtgcagccccatcccccttccatcatagcatctcatagccaggctccctcccccactatctgcagcccccccacccaatggaggcctttatcctatcctcccccattccagtgcaactccatcccccaatccattccaagccctcgtagcccccaatactgcagttctcaatattggtccattcctgcacaatgccccgcgcccagcaccgctgcagccccaaaagtaccccgagatgccattctcatccccggcattgctgcctccccttgtcttctcccaaattgcaagttggaccaggatggagatcttggccttggggattcacagtgggtcctagggtacagagggcgtttgggggtcggtccgattgtctaggtgttcacgggggaggggctgcagggaattgactcaaaggagaatttggcatttggcgccgaagggttactggagaggagggcatcccgaaagggttaatggaatttgtgggttgggggcagcacccagggggttaatgtgggggggttgctggtggggaagctgtgtgaatgagcggtctgtgccctggagttgccatggagacggtgaatggggggattgtgtgaactcagctgcggactatgccccccccaatacacaacacccacccactccctcctgccccacctccctactcctaccccttccttccccttcccctcctccccacacccgggtgcattctgggcagtgtctgggatcttaccccccatactttgctccccatttcctcatttcctctgagcccccacccctttagccactttacccgccctccctcctcttcctttttcttctctctctctctctctctctctctctctcacacacacacacacacagacacacacacacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcggggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccccatcctggtcgggcatccggaacgccacacactttcccccagtgtgcccccagaacatccacacagctgtgcccgaagtcatgctgccggtctggttcactgccaacttggatatcgtcgctacttacatccaggagcccaacgaagactgtctctacctgaacgtctatgtgccgacggaggatggtgagtgctgcggccaggcactgtgccctccctgcctcccgcctgccctgctgtgtttgtggcttgcatgtggttgtgtgccctgcagcatgcatctgtctgtctgtgaaaatgcttctaaccatcactctgcttggcctcccacccccctccctgttcttccctctcccagcattgtccgagctcccatgtgtgagtgacactgttgccaggaggggcctggcccggcctgagagctctgacgggtctcggtccagtgctggatgggggtcccctgggggagtatgggtcacggctggcagctacccgcgggaggatgctggctccaccaggcccccctgttgccattccacctgcttcgaaaggtggtaggtgtgtgtggccaagggcactgggtgtgtggggggtggggcagcaagcctggtgggtgatgcttaggtgcctcctctttcactagctgatgcctcctcccgcgggggtcacactaaggtaagtgacagaaacaaggagatggtgggacaggctctctgccatgtgccgcctgcagagcagctcagctcttggggcctggggggtggggggtgcatgcccctgggcagaggcctcctgttattttttagttttttattcattttacagtaaagcggatttccaaggaatgcgcccgaaagcccaacaagaaaatttgtaggaaaggaggtaggtagcgagccggcggggagggagagagagagagagggagggctgcctgcccacctgcccttgcccccaggacccagccttcctccaagtagcccaggctcagggggcagtaagcaggcataagcgccacctcatctgagggccctggctgccttgcagggaggatttggtggcctaaggcaggctcagagcagaagcagcaaccctatttcttccaatcttcccagccccaaattccaccctaaagtgtgtgccaaaggcagagccagtggctctctcggtgacacctcaggagaaactctaggaagccaagatggagccagaggctccacccttttcctagtgggtggagccagaagaccatcccttctgtgttctttctcctggattgaaagtctagactcaattttcccaccctgaagcttagaccaaacgtgtacacaggtttagtaactcctgccatacacacctctgtctcccaccccactacctctggccagagtgtagctgatagacccaggctgctctggtggcagaacttgggggtctctgggaactatggactttaaaggaggcaaaagatcctgaattttaaatttaccctcatgctgagaggagtttctccccctgtataataattcttcctgttggaatatcacttcatgttttctgtaaagtgccttggcatttaccttagagaatcctccctgtatctctggaagcgtctaaggcaggaatcagtatcccaattttacagatgaggaaacaggcccaggggagtgacttgctgctgctcaaggcccctgtcgctggtctgtggcagagctgggaccaaaacctgggtctcttgaccttcagggcgtgttctttccactgtagcacacagaagcaactcccatctgctcattcccatctccccaactcaaaaaaaatggtgagatgtggctgggctggggagaattggaacagtaacagcctaaggaacaggtggaaaaatcacagcttgatccctacaaccctctggcaagctgggagtttgttttcctttgatgtcctagggcagagtttctcagaatggggttgccaggatttctgggatggggtgctccttactgaataagaatttctgggggcagagcctggaaatctatatgttgaacatgagccctgagcgcttctaatgcacacccgagcatggaatgagacccgctgctgtagggatagtatttcaccacagccccataccccacccaggacctcacacaccataggcaattgatgttttttgtgtaattcagaagcatcatggtgctgcagaaagagtacaggtctgggaagcacaaggcctgagtcccagctctgctgccaactcacagtgagaccttaggcaagtcttgtccttcaagaacctctgtttccacatctgaggttggtagggtacagttctggccttagcattccattagcctgtaaatgaattcaggaagaaggtctcttaaacctgcaggagaggccgggcgtggtggctcacgcctgtaatcccagcactttgggaggccgaggcaggtggatcacgaggtcaggagatcgagaccatcctggctaatacggcaaaaccccgtctctactaaaaaatacaaaaaattagctgggcgtggtggcgggtgcctgtagttccggctactcgggaggttgaggcaggagaatggcatgaacccaggaggcagagcttgcagtgagccgagatcgtgccactgcactccagcctgggcgacagagcgagactccatctcaaaaaaaaaaaaaaaagaaaagaaagaaaagaaaagaaaaaaacctgaaggagagatggcattcacattaaccatttcttaggaagaatgatcgcccagtaagagccttgggctgtccagtccagccctgagagtgtggccagagagcagactggaagccccggctcaaacatgcacatttaccaatcgtgattgttgactgtgggcaaggccatgtgctaggtgttgttgggatgtggagggatgtgaggtagaggaaagatttagaaatgactaaaggcctaatcactgctctgaagaagctcttagccttgtattaaaactcagctggtttggccgggcgcggtggcttatgcctataattgcagcactttgagaggccaagacgggtgggtcacttgagttcaggaattcgagaccagcctggccaatatggtgaaaccccatccctactaaaaatacaggtgcatggtggcacacacctgtagtcccagctacttgggaggctggggcaggagaatcgcttgaacccaggaggtggaggttgcagtgagccgaggtggtgccatcgcactccagcctgggcaacaaggctgaaactccatctaaaaaaagaaaaaaaaaaaactcagctggtttccctaagtcccatgggccaatcaggaagtgggttccagacagtgcaagggaaggcatttggtcatttcactgttcaaattagttccctacccaggacctggtggccatttggaagagtgacaaatcccgcctcttgagggagacccatcctcggaggtcgttagggttgtggtgtgcagaggtctggggaccagcctggctgggatccctcagcggcgcagggtctgggaatggtggtcggcagtcaggctggcctgggtgagaggcatggcggctaggagctgctcaggaagtgccaggctgaaggagcaaaggcatctgtgtgaaggaggctgagacaatgcagcaacccaggaacactttcagagggattcacaagggacgtatcttctaagtcagggatgatgggaaatgaagggtttcctggggaagacctgccccatctccccaacaccccaccccatcaagttggaaggaattcgtgtctggggatgagcaattccttcccgtttggtaggctgtccgcagtgtgagggatgatgcccatgtcccattaaggtttctgaggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttccctcccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagggtattggtccagttcacagactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggaagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgtcctgtcttcacctctacccacccgccccacatctctaaacaccccacacatgcacagatattccttccagtccactccatggccacacacctatttaccttcatgtgtttacacatccaccccgccatgcacctgcaggaagacggtgatttctcactcacccccataaagtacacacacctagccccacattcacatctccaggcccctcacatgtaaacacattctcctagcactccaggtaactccattcacatggtctctccagaacacatatccacatacccacacggtctgtgtactccacgtctgcaccccgcagatggctctcaccctccgcatgtacacacacacatgctcatatacttctccccatgtctctgtagccacatctaaaccgatacccacgatgcatacacacccacactcacactttacccccatatttacagcccacacaaaaacctacaccctgcacatccatgtccacaccaaactccacacatatacaccttaaatgtacataaatattccttccacccaccccccacaaatacctacacacgcccgtatccccctgcacaccctacttccacatccactttacacatccacctaccacacacacctgtccctcactatctcctcagaaacacaaacaaatattccccttccctacacacatatactcttacctgtttgtccacactgtcccaccccacacatacacagatactacacacacaccatatccacatctatatacatcccacacactgcccttatgtcattcccctacacatacattcccccacacacacatccacatatgcatgcacgcgtatacatgcgcacactcttccatatacagcctgtatatgtacacccagcacacacccatgcacttctcccctcaccccaccccacaaatatatacacatccgtgtacatggggctgcatctgtatccatacatgcacacacacctctacccaggcccaaccgcatccctcaagtctccccacacttccttaccccgtatatgcacacgtacacactctttgtactctaagcatgtcccctgcacactcccacccatcacacacatactcccatgcatatgcactcattgccgaaatgcctcctcatatgcacccatacacctccccacccccgcattctctgctgtgcacaagcttgtgtcagtcatttaggctgcccttgaaccctgtaccttccttggtgaccacccatgcctatctatggccaaggtcttgaggtaaacgagtgcctcagagagggtgactaagcacacagggccctgctcatgctcccccaagccccgcatccctgtagtggcatgaagaagccaacttcttcctggaggaagagtttcagcgggagtgtaggctcttggtcaggtctgtaggcatatgggtgctaaaccagcagttaggcgtggcttattccatggctaactaggggacacgaccatatttgattttattttcatttaatttttgagacagggtctcactcttgcccaggccagttttgaactcctgagctcaagtgatcatcctcccacctcaagggccttattttaatttgcttatttatttatttatttatttatttatttatttattatttttattttgtttttgaggcagagtctcactctgtcgcccaggctggagtgcaatggcaccatcttggctcactgcaacctccgcctcccgggttcaactgattctcctgcctcagcctcctgagtagctgggattacaggcacctgctaccatgccaggctaatttttgtatttttagtagagacagggtttcaccatgttggccaggctggtctcgaactcctgaccttaggtgatctgcctgcctcagcctcccaaagtgctgggattacaggcatgagccaccacgcctggcccttaattttctcttgactatattgctttgtcagttccaatctcagaggctccggggctgcatttcacttctgggtgcagttgtatgcccagaacggcaatcttctcttggtttacaattaatactatgtgagataggaagatactcttttggggttcaaactgcagaaatgatgctcctttaaaaaagcaaagtcggtgtccccttcattggcgcccgggagactgaatatggagcatgcaggccattcacgctggcctccccacggtctggtaggcttgggatgttgggatgtcatggttctgctcctgcccctctgtctttctgcatcacctcagacaccatggtgaggctcttgtaagctgttctgtcctgttgaatctcatggtaccatgaaggtggctggaaacccacacactagggctgcacactttctttttttaattaattaattaattaattaattaatttttgagacagagtctcactctgtcacccaggctggagtgcagtggtgcaatcatggctcatcgcagcctcgacctcccaggctcaagtgatcctcccacctcagcctcccgagcagctgggattatggattacaggtgtgcaccaccacacccagctaatttttgtatttttagtagagacaaggtctcactatgttggccaggctggtctggaactcctgatctcaagtgatccacttgccttggcctcccaaagtgctgggattacaggcgtgagccaccgcgcccggctgggctgcacagtttctagagaggaatgaacgcgcaaatgtgatcacaaacagatatgcagacacatgtacacggtagttcaaagccaaaagtaattttgctactttcttttcttagagtgacagaaaacactcagctcagctgcttaaaaaaatataaacacaatgctccattctataaggtttattggaaaatacaaagaatactaaaaatatgcttcagagcagctaggaatgaagaaagagagcatggaaaagagggagagaaagaggagaaagcaaggaagagaagaaaaggagaggataatagagagtcagggagaggaagcagagaggagacagaaggagagacttaggatctggggagagactcggcatttcacgtaggatgtgaagtctccacagtgtcagttgggaactgtgggccgcacagaaggctgtcgctggtgagcattccgtatgatatcctgatttgctgattacttcacaatccttcagctgctctaatccttaagcttctacaccagaagttcttaaccttttggggcatcttggacccttttgagattctgatgaaagctatggactctcccctggaacaatgcacacatgcgtgtgtgcacacacacgcatgtgcgcacacacacacttaattttacagggccgggtgtggtggctcacgcctgtaatcccagcactttggaaggatgaggtgggtggatcacctgaggtcaggagttcaagaccagcctgggcaactaaaccctgtctctactaaaaatacaaaagtgagctgggcatggtggcatgcgcccgtagtcccagctactcaagaggctgaggcaggagaattgcttgaacctgggaggcggaagttgcaatgagccaagatcgtgccactgcactctagcctgggcaacagagtgagactccatctcaaaaaaaaaagaaaaggaaaaagaaaaagaaaagaaaagaaagaaagaaaaaacaattttacagatcccccttaagttcatccatgaaagtcaggttaagaactcgcacttgacagccccgtcatttggataaccagaacagcacatctagggggcaggaacattcttctttgggcttaagcagttgatgatcaaatatcaccgaaaactcagaaggagtcctacactgagatttgctcagaagttcctcaccacttcctgcacacccttcagttcctgttctggaacacaaatataatcaataagcccgtattggatgccgggtacatataagatgtttgtttttgtctcttgacaccagatgtagaacatgggtttgtccctgatgcttgggaattttcttttcttttttttttttaattgagacagagtcttgctctgtcacccaggctggagtgcagtggcacaatctcagctcactgccaacctctgccgccgggttcaagcgattctcgtgcctcagcctctggagtatctgggattacaggcgcgcaccaccacgcccagctattttttttttttttttttttttttagtagaggcgggggtttcgccatgttggccaggctggtctcgaactcctgatctcaggtgatccgccctcctcagccttccaaagtgctgggattacaggtgtgagccactgcacccggcggggaattttcctgtgtagtggggcctttgttgttttgttgcccaaagcatcccagaacaggtggtttgttttggaccccagtcacaggcattcattcactctccttcccatcagctttcctgagcactgaacccatcaggcggttcactctaaggtgcttatcttttttctttctttctttttttttttttttctttttgagacagagtctcgctctgtcgctcaggctggagtgcaatggcatgatctcggctcactacaacctccgcctccccggttaaagcaattctcctgcctcagcctcccaagtagctgggattacaggcgcctgccaccacacccggcatatttttgtatttttagtagagacggggtttcaccatgttggccaggctggtcttgaactcctgacctcaggtgatccacctgcctcggcctcccaaagtgctgggattacaggcatgagccatcacgcccagcctctaaggtgcttttctagatatcttgggtgattcatgaatgttgagaatgtcacaggctaatccatggatcctctccaaggcagaggggtagctattatttgagaaggccccactgggcttgaagccaacaaagaaagggactccagcaggatataggatgtggaaatccctgaggctgaggaagcaggcacttgccaagttttactccaggttccagaattgaatcctacatgcttgctcaggtaccctccaggcaaaccgaaaacccagtaaacatcaagccttgagtgacacaaatatctggttttgttacaatctgccagattccccatcttctgttgacgagcagtttaccatgaactgcagtataaacttgggcccagggagactggctccgatttattctgacagtttatggagtttagtatttcagccttcattctcacatggtttctgtggatggttgagttactggggaactagcagtgagtgacctctcccagaatgccagatattgtgtgcttgtggttggtcaggtttgctgtcatcttcctgagcctgttggagatagcatttcttttttcttttcttttctttcttttttttttttttttgagatggagtttcactcttgttgcccaggctgcagtgcaatggcgctatctcggctcaccgcaacctccgcctcccaggttcaagtgattctcctgcctcagcctccctagtagctgggattacagtcacatgccaccaagcccggctaattttgtatttttagtagagatggggtttctccatgttggccaggctggtctcgaactccagacctcaggtgatctgcccgccttggcctcccaaagtgctgggattacaggcatgagccaccacgcctggcctggagatagcatttcaagcaggactcttcatggagtagggatcattgacatggcatcatccacatgcttcagggccccttaaccagagactcataggatctgagagagcagagagtgatggtcaaatcctccatccaatcacctgaggtcaggagttcaagaccagcctggccaacatggcgaaaccccatctctattaaaaatataaaaattagccaggcatggtggcaggcacctgtaatcccagctactcgcaaggctgagacagaagaatcacttgaacctgggaggcggaggttgcagcgagccgagatcatgccattgcattccagcctgggcgacaagagtgaaactccttctaaaaaaaaataaataaataataaataaatcctccatccagccctttcaggcctttgttcctaacccaggaaattggtacattggagaaatctgctctactacatccaaatgcaggctttgcctgctgattaggccaggcatgtttgacacatttcagtaaatgatgccttggcaaaggctgaagccaagaccactattgcctaaatgaaagaaaaggaaaagagaatacaggggaaggagagaggagggaggactaaaagaaggacagtgatttctgccagagggtcccaaggcttgggcagctgggttggatcatggtcaacagagttggggttttgagggattttttttttttggttgcttttttagagatggagtctcattctgtcccccaggctggagtgcagtggggtaataacagctcactgcagccttcacacctaggctcaagtgatcctccagccccagcctcctgagtggctgggaccacaggcatgcaccaccacaactggctaatttgttttgttttaaaaacaaaaagggacagggtcttgctacactggccaggttggtctcaaacttctgacctcaagtgatcctcccacctcagcctcctaaagtgctgggattacaggtgtgagccaccatgcccggccaagtttttaagactcaaaggagcagcttcaatttctgaatgggccacgcaaaggaaaagctgatttccttgtctggaagagcaagggttccttcttcatcctcatgcaggctttctctaattcattctcatttcctcctctggaacctggggctaaagaggacttgtgactagggcccgggagaaataactaagtactttacatacttaattgtaccagaggtaaattaataacacacttgaagaggatgagatgagctcttttgcagaagctaggtacagaaggacttgagaaagacagtggtgaggtcttgtgactgtttgagtctatttgaattcagcctctgcctatggactgcaaggacgccagagaactccccatgagctctgggagtcttctccaacatggcctctcacaaagttgattccaggtgctgtgaatgagcttttaactggggagtaaaaaatactgatccaagtgtgggtttccaatgtgtaggagcttcacaattacccacctccaaagacttcttccaaaagcctagggcaggagaagacagagccttccaagggacccaaggattcagggaagagagatgaaataaggccgcaggctcagtctaaaatggaagcagagtaggggggaatataggacatctctgtgggatagccagcaggtgggcaggaaggtagtctccatggcaacaagtctccacagcagcaaatcccagcaggtgggtgggaaggtagtctccatggtgacatgtctcctcagcagcaaattccagtgggggggcgggaagacctgtttctgtggtaacgcactgcgctacttccccatttctccaccagatgaaaaagatggtctgacccagtggtttctcaactttggcaggtatcagcatcacctggagagcttgttaaaaacacagattgctgggccccaccccagagtttctgattccttaggcctccaagggagggaaatgaggacctgccctgaaaatgaggggaagggggccatcaaggccccggaaggaagtggagagggactgatttgaacaggaagggcaaggagagcttagggattgttgcctcttgggatcatctacacttcctttggagagagaagaaaggggaaagagaagtaactatagagctgcaacgtgcccagcatgttatagatgcttatgttcattttatccttgttacaaccctgtgaggtatttttatccccattttacagaagaggacactatggcccagagattttaaattaagtgcccaaggctacatgactaagatgtgatagagccaggattcaaatcaaggaccgtctgactccagggtttccattctatcttgccagatgttagggtaaggtccccaatagtacatcagggcagagaatgctgagttctggacatttgcagtttctgcagtttgtctcccacctggaggcatgcacttcaaatggtctgcagacccctccttccaagctggataacaggtgggaggcagggagctgacccctcctctgttgacgatgctggacattgcagaaaggagcactgctttaagttaactatgtgggaagaactacactgcgtgctcattctctattcccacctcccctgttgaccctgcctgccgtcatcacccaaatcctccatccctctgccttcattgtcttcatgccctttgttgaatccaggtttcctgagtactggagatcaggctgccaagggcaactatgggctccttgaccagatccaggccctccgctgggtgagcgagaatattgccttcttcgggggagacccccgccggatcactgtctttggctcgggcattggtgcatcctgcgtcagcctcctcacgttgtcacatcactcagagggtgagtaactcgtggggcaaaacatgaactagccaagtgccggctgtcccagcatgccccatccatgccccagggcatccaagggaatcggccagctctcttctaccagcttggtatccctttggcaagaagtggaagagaaatgtttctctgggagaagtacttctcccaaagctggagagggaaggaagagaatcccatttatgtcctgggaaagcaagattctccttctgatgtgggagtcttattttggggagtgggaatagaacaattgtcccctcagaggacaatagtttgacaggggttggggaggatctttcagtatgggaaggacatgttacttcacagtagagatatagggtggaaattggtttctaggtctaagaaacatccattctctgcctttctctctgaagaacaagtctgtacaagaggggaaacatcctagagggggaagtgggtctgaaatgagagtcactaacccacgaggtgggcttcttccataggacgatggtctattatcagactccagacctctccccgactgtgcaagctgccggggagattctcatttttggcctctctccttgtggtgggtccctttgccagtgacccttccaagagagcagaataggtcctttttgctcggcaggaaatgttttctccacctctggactactgggaacattctatctctgagaggcaaagctgagcttctcatgaagaaaagatcttcctgaaataggtgcccttttctgaagtaaggaaatctgtgagcgaggatgctttttttcttttttaattgaacactaaccccctgagttagggacattctcacaggaagactttccatctcttgaagaagttctgtctctctgagagagaagaaccaccttctttgacctagaaattctgtctttgcccctccagggactaccctggtgagggaagacttaggtgggatctgcctctctaaagagagagactgtgttcctaggtgaccatagtgggaacaggaatcttccctttttccccaaaggagggcgaaatgacgggctgcaagggtgccttggcctgaaaagacgttctgtgcctcctctgactggggactcctcccctaggagaagaaagcctttcctggagtggtgctatgctttgtctcatagggggcctgtgtctctggaggtttgactttttttttttctttgagacaagatctcgctctgttccccaggctctgtcccccagtgcagtggtgtgatcacagctcactgcaacctgttcctcccaggctcaagtgatcctcctgcctcagcccccagagtagctggggactacaggtgcatgctaccatgcccggctaattttggggataaatttttttttgtagagacaggttttcgccatgttgcccaggctggtctcaaactcctgagctcaagcgatctgcctacctcggcctcccaaagtgctgggattacaggcgtgagccactgtgcctggccgaggtttgacttctttaaagatctgttctctctgtttttctgtaattgatgcatggagaataatctttgggaaaatgaggctgtcttttaagtagtaatctatcatttctttccctctctttccactcatgcaaactggctttctcttaaaggaatggaattatgtgcctgagggacaaattctcccttgggaatgttggggccagggagagaatgatatcctttttttttttctagaggggaaaattattttctttttgagtttgggggactggctccctctctgctaggggaaaatctgaatttgaagtatcggtagcttcagataaaaggaaagtctctgccaggcgcggtggctcacgcctgtaaccccagtactttgggaggccaaggcgggtggatcacctgaagtcggaagttcaagaccagcctgaccaacatggtgaaaccccgtctctactaaaaatacaaaattagccgggcgtggtggcgggtgcctgtaatcccagctactcgggaggctgaggcaagagaaacgcttgaacctgggaggcagaggttgcagttagccgagatcccaccattgcactccagcctgggcaacaagagcaaaactccatctccaaaaaaaaaaaaaaacaaagtatcagtggagaccacagacggggagcacaggttccctggagactttcagacccgaaggcctttgcccttgggctccttccccaagccctcagaatgtggggctcttgcctgcctgcatttctcatctctcatgaaaaagactcctttgtggtgcaagtgccagctccctggtggtgcgctggcacggagctgggcccagctgggcaggaagcaagaggggaagacaaggagagataaagagaggcggcataagggggctgatgtctgggattcaaggggttaattcttcctgacattgccttaacccctaagttaccagccatcgcaccaggacagggaagggatggtggaagccatcaaggaaggggttcagcaacccctcctttggccctacatcatcccctgccaaaagagttgttcccccttcctagcccatttaaaccatggggcagcctcagtgacaaaggaatgaagagatttatggctatgtgtgacacgacagatctgacctggtgctacctgtcttctgtaggacttttccagagagccatcatccaaagtggctctgctctgtccagctgggctgtgaactaccaaccagtgaagtacaccagcctgctggcagacaaagtgggctgtaatgtgctggacaccgtggatatggtggactgtcttcggcaaaagagtgccaaggagctggtagagcaggacatccagccagcccgctaccacgtggcctttggccctgtgattgatggtgatgtcattcctgatgaccctgagatcctcatggagcagggcgagttcctcaactatgacatcatgctaggtgtcaaccagggcgagggtctcaagtttgtggaaggggtggtggaccctgaggatggtgtctctggcactgactttgactattccgtctccaattttgtggacaatctgtatggctatcctgagggtaaggacaccctgcgagagaccatcaagttcatgtatacagactgggcagaccgtgacaaccctgagacccgccgtaaaacactggtggcactcttcactgaccaccagtgggtggagccctcagtggtgacagccgatctgcatgcccgctacggctcgcctacctacttctacgccttctatcatcactgccagagcctcatgaagcctgcttggtcagatgcagctcatggggatgaagtaccctatgtttttggggttcctatggtaggccccactgaccttttcccctgcaacttctccaagaatgatgttatgctcagtgctgtcgtcatgacctattggaccaactttgccaagactgggtaaggagaaaatagggtttttttcctctttgagaccccagcatgccctcccctctgctcctctagctaaacctcttccatcatatcccttcctaagatattcccaaaatcttgcttggtaccccttcactcatcttcctatctccccttcctgagtctttcatgccatttttccttccttcaaaaatgttgttgaggcttagaactcagttagcatcgggactaggaaggaatgagggttactggaagaactatgggatttagccaggcccagtggctcacggctgtaatcccagcactttgggaggcaaaggcaggcagatcacttgagcccaggagttcaagaccagccacggcaacatagaaagaccctgtctctaaaagaaaaagcattagccaggcatggtagtgcatgcctgtagtcccaggtatttgggaggctgaggtgggaggatcgcttgagccccggagggtgaggctacactgagctgtgatcacgccactgtactctagcctgggtgacagagcgaaaccttatcttaaacacacacacacacacacatatacacacacacactatgggattcaaggttagctggtcacaggctatgtgaaataggaatgcagtgcttcagaaagagccttcagggccaggcgcggaggcttatgcctgtaatcccagcactttgggaggccaaggcaggtggattgcctgagctcaggagttcgaaaccagcctggccaacatggtgaaacaccgtctctactataatacaaaaaatttgccaggcgtggtggcgggtgcctgtagtcccggctacctaggcaggagaattgcttgaacccaggaggcagaggttgcagtgagccgaggttgccccaccgcactccagcctgtgcgacagagcgagactctgtctcaaaaaaaaaaaaagaaaaaaaaagagagaaagaaagagagagagagaaagaaaaagggaagaaagaaagaaagagagagaaagaaagaaagagaaaaaaaaaagaaagaaagaaagaaagaaagaaagaaagaaagaaagaaagagaaagaaaagaaagagaaagaaagaaagaaagaaaaagagacttcgggttcagcaacttctgcttgcttaataaaagaaagaggctttattagggggctcctggcaaaattgggcagctgaaaagattgataaatgctcagtagcatgtgcaaagaaaaagcatctatagccttaatcttaaaggatgagcgccgggaaggaggatataggagttcaagccctggggaagaagcaggtgtgggcagagcaggggaccctgaaaaagatggaaatggtgggaagttctaaactgggaaagaggtttggctgtcagaggaaaaatgctgggccttttcctcatccagatagagtggtgaccccagatttccatgtggtatttcagggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaagcaagaccatggggtggaaggagaaaggggctagcactggatggagctggagggtcgtaggggagagatctccaactctctctgtgtccgtgtggagggctgcagagcctgcagggtgacctgcttccccaaaggccaacagcattggcctggccagaccaggtgaccttagatttggtgaacaacgtactatggaagccacatcactattgggcccccaggtctgatctgggttttgcctctgcccttggggaaatgctatcagaaattcgccccattttctttacagtcttttgtgtctgtcatttctctttcaaaaaggcggtgttttttgttgttgttggtttttttttttttttaaagaaaagttcttaaaacactaacggaaacccatggagtttgtcctttgtaaaaattttaaacacagtgtcttgatataaaaataaaaaatccagttagcactcccaacctgcctcccttgcacaggccttgccccaacagacctccgaacagggtgcctctgcgggctgggaatcaggcaatcaggcagcctccccctgcctcctgtatctttaagctgagtctgggctgcactgtgcggggttgggggttgggggttgggggggttggggggtttgggggccccctgcatgaaggcctctccaatcttaatcaggttgctcttcccatccccctgcccccagcgcgctgggttcctgcagctgaagcctcctctcagcacttcaggcctcctaatgaaatggcaaaaatacttccttccttctctgcaccgctgcggcctcctcctcctcttacttctcctcctcctcctctgctgcaaccaccctgccctcaccttggactgggggctgggaggaggtttgacctctaacgtgctgaaattctttctcctatctgaatccagtgcagcgtcagacgtggactccctggccttgagtgactgacagagcagaggccctctccttccccagggatacttgtttgctgctctgtgaattagaactggagaagtccttggggccctgggagcgatttttctacaggattgtgatcagtgactccctatcaaccctggggcatggattcagtggggcctcacagggttagcattatgggatttcatattattctcagtgacttgaaagactgaactgggagtgtgctcggcaagtatgatagttgggtggggttgctgatacctcagaaagcaggaatagaattcttcaaatgaccctgataaaatgagggagatgaaccatcacaaggaggaccatgttcagagaggacgaacacaggtagtgtgtacaaagaccaaaacctagaactaatacactaatatggta

SEQ ID NO: 14258 - DNA, 29321 bp, Human; identical to SEQ ID NO: 14257

SEQ ID NO: 14259 - DNA, 174262 bp, Human
ggtctagacatgaatttgatttcctttgcttcttaatgttcagtatttcacacaatagacattgatggaagaatgaacataagaattgtcaagtaatttttacaccactctctaatttatgcaaacactaacttctcacagtctgaaaatgtgaatttttccccctctgtgctttgatggctaacattctttttaatgacagtcatttctataacaggaagatgttttcatttgtatttacttttcagcgcgacgcaattatgcagttttgcgcttcagtagtgtctcggtactttgtgtctcaaaagagaattacagtacttagaacaggactgcaatttgaagcaggtgttgtgttttactgttatgcaaaataacagtaaaatataattgtgggagaaattaaggaaacagctgcaaacttggtatgaaaactgctacattatgatttgtaagcagttcttatagatatcttacatcagaggagcagggaaagattttaatttagttaatcctactggcctggttgtctatcatctggcgcttaaaagactcatacctcccatgaagtcaggaaaaagaaagagaacccaaagtgacactttgtttaaaatgccagagcacggggattcatctcttggcagtgcacttgacattaggaaggcaggcaaggtgggtgttatttagcttgctttgctaatatgaagaaggcaatgatttgagtagaacactctggaatttcttagcccagctagcatatgggggattactcaagccccgggttgtaaaataataaaataaatggcctatggcaggccatctgccttttgctcgatatttaaggtgtttcatgccaattttaaatctcatcttattattctaaatatttttatttgaaatagcagataagattctcagagcttaatggtgcacatggcaaacctattctgacgttgtgcacttaaagtaagagcatgggttacctaagggttacccaaggagtgtactacggcttcttctctaccgcactgatcaattgcaacaacttggacatgagaatttgcttccctcagcctttgcacacctaccataaaaatagacatcttcatttctcaacccagtgcagcaaataatatattgacatttatgaaaaaatcagaactaatggaaattttaaaaaatgaaaccaattactgagaattacgttgcaccaagaatgaggtggcagatgtaatggccgcccttctttaccgctccatcggggcttgaagaagggaggtaatgaatgcattcaaagtggtggtccagacctggaggtgtttggttttcccctgagtgactggagtgttgaaaaaaatgacactacatttaacaagaaagatttgccttaccataaggttctgggccagtgaggaatgccaagcattgcctacctgtgtattttgggagctgcttgtgaaagaaaaaaatatgtgtaatgtgtggttattatgtgcatgttatagtaatacacatgtatttgttataagcacaacattttaaattcttatctgtcattgtgttatatagctgctttaaacatggagctttcaaatgattacgtgacaccaactttgtaaagaccaaacattccaattagcagggcaggtttggaagattcttcacttggagcacaaaccatgtatagccagatgccatggcaacggtggatatgccccttccgtaattcacgctaagtgccataattataattaaagaggaaatcttagtttgaactccattgagaagatttgctagcacccagcaatatgtatagagtgtaatatccactttgaagtgcatgaagggaagagagttgggaacagttgtatccatgagccaacaacacatattcagattttccctgaactagtttcatgtctagatgttaaatttatgtctcttagaacaccctttttctctttgttctcattttatatacattttttttttctttcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatgtaagtatcgcttatgaacttaacaaaattagcaatcaagaaaataaaaagaaaaaaagaaaagcattcactattaacttctgctagggagactaaaaggtaaatgatttacaaatcagatggatatctgtggtttcaaatacagctcaggaggaatcccatacatctgtgtaacatttcaaattttcagagcactttcaaccacaattgaaattagattttcagagcctctgaggactggtggttggttgcccctatttatagataagaacggaaaagaacagagaggttaaagtatttgccacacagcgaatttgcctgagactcctgacccctagttcaatttgctttacattgtattgcttgcctccattctgaaatatttctttaaaatttctgtagttttttttttttttcccacacctcaccccactagccctttacattcagctgggaaataggcctaattgggactaattgtccagctactgctagatccattgtcttgcctgttgctagtgaaacgtgtgctgcatgctacaggactcaaacaatatggggaacaaaggaataagggacagtggaacagttggttccaggaattgtactttcctctcactccctaatactatttaagtcatgttgaggtttaaactgtttaaggagcaaagtgtggcagaaacccagaggcaaggattttgcagcacctggttgcacatcaacttttttctggtcctctgctacaggatgtgctgggctttcagaagaagggagcaaaaggtcaccatctctcttgtttattcaaggcctggtgctcattctctatgagacccttccaatgtctaacatgagtctttcatagtaggactaaacctctttgaaaactattgtatagtcaagatagaaaggaggttagagctctgttgactgtttttaccactcctggaagaattgaactcggggcatgtccaagtcacaagctctttttttaggaattgttttacatgagcatttaaaaaaaaatagtaggacaccccaaatacacacacccccccaccctggaatttacaaacgctaaccaaacaaaagggtctttccattgactgcctggatattagtgtaaatactaggatgttgctttgcaagtatattctggagagcgagtcagttacctatgatgagatttctgcaaagcagccgttttaaagcagcatgcttgagtgaccaaaaaaaaaaaaaaaaaggaaaagacaatccttgtaagtggttactgctaaactatttgaaagaactttatacgttctttaaatgagaatatattcatgattatgaaggatcgctaacatgattttaaggaaaaatggataaagtttttctttgttaaaatagcttttctgaacaataaatatctgtttaattcaaatattctttttattctactgtttctatttacttgtttttcttcaaatatgttacaatatttgtgtaagccatactttagaatagcttcagttctgttttgctggtgttatgtttttgtattaaagaactacaaggaactttgtagatgctgtttccattcaagcaaaacaaagtgtgttttgcccagattccttggaaaatgactgctggggaacctcagcttagttctcaagtctgcagacatctgctcacttgttcttggcctcaagattccactggcgaactgtgaatgcacagagatattttaaaaatcatgtaactttaaagttgatctgcttttatctagccataacaaatttgaaggatcaaattatacctcttttgaaaaaaatggcttgaaaatggggcaacctagacagctgtgtagtgctttcaccagactcctgatcttggaatagaggattcttctacaggctagttccagtgtaccttttcacttttattgccaataagggcttcccatctgaaccctctgcttcagccacacagtttggctccctgtcatctgaacacatcttagcaccttccatcttggtgccattgccatcactgtttcttacagagcgtaacacatttacgctctgctcatcaaatgcctcaaagctagtttaggttcctccacttaagccttttctacctatccgtttccaatccaaaatgatcatgcctgcccaagttacttggcaacactttataccacctccattattatttttcttaatctgtctgtttctctgtctacctacctacctatctacctatctgtatctatctatctgcctatctgtctcttattcttttaattttttacttcttaaagaaaggcttgttcttctgagcaggtgacagatgctcaaaaacactggtcaattgatccattgatttgattatgcattgaatagagagaatagattgatgcttggagattttcactggaatttttctgtcagttcttgacattttgaatgttttcatgatggtacgtgttgtcaggaggctggcttaccttttccctggctttactctttcttgcttgagaacatgccattgttttgtaggcctgatggcctcacacagtgactgacctatggtaggtggtcagggatcttggttggatttaatcatgtcatatttctgttatgttaagaaacaaaaattggccttaatctaattagaaactttaattggctagaaaatatctataaaatatttagtctaaaatgtcttcagtttttctgaaaatttcaacatgtcatggcagaactttgctcctctccccgaggtaaagatattttgtcttttccacttgcgtagttgctcatttattttgcatgggattgttaaattatttgcttccttttttcacttacacttgagatttctgaagacccctgacagatcacttggattatagttaaaaaccctatccctttaatgatgtcttactttcttttctacagccttgtgatggtagttggggtttttcaccttaattaggaagagctcacttcccatttaattcaattagtctcagctcagctttgtgactaacaaattttcttttccaagtctcagtttactcatctgtaaatatttgcaccaaatgatggttaaggatctttttagctctgacttgctaagattaagattgcagttaagacaatgtttatttgcaaggcgatgctattaaggaaacaaaaataaataagacccagtccccatcttcatgaagctcattgctgatttcagagctgatgtttcaaacagctttaagaagcattggtttagttttcatctctgagttctgacaagattaccaccaagctctctaagaatgactggcttgaatctctgcttgttatggagggaagttttttttttttagaaagcaatcctgtatgaccttgggaaagaaaattaaagcacagctggagttggcagagcaaaatttaacctagaatttgtgtgcctcacttacccagactcttgagcatactaatagatgtgatgattgaagcccagcaattaacagggtttcatttttccacaaccccttcatctttcccaagcagaatgataagaaaaattatttagtatttttaatgatggtgggaggaggtgctgaaggagccaatgtaggtctgaaaacaccataaagattttgtatgtgtttcataatctgaggcctaatcaaatgttacaaaactttattagtagggtatccagccatttcagttttagcattgaaatccccgtgttattggaatgccataggacaataggataccctactcaggttaattcttcatgtttttctttaaggattgacgactagggaactcaaatcaagccttgttttcagttttagccactttccttatctgcgccttctgttgttaacaccccttgaatcttacactgcacttgttcttttaccctggttctgtggaggcaggttagcatagtggtcaacatcacctgtggaatcagattaccgggtttaacatttgcttgcaccactgactagctgtataaccaactgtgaatacatactctaacttccttatgttttatttttctatctgtaagatctggaccataaaagtaatgcctatctcaaaaggctgtggaggatagaaggatgaaacagtattacatgttaatgcttatacatacatagtctatgctcaataaatgttagctgttatcattaataattttttcattgattctgggtttttaattttaaactgccaattcatttgaaaagcagtggagtgtatacaaatgaataaataaagtcattgctaaatcttgtcctttcttcctcatggagctatgagcagcaaagagtcatggaaacttttctaggtgggattttggtttgtcagggttggcaagtgtcctggtttagtgcctttcaagattataaacagcctaggagtgtctcatccacctccagttactccacgggagtggcagtcccaaggcggggatggaatcttgtgagctgagtgctgactggttgctgtctgtggaatcacagtggccttcctccacatgagctggacctaggttctctgtaccccagtcagtttcttagacttcctatctctatctgtggttaaaacaaaaacatcaagcgctatctgtaattaaccaggattgagtgcaaaaggcacagcttgggctggggaatgaggacaatatacacatggtagctgagaatatggtctgaaatcagcgatctgtatacaaatactgatcctgccagttactggcgtggctgggtgatgatggaaaaattgttgaacctgtcttctcatctgtaaaataggtttaatgaccctttaatatggttgtgagcattaaatgaaatgatatataatgacatatagtgcccaaaagataccacttgataaatagattttatgataatatatatggtattgtctaccagctgatgagtatgagataagttgttaacattttcctttctaaactacttggctatatgaaacctgacaagtccaacttgttttattttgtattgtgtagtatctgtcagtgttgcttggccatcgctagttaaaaaaaaaatctgtagcttttagggtatctgggtgattatttcatgccaaagtactacaagattttgtttgtctgatctgagatttcattcttattcagttcaagaatgtggtaggaagtaaatgtttgttttagttctgtattagatatgcttacgtataaaaacaatgttacagaagagtgttatagaaaaggtgtcatttggctaaataactatataaaagtgtatggaaggataaataacattactggtgatttttagggaatacatttggaactgaatttgcaggagggagtgttggataaggaccttttactttttatttcttatactttcatataatttgaattattcttacaacaagtatgtaacacttttatgattaaaacttttttaaattgataaaaaatgtaatttgtctccaagtccttatgcctggcctgtaatatttgctttaaagtcttgatctgatgcaaatcttctattttcttttgtactcactttcttgggtagcaccttcttctattttatattgcaatcaaggaataggccaaaggctgttcattggttcagtataactcaacttgctcaagtgtgggaagatgagaacagtgttgcctacttcgtcgtcttataactgattggaaatttttaaagaagtatggtgtcacttaatgacagggatacattctgagaaatgcatcttctaggcgatttcgtctttgtgcaaacatcatagagtatatttacacaaacgtagatggtataacctaccatacacctaggctatatggtatagcctattgctcctagtctacaaacctatatagcatcctactgtactgaatactgtaggccattgtaacacaataataactattgtgtatctaaatatatctaaacacagaaaaggtataagaaaggtagagtataaaaaattaaaaatggtccacctctataggcacttacatgaatggggcatataggactggaagttgctctgagtgagtcagtgagtcagcggtgagtaaatgtgaaggcctaggacattactaaacactactgtaggctttataaacagtctacactaaatttataaacaatatttttgtttcttcaacaataaagtaagaaacagcttactgtagcttttttactttatacgctttttaattttttaaaacttgttgactcttttataagccagattaaaacacaaatacattgtacagctgtacaaaaatgttttctttctttatattcttattctataagctgcttttgtaccaaacttttttatttttatttttttgctttttaagctttttgttaaaaattaagacatggtgggaagggaatgaaggatttaaactacatgttggatacattgtacactactcaggtgatgggtgcactaaaatctcagatttcatcactataacaatttatccatgtaaccaaaaaccacgtatatcccaaaagctattgaaataaaaaatgtgtgtgtgtgtataaaactaagacatgaacacacattagcctaggcctacatagggtcaggatcattcatattactgccttccacctgcacatcttgtcccactggaaggtcttcaggagcagtaacaggcatggagctgttatctcctgtgatgacaatgccttcttctggaatacctcctgaaggacctgcctgaggcagccagggttttagttaactttgtttttgtttttttaataagtagaaggagtacactctaaaataacaactaaagtataatacagcaaataagcaaaccagtgatagagtcatttatttcattgtcaaatatgatgtactatccataattggatgtgctatactttataccactggcagggcaggtttgtttacaccagtatcaccataaacacatgagtaataagttacaccacaatgacattatgacagctaatgtcattaggcgatagaaaattttcaactccattgtaatcttatggtaccaccttcatatatgtggtctgtcattgaccaaaatgtcattatgcagctcatgactgtattttcaaatccatttggggaagctaaaagagtatacagtaatagacttcttgatagcgtttcagggaatctgcattctagtcctgtcgtgatcactaatcagctctgatatttagcaagtagggcctctctgaatttcaggttccttaccagccaatagacgtaatggtcttagcatcatctcttccccttttaacagtctgggatttctcctattccttacctttacatttgtccatgtaaaattaagaacacaaatcccacatcattagtcatattctttagggaaagaatataatagagacatcattgggatatggtggtgagagaagagaaatgacccctaacgctcacacagaggaaaagtcatatcagtggatgaatgaatgaatgtctgggactctgtaaaatggcacttactaacaaggtagaaatttattttgttacagagttgggctgcatttgctgttttaaaaaaattctaaacatacacttctttcttggtaagccactttcttattttcattacagattcatcactgtcctgcacattagcatggccataatttgtaaaatgttctcaatctgaaattcatcatagaaatgctgaattgtccttttagtttgcactttatatataaacactggatatttttattttcttctctcatttattcttaaaaatacgttctttttcctatacactccctgagggcacctgtcttgtggtccgtgacagttggacttcattttagagctgactttttccctattctgtacatttctttgtttgcactcaagcattaaagaagcaatctaaaattagatttgctttttgtccataggaatttgttcctagaaccctagctgtatgttgcataattggacagtggtttttgtttatttgtttgttggctacttgactttctgggagggtaaagaattttgatgaaataaaacaaatcctatcttctatgttatacctggattttgggtttggaaagttacctacatttgtagggataaagaacgactcatagagaaagcatagtcatcgtcaactcatagacatatcctgcaactaggagccatcagatcacctctccttacagactgaatctatctatctcctgctctaaatacaatttttgttttctaaacttctttcatggggatattttggtaaaaattattcaagtggcaagacaagccaaacaggctgtaatgaaataggtagtttgtgtttgcaacatactcgattttaattctaagctttcaaagcttatgaagatgagattttaagatgtagaaacaaagctaatgctgctaaatctactgcatcctgcacagcaaactctagattattctgaactgtttccaaaaaggagaagcttactgagtcttggaagatctattcatcagtttgtttttcttctttttcagtattgccttagctctttccttcccatgtctttttcccttttagactttcatagcttactggaaactagatgtttaagtagctatcctagcatggttagactattatttcaatatcagtatggacaaaactgctgcaattttgcagaccaccatcttggtcttctttttttttctttttttgttatttaatgtaaaaggtacacttagaagctttgtctgtgtggaaacactaactctgcaaagaggaaactctgttgaatttattggctcctgcattatttgggtctgcatatttttattctatttttctttgaagattggttttattcaatttctgtccctgtagaagggacaaaatatatgcaaataagaaaatgcatttttgcagatttttttatttttttcttctttaccacaaatcaagaatataagcttctctagttgatttacatttttgtgcaagtttttattaagcctcagagctgttgaaactagtttaaaaaaaaaaaaagaaaaagaaagctaacatcaccatggaatatagggaacagataactttttcacatttgatagtattgagctttaaaatcctaagtgagaattagaccattaccgaagttcctctgttggtagtggcttccttaaaaaactgcaggactctacatcaaaacatggactctactgaaactcacttatttctttgtacagactgtctctgaaaccttccagctcaaagatttgataattcttggattggaaaaatatcctttcctgtcttgctgtgggcttttttggcatttatactgattggctaagaaaagtggcttacttgtggtatttggctttaggtatttgggccaaggaccaagtttcaaaccttgtacatatttgtacacttagtttaaaatatgttttgaacaaagactttaaactgaaatcaagaaaaaaattaagtctcccaccagctaagcaagctcagcctgtttccctaatttactgaaagagttagccttcttctatgacataggcattttactagctcgtttaagtcctgagttttgggaaatttttctccagtttgttttattttgctttgcctggagacttcaaagataaccaccgaagcctatcaaactgtattcgattttttaatcataaaatcttaactattgctcttagcaccttttatttaatacattctatgtttaagaatgatacgacttttatgtactggttctgcttggatagtgctatggtttgaatatttgtacccctccagaatgcatatgttgaaatcctaactcccaaggtggtggtattaggaggtggggactttcagaggtgattttctcatgaggatggaacccttataaaagaggccccagagtaaccccttgttcttctttcatatgaggttacggtgaaaagatgcctgcctgtgacctgggaattgggccatcagcagacactgaatctgccttgatcatggactttccaatctccagaattgtgagagataaatgcatgtcttttatgagctacccagtctacgctattttgttaatagcatctcaaacagcccaaggcaggtaggcagggaatataatgggaagatgaattttatagagggaacaagaggagaaatgggcgtatttgtgaaggagagagggaaaaagtaggagggaatatatagcagatgtgtttgtgagatcataactcttccttgtcagttacgatgtcctgaccttgggcttgactttagcaccgggagcaggtcagcatccctagacttcagtcaacagggagatgagacaaaattgcaacttggctttctagggtacacgtgccgactcaatataccaatgaatctagcatatgaaaggatcaggatagcaacttttgatactttgacctatgttgatctctgagaaggaatgatttttggggtaattcaaaacttttaggcttgtatttcaatattttttaaaaaatcatttgacaaatagtgaactctgaactgactttcgagagatgtaagactatctgaagttgtgatttcccaaggttcgccatctgttagtatctgggagacttaccatatgttgtgctcaaattctgacttttacaggttaacttgttttcactttattcttcacccatacattttgggtacagccggtagcattgaaacctttcttgactcaataaacttagagagaagaatggtgaggaaagaacaaacaggctaggaggtgttgactcctaaaggatattaattcttaattcttccataatgcaattcaaaaagtctaatgctttcttcatgtaaaatacatgtaaaggcttgggtatcctgtttggtacagtggtgtgagtcctgttctaacccctcttgcaactgatcctcctgagaattcggaagggaaataataatcccgtgggagtctgtttgctccacgttgtgcccctcggtggtggtggatggctcccctgttttgcatctctccatctcgaccccaccacgatgttaatggctgtcggcacgctccactgtttatcttggaatttgatcccatcatcttggcaaccaaactgggacctttactgctcagattgtttgtcatttgttgttaattatctgttactataaattttgcactttgagaaaaaagggaatgttttgaaatatttcctccaacatgtaagtggagcttcattttctgtggacaaaagagaacaaaaaaaaatgagcccttttgggagctggttttagggaaatcaagtgccctggtttttcagatgggctcagtgagatcccactagtgcagccaggatttgcactgaaagaacctttgcaattcagcagtggtctaagacagaccattagtgacaggtaccccccattggagggaaaaaataatttaactttaaataaggggttttgctttttatcccaatctctttatgccataattgcgttttttgtatgctagggcctgttcccttcagccactttttaaagattattaatacaaagcagtccagagtgagaagtagcttctgcctgcctgtctttatgaggggtttattttgtcaagtgtagaattaaaatgagctgtctagtcattagtggattttagttctggtctcacactctgcaggaagggtcgtgccatgttataaacagatagcactgttttgcagggtgctgtaccacaggctgcaggaaccatggttgagcttaacatcttcataaaacggtaaacaaaagaacatgaaagagagagagagggaaagaatgaaggtttgtattttagagggagcatttgagaatagagtgactgttgctaagcagaaatctgggcaccattaacatatttaaaaatgaagtcatttgagaagttccaaaaagaaaaaaaaagtatacccagaactactactagtgtcttatctttatagcagggatcataatcatatatgcttcaaaaagtaatggtgagggttatagaagataatgcttagtgcccagtaaagcacttagtgcagtatctaaatgttccatgtatggtggctattattgttaataatattgtgtgtctttattgcctctaaaacattaacatgagcttctgcagttttaatagtgatatgtagtccatcatcactataagttttttcgtgcctttaagtttggtgtgtctgttttattcttgtgaagaagtttttagggttttgctctctcccaagggagacacagggagggaaggattgagtctctgttaacctggtagccaggggcagagacttaataaacacttagctccttgcctgctgcctgagacagtgtaactctcagtgatgtgtcttttactggagttgtggaatttgcttgggtgaaaatgttctcaagtttataggggttcatgataatagtgttggccctgaaataaagcaccatttctaaatattccactttcactatccttgtatgtcttctttctcagtgtttttcaaagagaacaggataagtgcttgggcactactttagaacacagattataatcagactttgggattaagacgtgtagccaatgtattaaattagtcacttagtaactgtttgagtatgagaataagaaactggagggaggagattgggagctggaaaaaaagcaccccctgattgctctcggggaggctgggaaaaaggatttaacactttggattttttaggagacattaaaactctgatgggatcaaattacttgactgcacatctgaaacatgaaactcttgccctaaaccgtgcaattgagttaagctcaaaattctaggcctgcccctaagactggcctctgggtaagcctcattgttgatcgcaaaatgatttcctttgagaggaacaagactacagtgaggtttttatggccaatttggtctgtgcattggtgccagccagacttttggcaagagttagtgccaactttggtgatctgtccaccgaatttttcccaaggtcttcaaaaccgtctggatttactgctgacattgaaggaaagatgcattataagtccagctttctaggcacacctcctgtattttttgttttttcaagtagagagatactgagaggtgccagagaacaacaggctgatccgtggccgtaaactttgagtcacaaaagaatgttgacagtcttcttcactaaacactattttctctctctagctttgtcccctttttagggagcccctgtccttctctctggattaggtgtccccttatacatactcccagaacctgtgagtgatactgtcctttggctgcacttatcttaaatatattcttgaattgttggtgaaatgtgtgtcttccactaggatataagctctatgagggcagtgaccttatctttttcgttttatttattttttgctgtctgtattcacaacacctatcacaatgctaggcatgttctggagactctgtcaacacctgttgaatgaatgaatgaatgaaagctgagtttgcaaggattcgaggaattaacatgtgcttccccaggaagtgagtgctgccttgtaatcactcattcattttgagagcatgtatgtagacttgagggtgtacttggctttaaaaagggtaacttatgtaagtctcccgtgtttttttcaggatggagctggatgaagctcagagtgagtatttctgatactcgtacactaatgctatcatctctgccttcagttgacttttgctttgacagtagtaaactctcatttctaacataggaaaaaatatcaaagcttccactttcaatgtgaccctagagatttgggttttctatattgttctttaattttaaaatggaggcatcggaaagtatattgttttaactccttataaagtgctcacttattgatcatatttggagtcaacaattatcggtcagaagcattaaattaattaagatatatttcagcccacttacctggaacgtgacaactgctcctaatatgtggagtttacttgaaatgaagaccatgaaaacgggtcatctgtcatcatgggaatcatgcgttttgaataaggcgaaccagtttttattctgtactctgatgtttaacgactctacattttttttttaatagtaaactcttaaaatttttacagaacaacttttttgacaaaaatctgtgatttgggttaaatacagataacaccgtcataacagtattggtatggcagtggttgaaaaccattcttaaaaacattgacttaaaggtaaaacaaaggaaattcaaagtaagtatgcaatggagttctaattgtgggtgactaaactgtcaacaccttgaaaagcaaatgatcaggaaaagatcctgctgtaaactgccaggcttaagaaaattttacatggcacagaaattaaaagaggggagatactaagaaagagaagtctgtatcacaagcacttttggggcaggaagtttttaatttagatgactgacttcaggttttctctctaactttccctgtggctgtgtctactaaggaaggtgttgtataattagactttctggagatgacctttggctgaagacctaattgagtctctggacttgagtgcagggttggagctggaggagctttttgccctgtaggtaaaggggctctgatggacctacgtctttgataagtacctgtagggctggcagtgacattgtttaggtaaattatggtttagtaattgaggagtcagtgctccttagtatatgaaaatctttctttaaaatagggaagacaccaaaatccacatgcgcaatttaaatgagcctgtattctgcattataaatatgcaccggatgccaagtagaaaaccggaacactctctcaggatgctgttagggccaagcggaatctcattagggacagcttcaaagatcagttcctcgcgtccataaaaacaagtgtaaattatctggtgcgcgcctgctgttagcagttgcggtgttgcattatgcatgattcaagactgcacaggggagacacaggctgcacggagttccacaatatatgtggggatttctctacccatttttttctttttggtgctgagtcctacattttggaaatttattggtgtgtttcagttaatggaggatgtcatatataactcactcttacatttttgatgaattggagtcagttcagagaggaatgataaggttctgaattgtttacatgaacagccacgctactcagatttatgtatcttgtttgctcacacatggagtcagattggggggcatgaatgcattccatgcacatagaattgagtgcatttgtttcaaggactctctccctcattttggtctcttggttagattttttaaaataagtgtgaatgctcagtaaattaagaacatgtagtcgagtttaacatataaggcttcaataaatagttttgtaataaatgcctaagggtctgaaaatatatttctgagcttcattgcctgaggagacagggaagcaatatagtgtttaagaacgtggtttccagaagcatactgccaaagtttgaatcttggtctccctcttactctctgtgcaactttgagtgagttacttgacttctctgtgttcttatccataaatgtgacctctctgtgttctcatccataaatgagggaagcaaatagtacttttctcaaagggccattgcaaaggttaaatcaactgctttaagtatagtacctaccaaattttctggggacgtagtaagttctatagaagtgtttcatttggtgttatcgtcatgatcagaggtagaagaccttccagtgcagctgggcatgactaggtatagaacacccagagcctgaatttataagcctatgtttgcttgaatggatagatatacatgaaagctgagggcagacaaagtcagggaatgattaccttggggtcaattagaagaagccactaaaaatacaaaatgcttagtagatgtgtatcttgccagcccaggtgactcacagagataaacatgagatcttgagaaaaggttaagacatagtagcaagagggagttagctttcctctagccagagtagaagaaagagtttgtcaatttccttttcccagttgtttctcaaggcctgttcccagaacaaagaagcatgtgggagaaagatcaaaagatcagccttacacagtgtctcatgacttaaatccatcaatttcccagcacaagttacctccattttgacatgtacattcgctcctataaggggatacccacacatagcaatattgccctttctagactggaagccctataagggcaggattgatgctggctgatcttgaatcctctgccttgtccatgattcagtaacaaattcatctttgacaaatcaataaacagtcttcaatatgtatttctcctgtcattttgtcctcacagtaaattctctctgaactcagaatctccccaccctctttagagttgcctctgctactaacatgcttacctaagcactagttaatggcctatcatgcttgcttcagtgtccctccttacagtttgctgaaattgcccctactatctcctgtcacttacttatcaataccttaagaatggtttgttgggagctctcattttttggcactaagtgattgaggctaccttgggtattctgtagaggtgagctgcgccagcattactgcctgacttccacctcctgtcagatcagctgcgacattagattctgataggagcccaaaccctattgtaaactgtgcatacgagggatctacgttgcttactccttatgagaatctaatgcctgatgatctgaggtggaccagtttcatcttgaaacgtaccccctcatacccccatctgtggaaaaactgtctttcaccacacctgtccctggtgccaaaagggctggggactgctgatctataggacagggagggaggaaatgagcaaggagagtgggatgtctgggggaagctgggtgtcattgaaaatgttacagtaaatcaataagtatttattagaagtagcatgggatgcagggatcctggttgttttgcttctcgttttatccccaatgcatagtacagtgcctgatgcataaataattattgatgaacaaattaatgaaggaatgttttatttggtttagcagtcaggataatatagaaccataaacccccaatccttgtctgctagcgtgtcttgcctgtttacagagacaatcaaatgcatctgaaataaataatatttaataaaataatcatgtgtgcattattggtaatagaatatcaaggttcttaaagtacttttgtgctgtactcactgtgaaggaaacagaagtagagaattttacgtatggcctactggcagcccagagaggttgagtgatgtgctcaaggtcaagcagaactgctggtttctagtacagaatgtgactctttatgacccttaataagctgtaggtgcctaaggaacttacagtttggggcacaataaatgctaactgagtaggagaagcaaggaagaattcaagaacatgtctaaaataagattttttgggcgtctgccttagttctactgaaatgctttacaatgttatttcctagtttttccctgtaggcatgcatcaggtttgattcttctcccaaacgtgaaagaaggtaggcttcccgtaggaggcagcctgtgatggaaagcagtttaaaataaacaggagcagctattttctgccctggaagatcacacattactttcatttcagaatatgtcctcctgtttctaccactcttttgtcctttggttcttctcaagtctggcagcatcttctggccttatgggctccagaaaccactgccatttcctattcagagcctgtgcacacttggacagcaattgcatttttgcttggttgtgggagttgagaagtatgtggccatatgctgtggcttggataatggcttacatttcaaacaagttaggtggtttctggcccactgcttgctgtgtgtggaaatgagcaaacctatatgcttctaggtcttttccatttggagacatgaagatgaaaggtgggatgcttcaacccagtacattttacaaagctcagtttgagtgtggttttcagatctgactatggtcgagtatcaaagatcaagggtaacttcaaaggcaccaccatttttgagaagttcacagaggttactgtttgtaaatgatgtctctgaccaaaaggaagtggtgttactgcacagaaaattgcttctgttctctatcattggtgttggcatcacttggtaggctactgaagtgcatcttcttctttagggttgagaaaccctgtggtcacaggttgctccacaaggagcacttttagccacaggcaattttccttttggaaaatgtggggtggcaggtgtaaggtatcacattaaacttctttatgttggactgcagctgggcccaagttggctttgataataaccctctttgcctaggttgctacgatctagctatcagtaaggctgcagccagactcctaggatgttggcacagtggctggtggctgggcattggtttatttgccagcattgagccagtattacctgttagacctttaaaaactgagcatctcaggacatactagaattcttccagctctgttgcttttctgggaagttcagagatggcatttggcagtacattcacatttagttgagactgttgaacttcacattaagttgaactattgaacttcataatgaggaaattatctaataaaagctctagtttttggtgatgattaaaaacagtggctctggaatgctcaagaccccaacttagtaggcagagaagttcataaaatacacattgtgcagagtccaactagtgaatatactggctgtagcagtatttatttcactgtagaaattatatatctatgcagtccatattgaaataagtgtgtgtgtgtgtatatgcacacccacatgaaggtttaaaattaaacatagatgaaaatgcttgcagaacactccttttggctatttaaaaaacaaataaaacattggacatgtttgcatgtgggttgaacacctcagctaacgattactcacacagttgaccttgttttctattcagggcaccaagaagccacgttgttaagcatattgggtcaacccagggttcacgttaacatcatttttctttctgtggagatgtaaaggtcttcagcctgattgttttctttttcttccacaccaggtggggggtagcatgatttttgcatgactatgggcctgctctataaataagcagattcagtcctttgttttaaatgtaatcagcaagattgcatttgcatcgcctgtaagtgaatcacataagtgaaattacattgcctgcatctcatttggtatcataaaatgttatgggatgcaggctgtttttctccaagtaaagtgtcttgagttagtattagggtgcttgctttcattttcctttgtgaccaaatttgtggcattctacggagctagggcttgtattttcacttatgttagttgctagagaaatacttgttcatgtcctctagaataagctaagatattggttcagtagggggtaaatgggagttttaagactatctcatgccgtgtagcaagtgattgctaatcactttctgtcgtttgtgacaacttctgcttactaagagtaaatgccagtcagtgttggttggaaatataaagcaatctgaagcttttcaggcagttggccacagaaaatggttaacatattttttttttttaaaaaaaaaacttgttagtcatcttttaagcaactactatgaaatacatatcttaattgaccctttaagaggtatccttaagacagaggactcagaagtcattgtaagattctcccacttattttcttgaaaacaaataaacacaataaaaataattactgacttcaaaagtcagtaattttggtgacaaatgagaatgctgtatttcatacaacacctcccctctcccctgaggttttcttaattcgtgaatgctggtggaagtcaaagcaaaggtatgagttcttagataacctataacacagtgtggttacccacaaaacatctgtttattagctacattattgataaaactccacaaggcaacaggcagctatagtgcccattatgccctttggcataatgtgaagactattttcaaaatagggcataatgtgaagactattttcaaaaaggaaatacatgtgaagactattttcaaaaagaaaaggcatgccagtcataatgatataccaacacagtgtaggtgcttgatacaaaatgccctttggttatttggagaggtattaaatttagtatgcctcacatggaataaaaataatttatttttgaaattatatttaaaaactaaaattaaaaaaataactttcaaacatagcttataattttttctataagactttgaaggagatacgcaattttgtgttcccatattatttaaaagaatgtatctaggaaaaacatttcattcggaaggagaagattgagtatagtttctttttaattagtaagcttttaattgacacatcatgcaagttaaaatgtatacaaattaagcatgttcatgcaataaatttccacaaagcaaaatactcatgtgatcacaattaactatggttttaaagatcatttttttgttttagtttgcaaaataatattatgaagtcataagaatttaaatatgattgcaatttacaatacatttttattaataaaagttgtaaagacctttgttactattgctctgtggtttacaaagaagataattgtgaacactgggatcccgttgggttcctatagattcccctgcagctgggtgttttagggcatagaattacatatgtgactattgtgacttttatttcaactggactctaaggaatacttttcattagtagtcatttaagatttcctggaagctcttctctgtgatttgaaaaattctctggataatatttccaaattgatgaccttctggagttaaaacaactttttctttggtctagctttaaagatatctttattttctattccattcatcaccattttttcattgaaaaaattaaccatgcttatcccacttcaaatgagcagctgcactttgaaactagatccttcttttggctgtaattgtccaaatgaggaggaccaggtttgtggactatttgaaaagaattggttgtgactcaaagcatttttctgctttcaatttttctcttcaaattttagtgtattcccaagccagaaaaaaaaaaagaaagaaagaaggaaagagggagggagaaaaggaagaaggaagaaaagaaggaagggctgggcaaggtggctcctgcctgtaatcccagcactttgggaggccaacgcagggttattacttgaggccagcagtttgagactaccctgggcaacatagcaagaccctgtctctatcaaaaattaaaaaaaaaaaaaaagctgagtgtggtggcacatacttgtatttctagctacttgagaggctgaggtgggaggattgcttgagtctggcaggccagagctgcagtgagctgtgatcagtccactgcactgcagcctggtggcagagcaagatcttgtctcaaaaaataaaaaataaaaaaaaaaagaaggaagcaaaagaaagagaaagaaaaaggggaaaaaagtttacaaagtacatataagtaaggcagttcttacctgggaatagctgaactatagcttttgaggaaagagaaagatataggatgatcccagaatttcagcatgagaacgactattgggtttgaagtgtgactataaaccactcagccagacttttctttctttttaataaatttaccagaataggtaaaataataataataaaatacatacaaaatatatacgtgtgtgtgtgtatatgtgtgtgtgcatgttctattggttgaccaattcctgcaataccaatatcactgaaaacaattgtgaaaccactttttgaggattgtccttggagccaggtcatgggcacataaagaaagagttcttcatattttccagccacagacattatctttactcgtatttatttatatcttcctagcaaggcccttagattccagttcaacacgcccaaggaataaaattcattagtgagttctcacatttgactttctccctctgaccatgaggctcttcttaccaggctaatgtttctttgattggatccctcatggtcattgccatgaagagttctcacatacatattactatagcaacttttcacttatcttcaaatatgttggactgactgtcagaatgttgacccagcagttgatccagatcattctatataaatgggaatatgggagacggaaataattgcacattccattgttaacagcaccaaggtagctggttagagatgtttattgattggttatttagccagtagcctttccttaaaagaaaacaaaaggaaactaacaatcataatggatggacatgtgctaaatctcataactagaaagaatatttgtaaataaacatgaattatagctctgtttattatacaatagtgagagctaataatttgccttgacataatagctgctttcgagctatcatgagtcatgaataaatgaaaatacctataaatttccaaagtatatttgaattcttatattttgcattataggaaatgatacattttctccaacaaagcgttttaattgatatctccagttaagatagaaatattctaaaacttactttaaccttataaatgaaatagcaaatacagctgtttcagagttttgatatatatattatatatatataatttgcttatttggcacagtcattcttttattcattcgctcattgaattcctgctatgtgccaggcacacaaacaaactgaatctagcactgtttaacaaaattgaaatgataatctcataaatgcattatgggggaaaatgtttcaatgtaatgcccaatgtatcagtcttgatgcaaaatttgtgatagcctagagtgtaaaactaacccccttatgattttgatttttttttattctgatgatcttttcctcatcttattgccctaacttggttcaacactgcttttggggaatcccttctctttcttcttacattttctggcctatagggtcatatggcttaagttagaacaaggagaccagtcaaaaagagccaaggcagacaaggcaaaatctacagaaatgataataatagtaatgataataaataatatggctaccatttattgaatgcttattgtgtaccaagccaagtgttaattgttgtaatatattatatcataaccctaggaagtgagtggtgttattcccattttgcagataagaaaaccaaggctaaaagaggctgccaagggtgacctgggttttacagcttgtcaatgacacacaactttgcctgaatctataggccatgctaatctgtcaaggaagcagtgacagacttgtggattaaaggtttggatttgactattttattttcttttccaaacaatgttcatgataaaaccatgtggaattgaagtcatgaagaagcatgaggtaaatgcaatccagacccacaaacatatttttgggatagttccactgattgagattctatagagaagcatgacctaggatgacatcttcactcagaaacaaatatggaggaattcattgtttggaggttggggaatggcatggagaagagcatattgggttaagagtcaaatggtgtaggcctccattccttagtctgtaaaatgagactaatactggttagagaagatggtctccaaggatccttacatttcaagcattctaagcttttaggctgaagttacttaaaattctttgtattattagttcccggactttccactgaaaggctacagggattgatgataatgcaggagagagtggcaaatggaaacctcactctcgtaagtcatggaattacagaaggaacactcaaggctattaactttcagctgaacatctaaaactgagtggaaaaatttaagaaggaaaagattttctctaccttgaggaatctttggcctgtggaagaaagagatttcctaaaagaacatgtcagtatgggagtattaaaaaaatatgtggagactgggctggaatgaagaatttgagattccaggggaatgtgcagaggatttgtttttttcattggttcatagacatactcattgtattagtccattttcatactgctatgaagaaatacctgagactgcgtaatttatcaagaaaaagaggtttaatggactcacagttccacacagctgggaaggcctcacaatcatgacagaaggtgaagaaggagcaaagtcatgtcttacatggtggcaggaaagagagcatgtgcagggggtctgccctttataaaaccatcagatcttgtgagacttattcactatcatgagaagggcacgggaaaaacctgcccccatgattcagttacctcccactgggtccatcccatgacacatggggattatgggagctacgattaaagatgagatttgggtggggagacagccaaaccatgtcactcatctaagaaccatgtgaacagtagcctgaagtactctaggtctgaaaattcctagtttcagccttgccactgactcacactttgatattaatatctgggtctcattttcttatctgtaagatataaagtaagtttctaaaactgctttctggtgccacaaatctgtgatttggggtatcttgatatcactatagcaagagagtcacagtgttgaggtggtgtttggggtgcctggactgtcaagtggactgagtcctggctgagtgaccagttcagaggacatggactaaaatagtttccatgaggaggaagaaaaaaagtccaacattaggaaaataatttgtagttgagtgagaatagtttgtcctgtggggtgaattaagtagatgatggtaattctgctttcatataccatggcatctgggaaatggtggaggagacagaatagtctaaaccagcacagctgtggaatctgggagactatctgcatttggggctggtgtgaattgtgggtttggagaggacaagaaatcacaatgagcagtgtacttagagaactgatgtcagagaagccagcatgtgacgtcaggcctaaggacagacacacgtggggatcttctaacccaaagaaaatgtggtgcaggctgggcatggtgactcatgcctgtaatcccagcactttgggaggccaaggtaggcagatcatttgaggtcaggagttcaagaccagcccggccaacacagtgaaaccccatctctactaaaaatgcaaaaattagctgggcgtcgtggcaggcccctgtaatcccagctacttgggaggctgaggcacgagaatctcctgaacctgagaggcagaggttgcagctgagatggtgccactgcactccaccctgggtaacagagtgagactctatctcagaatgaaacaaaacaacctctaaaatgcagagcaagtggcaaacatctaatggatattttggagtttcagagcaaaaattttaaaacaggagactacccttcaaggaacaggacaaggacatactgcagtccctggagttgtggtaggatagcaaagcttaacaacaggaaagaggcagaagcccatttactagaattgaagtgaaacacaagcagtggcagacaagcagaatgacttgtctctgagcagtgtgaagcctgcattaggatttttctgagtgccacctacaatcagggtgggtttaggagcctggccttggactaaactgagtgatgggcataaagttgccacggctctgtgtaggggattgacatgagggcggagaaccagtctctgcagttgctgagaaattcacaaagtacccaaggactctaaattgggcaggctgcctcaagacaaaccaagaagtctaggaagagtgtactttttgttctcagttcttggtttgcttcatgaagttaacaaaaagaagcaatagtcctaggttcttaatctctaggtccttgaccttatgcttacgattatttacactcataaattgtcagtgcaatatgactccctgacagcttcctcctccttgcagtataggcttttcttcttgttgacaataattctgcaatccttacactctctgtgccagagatggtgcttggcattgtaggtaccatgtttaacactcaaagaaccctttgaagtggctgcttatccctcccgcatgtggcttgaatcagaattcaggcccagctcttatcctgacaaagcccattgttttccattaagccatcctgactttcaacttgaagcagtttctttcctgtttctcaatcttgttttaacaggaacggtgaagattttcaaaattccagctactgtgcctagaagtgcaaaaatgctcttttgtatttgcttaacctttaactgcttaaaacaaaaattcgtgtttgttgtttgtttgtttgaaccataagaaatgcaaatgcaacttagaagttgttctgtaagaccacacaaccatttttaaattcaaagacttagctttgaatcttggatttttagatgatggtcatacatgtgcatgagggtgttaaaagagccttggtaattgtgatttctgatttcagtgttacagtctatgactattgcaagttctacattgttttttctacctaatgcttgcccttctgccttcttttttaaaaaagaaaatataatgaacgtggtctgttatttaaaaagtgtgttttatggtgcagttcatggcaaatggtgttgagtggtgatggaacagtgatttttggaaataaactgagtagggcaagaggagaaaagaaggaattcacatctgcacccttggtttgcattggaacacaggcagcagaggtgggtgggaggtgtttgtgctcttccctgtgctcaccgtgggtggccgggcctgtcgagaacattattttatttatcctagaggagttgctgtaattgttgaccagaactactggcatttggggttcacacatcactggactcagggtctgttggcatttgaagagtaggactcatggtgattcttacctatcgtgaaaagtgatgtacctagttcccaaaatggcttggtttatgaccacaggcaggccccatccttagggctgtgtgtctagaaatcttgtctgggcctgacagcttaaaagcctttggggggtatagcaaagggaaatggttaagaaaattgtgacaaaactaacctgtgaaatatcccacagccagtgaaaacgtttataaagagtctgcagtaacatggaaaatgctgacgttataatggtctaaacggagagagagagaaaaaacaaaacgaaacaaaacaaaacaaaaacagaaagaaagagaacccagaatataacattttgcatgcagaatgattccaattatatttttaaaatgcatagcagaaagatgaaatggaaagataccaaaatgttactagtagctatctctgggaggcagaattatgggttcatctttctttgctttttatatacatattcttaattttactaacgttaattatccctaactttagtaagcatatattacataactagggtaaaaaaagcattttcacagtaaaaataaaacttcttatattttggggaaactcccgtttgtggatcggggaaatttgcttgtcccttgccattctggcttcgcagatggctcctgtttgaccagattaacgcaggacattgtgttcaagaacacctacctatctgataggagtactgaggtgctatagaagatgacagttttaatagtaccggatgaataataattttaagagatggaattgacttatgaagtgtaaaatgacatgatttttttcccagttagggtgtaggatgctttattatctgtttgtgagagacctgtatttggaacacttcatcaaggagtgtgttcaggttttttcaacctagtgaaattagggcaatcctgagaaattttgcagaggcagaaaaacaacaaaacaattccagtaattatgggtcatttataccgtgctcagtgcattctcattacttcttcttcataacatccttatgaagtatttttacccctaacacagatgtgagaatactgaagtatgaggttgagtaacttgcccatattccagaggttgtccgtttgtgtatttgggatttaaatccatgctgtttgtctctagaacttactatgctcataaagtttgctggggagtctagaaaacttcatgcaggaatttatattaaaccatctgtttttcttttaaacgaaataagagatagaagcaaataatacttggatcagtaaaaacacctgacaaaagacagcacttttcagtttgtagtgtgttttctttttgacagtatcaaaatggaccaaactagaattcataaatttattagatattttaaaaggaatttatttgaaatcaggagaaaacttacaatttttcaacttagcattgagtttgtgtagacaaaagcattggacagggagggactataggtaagctgaggaattctattcctcttataacagaggcctcatgatttatagcatctctgactatggggaaattatgtaaccttgtaagtccagtatttctcatctgtaaaatgggattaataatacctaccttatagggttctctcaaggaatggatgaggtaatgttcataaagtgcttggcatggtgcctaagcgtgggaatagtgttcattgatgttagtgattatttttattactgggggttaggaagtatagagtgtggatccagttctgctgctaacattggccatgaacaagtcactcaacccttcttgttcttagactccaatgggaataattacaatgccctttttactgataagatgagaatgaattgaaattatgtatgagtcaactttttgaaaaagtatgaaagattctaccaatatacatgataaagatggaagggaatagcaggcaggtcagaggggcaaagtagttaactttctttgggtttaagtcctaactgggacttaaacacaagtccagtttgcatagaacaagttgagtgaattatactcaatcacttgtgagaaaacactgtaactcagaaacccagcattactgctaccaaattttcctgatgtttggcctctcatcatgaaggggcctgaactggacctggcgggagattttattgcattttttccccaggctgtgctttctggttagtaaagtgtcccggacagacctggctgaggttttactctttcactccggaatgagaggagaatggaaatagctcatttcttcagccgtgcaagccgtggaaacatcaaatgtgtgtgtgaacttgtccatacccttcaggccaagtgcttttaaaaattacctgcttcctaaattgccaccagtgctctgggaagttttgctgtggtaaactcccatcaaaattcctgactattctcacatcccctctgcaaggccataatgggagtactgacgggctttggctctggaagcaaacatttaagagtcagggcaaacaaagaaaaattatattctagtcctgctgcactcattgaaatgggttcaagatactcagtgtgtttcctagtatagatgacatgctacagcaggggtgggaaagacacaatgatttctttggaaccaggggctgatttgttgttggagattataaatcttttcactgactgtttctcaggctaccattcaccctagattcctacaggaatcacattgcctccacggaacagcgccagccccagtgctaatcaaatttaatctatcagcgaggactgctttcctacaatggacattggggggcattgcccattaaaatgttgagtcattagcactgtcttcaaagcaaatctgaaggcttgataggtgctactatcttattattattttaaaaaagcaattgatatgggagtgggaagaggggctgatttgaacttaacatgcccccttggccacccctccccaaaagatgatttaaaaacaagcagtgagccagagaattttcaaggctaactttctcacgtggaagagaaaaattattgcaatgccctttagctaagtacactcacttcagcctttatcgatgacggcagtcacgtgtgcacctcttcatgaggaagagagcttgaaacaatcacagggcagaacctccagagactagagctgggatgagctctaatagtagggcacagggagtacctgtgaggtttttgtttttgtttttaggagaaggctttttgaggaagtaatcttcctgcccaaaattgaaagttaaatcttttccatcttatccatcattgctcttaacagagacagttgatattcctgagttataggagacctgcaagtctctacagtaggcaactttgtagaactcatatgtatagatagtgggccttttacagtttagcattcacttgagcatatgaaggaataaaaaggagcaaacagatgggattatgcaaacatggtgcattaagagtttctagtaaacttttagcaaatgttgacacagaattgagaattatctgaagtttattctcctgtccaaagtatccaagaaagcaattgattggaaatagagcaggggaaattttgatgtgaaccataacaagactaataaaatgtagaaatgacatataaccaggtacagaaagaaagcagttacgtccaggataagagcaaggatgtaattggctttgtgtgttattttcatgtgtgtatagggatgcatatgcgtacacactgaatgggagctaactgttaaagtatgttgtataaagttcgatctgtataaaatgtggtttgtactttgaactcatatttttttgttgcttataaagtttagaataaaataaccacttattcctgaagggtatttgaactggtgagtagtcacaactgtagtcatgatgatttggtgtctagatttttatgtaaattggtacctggataatgcattcctatttggctttagtaatcttcatacaactgtgaagtagagaggcacaagctttaacaaatttagaaaaattcaggtcacctgacaaacgcagtgtccccctgggaattaacctctttgtaaatttggcactatgactcacctttgttgatcctttcatgactctctccctcttcaatttaaattgtttcttttatgtctaatgacattactccagttctttgcttggtgacctaacctttcaagtcccaggtaaaatgcaccttcttttgtgaagatctacccatttttaaatagaactaatttctttcatcaatatttctcatagaagaatctcaataatgatggctaacacttactgagcattcgatatgcactgggccctttacaagcaatagttacttaagctgggcatggtggctaacacctgtaatcccagtgctttgggagaccaaggtgggagaatcacttgaggccaagaattggagaccagcctgggcaacatagcaagtccctgtctgtacaaaaaatcagaaaataaaaacaagctgggtgtggtggcacatgcctgtagtcccagctacttgggagactgaggtgggagaatccctggaacccaggagttcaaggctgcagtgagctatgatcgcacctttacactccaggctgggagagagagagaccccgtcagttaagaaaaaaaaaaagatagttacttaatttttgtgttgatagtcaatcttatgaggcaagtactattattatccctagtttatagatgaggtaaatgaagctttgagaggtttagtaaacttgtccagagtgtcatacccaggtagtgggaaagccatggtccaaagccaggtcttgtggattctgtaagtgacctcactgtttgctgaagtgacctcttaatcactttattctttctccattctccctccccagtatgtacataggtatatataatttgtggtcacattgattacagtttggtatgtatgccctcccaaatgaaagtgtgaggttcaagatagtaaaaatggcatcttcgtaacctctgcaaaagaataatttttttaaaattgactcaaatacagatatgcaaacacctgtcagaaaatttacttaggttgttaatgaatgagggaaccaagaaagttgttgtaacagatttgtagaaccatgaatttatatggaataaaaaaatgctgaaattaatttgcaaatggatcaaaagtggaggggaagtcgattgaacctccactggacataatttatttgcatctgtagacaaaaattatttgcattgcttttcattatctataagttacaaagttatacaatacaaagaacataggctcatggtttagataggccagaatccagattctaacttccaagcttaatgtttgaccttaagtgaagtttggagaattcagaatatcacacacacatagccatacacaaacatcacacagagattttgagaagattaaaggtaataatttagaaaaagcccctggcacatagtaaatactgctaaatattaggcgtgattgttagtagtaataaagcttctatcagagctctaacatttagttattgcttagtaaatgtttgttgagtgactaaatcaggagtgaacaaacttttccctgttgaaagagttctggacatgccactcctgttgtagcacaacacagtagatggtagttctctttgttagtgtttgaagttgcttaacactggaattgcagttagacctagatttgattctcttctcagccatgtactagctgggcaatcttgggcaagtcaacccatcatgtctacaacttggatatacaaaccctgtgaaaatcatgaggaaactatgatatactctgccaaggtagtaagtatgcatttccagagagggaagaaagtagtctttcatgagttctttggttgagtgggaactatgtgagttttgtggctaaaaagtgaaccagccatttctgcaagggataaagaggtagggtaaaatagttctttattgttacaaaaccacctccagagaaacaaatattaagtctaataattattgtattgaattaattttgaaaggtggttaactgttgacatcatgttgtcttacaaataagcatttgtcttcaaactcacataaatgatgtcccctatgtagtaaaaaatggtctttttgtcttaggcattgatggttcttagaaagtaagtttatcaattcaactcaaagttgggaaaaaacaatacagaccattaaaagccaactaaaatggccacacactttaaagaaggcccattagccatgcaaatatgaagtcacctgcacttccaataagcacaattaactaaacaatgaagcccattaacaactacttgtgggacattaagctttggggaactgggctttgatgagttggaaaggaagaaaagacagaatttgttctcaatttgggctgaattttaataaaaaagaaatcttgtagagtcagttagggtcagttaatgctctttgtaaaccccactcccaactctctcccctacaacattaaaaaaacaagctcgtgtgtttgatggctcttaatgttctttctactggagtgagctaagtgaagacatgtttgaggccgggcagtgtttggaaataatccacattttgttcatgatgttgtaatgattgatttaaaactatgattttaaaataatagttttaggcatgtctctattgttttttccgaactttgggttgaattgataaacttactttttaagaatcagttgtggccgggcacggtgactcatgtctgtaatcccagcactttgggaggccaaggcaggcagatcaccagaggtcaggagttcgagaccagcctggccaacatggcgtggtggcagacacctgcagtcccagctactcaggaggctgaggcaagagaatagcttgaacctgggaggtggttgcagtgagccgagaccgtgccactgcactctacctgggcgacaagagcgagactctgtctaaaaaaaatatatatatatatatcagtcatgcctaaaactatgtgtcccattttagaacagaatctgctcttagatctctgtgtgctgttttgtgtaagaggagattgtagaagctggagtaaagcagacattgagcagtcatactggagcagagccaccgcctatccctgtacctttgccctattgcttaatctgagtctcagtgtctttgtgtgccaaatgggaaaaagagcctatcgctgtaagggtcaaatgaaagtgatccatgtaaagtgccctgtacagtgcctggcttctcaatgaaaactgctgccatttctcatcatcatcatcatcactattactctattcagccaaaaaatgatgttcgtgtcctgatcagtggtatagatggctgtaagatagagctacgggagactcggtgtaggatgttgtagttcatttttgactacttctctacttctcccttacagtagacatttatgtgattatcatgatggtttctgtttacgataaccatcaatttcctgttgccttcacattctctcctttgtattttcttctcaaatggatttggttttgtcactatatacctagattcttagcaataaattacaaaccaacctttcctcaagaatccccccacctcccatcctgtagggagcaaccccacttttcctaaaattcagctttccctgtggccctctgttcctcttactgggtagagggagaaagatgttttccatgccctccaggttcaagccccatagtctgactccctgaggttcagaccctaatcccgctggcctttcaaatcttcttctgctcaccttcatagtgactctgcttctgccatgcttgtttactcacaagtccctgaacatgctaagtgctttcacaccactcttaatagttctctagatggccttcttcctgagtttccaagtcttgtgcttattttaattccaagtgaggtcccagcttccggccactctcatgcgtcttttttctgagctcctaatagtgccaatcctttgtctcgtgcatttgaaatcgacatactaccttgtgttctgtacccactgcaatgttacctgtccttcttcctagcccataggcagtgctggatattttttccttttactccatagcacctcaaacattcttaattataacactttgtgcattatttcataaatcacctatttacatatcacatggaccatctcagactggctggtagctgtctctccagcaactagcacagtctgtggcccataaaaggtgctcaataaatgcttatgaaatgactagatgacagagcagctaccaggcatgttcgtaagcatttgttgaatagtaaattggcagaatccttgagggaaccatctttattgcttctttgtcttctttatacataccagggtacctggtacacaggtaggtgcttaagacatggttattgacctactgcttgaccaactgacagaccaacatactgtgtggaataatgggcactcagtacagtattacatggctttttttctcaaatgcaaggccattacccagaattttaagctgattaacgtgattgccatgttagaagggagggaaacgtttaaccctggacaatacatctccagtgggatatttatgacccagcgatatgtcatctgagaggtttcagtggctgacacggtagttagcctgatgcacataaaaacacctcagatggcactaggagaaggaccatgaattcatattgcatgcagtgctcaaagaattaaattgttaccacttaacattcattgaatgtcggcactgtacttttgtaagaggaaaaaatagaggagacacactccgtgcagtgggctttgttagctataattagttggtaatagaacagtgttgatacagcagttcagcagttaaagaaaagcagtgcctgtggtacaaatgtgaatatctttatacatctggttctgttctgcttactgtgtttcagcaccattactgttctggggcataatggctaaactaagaattttaccagctcctagtttaaaaaaaaaaaaaaaaaaaaaaagaacaacgccatttctggaacgccttagttcaatcacatattctgtcatttttgtttttttgttataactggaattctggcttctttgttctctgttggaatagatatatctagaagctcagtctacagtcgtaaattgcaatttcacttctctttatttaaagtcttgctaattctgattatatgtggatggatctggatggcatttatctttgcattgtctgggaaagcataaaataaaattgcaaagagaaaaacaggtttggagtgacttcagaacctgaattgtttctgctctttcatcggtaaatagtggtgtgtaaactgtgtggctaatcatggaactttggagtcatttggtcttgcctctcttttcacactagagggacagaggctagaagatgggaagtgacttgcccagggtcacacagctgattgatgatatatgtagtaagaacacaaaagccactggattccacagccagggctctttctaatgagactcatcagtcaactgaactagtccctctgaagagacctgtatgtggaagcaaaatccatatgtgcatgtgacgtgagatccttgagaatgaggaacctttatatctttatcagcattttaaaaaacaaacttctgtattgttcactccctgtaatatgcatttttttcatttaggagacttatttttatttttttggtaaacttaggagacttatttagtttaggagaagtcattacttcacttctcatgtaaattatccgtgactggatagagagcactaaaacttggatatttttgacaactaattccaataattttggactgtctctctagatattaatggttgccagagttaggtgactgatttgccagtattttgtcatttttaaaattatttttattctccaagtgcaggtatattttagcttgcaaaattaagtgggtggaaagataagtgaattgaaagttagaaaatctgagttctacttatggctcagattcttcatggtaaaatgagtcaatttaaaccagatcagtgttttccagagcatggactatgtatcattagtattaataagcaagacactttagaggagacataccttaaacaaaaattgaacacttacatgtttattttattttatttttatttttatttttttaagatggtcttgctctgttacccaggctggagtgcagtggcacaatctcagctcgctgcagccttgacctcctgggctcaagtgatcctcttacctcagccttctgagtagctggaactataagcatgtaccaccatgcctggctttttttttttttttttgtatttttggttgagatggggtctcgccatgttgcccaggctgatttcgaactcctgagctcaagcaatccacccaccttagcctcccaaagtgctgggattacagacatgagccaccgaacctggctcgtgtttattttaatgtgttactacacattaaaaaagtaaaaccatcatatctgactgatgacttcaaagatgttgtttttcagggcaaaactaaaaaatatttctgtaaaaactattaagcatctaacaaaaattaaggactagtacaagtgagtaaggcaaaggccatgaagatgatcctcaaagaagtggaacacaggatcagatcatctctaagttcctttaaacataaaagttctgtaattctggtaacttaaacctgttatttatttgttcattgttgtgctggcaggttttacttgtctttatcaaatagtatgtccaggttggatgatagaacatcacaaatataagtttagcattaatgctatctaaattttctgggtgaaaaggaaagccttgatatcacattggaaagtttttagagataaagtcagtgggccaggcaccgtggctcactcctgtactcctaacactttgggaggccaaggcaggtggatcacttgaggtcaggagtttgagaccaccctggccaacatggtgaaaccttgtctctataaaaataccaaaattagccaggcgtggtggcgcatgcctgtagtcgtagttacttgagaggctgaggcaggagaattgcttgaacccaggaggcagaggttgcagtgaggtgagattatgccactgtacttgagtttagacactgtctaaaaaaagcaaaaacaaaagtaagaaaacctcagtggaatccataagcacagcctgaggattttaaagtggaatgggggttgctaaaagcactgaaatccctttaaaatgctttgtaaggatacagttctattctctcactgaattataggttgattgtatacacaaaggttatactgcacacatggtctaaagaagaaatccatgtcacaacaaaccacatgacagcttttctgaagatctaccaatgaggtttgcaatactgtattcatttgttattggaaaaacaataataaatatggccggaagaggaatcagaatggaagccataatattatcatattttttgtgagtaaaaaaaccctaatatgtcaagactgaataaacaagaatggtttatttgtttgaatatgcagtgagatatgtaagcatttgatgatcaagcttcaagaacaagatttgaggcttggcacaaaacttggaaagttcattggaaaatggtttaagatgatagctcaggccttctctagaaaaatctgccaatttgttcagcagtgccacctccccatggcctgggctagcatctgtctttgatgaacagctcattggttcatgaattcacacagaccatgaattctgacactacaaagggagggattctccccagtgaaattgtatctgggaggaaatagccttctgaggacattagacatcttatcacacaaggaaaaatggaagaaactgtagctactccactagagtggagatgatttccggggattataatagattgttttcaaatagttgaagaactgtccaatggaaaagggactgggttcttattttcttgttatttcagagtgcagaactaggattaagaaggagggacaggcaggaaataaatatattaaagaccatggattccgctcccagtatatgctgggtgttgtgtatgtgatttcttttaattctcacaaagtccctgagtgagtggtagatgttattatctccctacaacagaaaaagagatggaggtcatagaagttaaatgatactactactaatagtagtaaaaatactattagttactagtaaaaaaaaaatactaacatttattgggtatctacttcatgtcagacactgttctaaatgctttgagtacattatcattttttattctcataacaatcttaggagataggtactatatttatatctgttttactgatgagggaaccaaggcacaagggttaagccccttgcttggtgttgcatgttaataagttgtggagtggatttcagagccaggcagtctggctctgcagccaaacatccttcacccttacgctattctgctactctatttttggagcatttgttgtgtgtcagatgctgtacttgatagtttgcatccacatagcaacacagaaaattaggcattattattcccattttacagatgagaaaaagtgaagcttaaagaaatcaaggaagttgcccaaagccaatgactgacctaaaattgttacttagtcttcaggttccaggccaaagtctttggaccatgctcagctttctcagaggtacagaatctgaaacagaactttctaacaagtaaagctatgaaaaaactaggatgggttgcacagggggaggaaggagctctccttctctggaaacctcagaatgaaaattgaagccaggtgggggtggctcacgcctataatctcagcactttgggaggctgaggtgggaagattacttgagcccaggagttcaagactagcccaggaaacataacaagacctcacctgtactactgctaataacaagaaaaataagctgggtgtggttgcctgtgcccataatcccagctactctggaagctgcggtgggaggattgcttgagcctgggaggtcgaggctatagtaggctatgattgtaccactgcactccagcctgggtgatagagcgagatcctgtctcaaacaaacaaacaacaaaagaaaaaacaaccaacaaaccaaacaaacacaaaacattatgtcgtctagagggaagggatagaggagattcagatgtcatgtaaaacattgaacgagatgccccataaggtttagtcctgctttgggattttatgctgctatgtttttttctcatcttcccatgtcaccttgttgtcccccaggtgtactcaaacatatgtgcaaatatcactctaatatttgaatctggctctggggtttagattgccttggtaagatactcacttgctaggatatttgacacgatgccttaggggaaatgttaggtcatttgagaactcagcagcataaacagtaagtggtaaagttgtaaactaaggatgaaaatatagtgtgagggccttcacacaatatgaacagataggatcttccagtagcagttggagtctcccttagatgtacttttatagtgaaaatgtttggctgtcttgacttttccaggtgtttatcaaatgcccaatttgggaggagtagtttcctgagggtggtctcagttttaattatctccactggaatttgcccactctgctagaggtcttattttcaactctatgcctgtgggtggaaatgtcttcttcctatgagctccaggtgatatttgttgtaccatctcacagagtggctttggcatgttgcactgccttgtcttctgaaaccatctcttgctttgtacttattcctatggatagcaaagattctcagtgcctctgggtcaggatatctatataaagtctgcatctgtatacgcctcacttcccccatcccctgccttgaatcgatcttctgtgcattctccctagtgtctacacattatttctctttgatggcatcatggtggtggtgtagatgtgcgagccttctttgcttgtcttgctgtctactttggactcaaagctgagaagaaacacttactatttcagctcaaagctgagaagaaacacttttcccatttttactgtcccctctactcagctgttccttggactttgatatttaaatgtttctctgaaggaggtgggaggtggagaaagaggttgaagtgattcagaaattgcctagtgttccccataatgtcagaaaatttattgcctagtatgaagtcaagatgaggaaccaattatgtaccatgtgatgattggctactttaaagtgggtagattcatagaacagggaactatttacaacaagaggtttacatctgtgctactttcagtctaattcaaaataatgacaatgatgtctgtctgataagctgagatgacctcccaaaggattttgatgcagtagctgggtctgtagcttagctgagttacagaaaaggagaaatggggctgtgtctgtatgttagtattagaatgaaagctagaaaacaaacactagaataggtagatattacatttattcatatatttagagatgtagtggctgatttattaaattttcattcaaatgttggtgcattaagtataaatgcaaacagtcctattctagtgagcatttaactattggtatagggatattgcttatcacttttagagagtgacacagtcagccccagcagggaacagtcattcattctctgggaaaactacttttcaaagacaggaaatgttgctaagattgtaagcaccgagactgagtgtaaccaagtctcagtgatggaaaggaagacatcaaacatttttacatctaaaaaagcaacatcggctataatgaggagggtttccaggttactaatgagatcacagtggattagtgaattttctacgtggtaacagcatattaatttctaacctttctaacagaaaaaatccattaattttttgcggaagttaaactttctttttgggcttccaattagacccactgtgataaccagttcacaattccttcctccctactctcctcctttcctcccttccttcttgctcctcttactttccttctccgacacagataagaggaaataaaaaggttagtcattgaagaaatgtgggactatccaggttgcacactgatctcttctatttccctcactgaaattgtcattgttaaaacagattgtttctttaagaaaataaataaataaaggaaaagagaaaacaaattaaacaaagcctgtagaggcaatatgtttagggagtcttgtgtggagctttcagtgtgttctctgctgcatgttaactatcaagggttggggctgggatatgaaatattgttccttatttaatgtttcacactctaatctctgcattgcatatttgcttctcttgtgaccttctctttgcatttataactgcttcttttcacctataatccgaaaataagtgtacattcctacagagaaattaaaggaggctgtcagtgtagagttaatatagttaaagcatccttaactctgcgacaaaccccttaaataattaaaactgtatgcttgaagagtcagatttgcattcctttaccaagtttatttagtacactttgttacactcaattaaatgaggatgttctgtttcattttctttgctttgggttgatcattttgccttttgattcttatgccctggtgtaatttcacagtgcttaggtctctaaaactatacatatattaacgtatatgtagatatatacatcccattaaaaggcttaatatttgtactgaatagaatctttgcccaaggcatttgagcattcctggtaacctcaggtgtaactgggactgcagataattcatcgcagtaaaaacgagtttgacaaagttcttttaacatccagtgtctttttttttttttaatttttaaagctctgttattttggcatcaccttctctccctacggtttgatttgtgaatagcaaaaaccagaagatacaggtgttgaatggttgtggaaaggaaattaaatataagtgctatctctccacatctcagttggcagagcatgtgcagactgctctctgtaaattagttcattgcttaagttatgcatgtttaagaaggaataaattagttatctatttcctaatgagtagtgggatcaattggagcatgatgagagagaaatagcataattttgcttccccagttgaggttcagtatccctaaacttcaccattaatcactctatcagtttcctgggttatttcagatctatatgtaagatattcattccttttaattttcctaccaggtaagtaagtccttttgaatttgcccagtgggtttgtaaatgggtgatgctgtctctgttacacccagaagtgtccttaattacagtgggcccttctgcctttgcgtcagtttgtctgggtgcattcacgaataataataaatatgtatgtgcgacgacaatttcaagggttctaatatgtttaactgttatgggatctgttatgtctactttagggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggtaaggaatgattgcgttctggcggccccaattaacctttcccgtccgagtgtcactcactgcgtcctaattgaattagagcacttggaagccagctcagccatttctcgtatgatatgcggtggtgtctagctttaatccaattctgttaattaaagatgaatttttagatatttaattttactgtgcatcctttcagtgcctggccttggtggctctggggcaaagggatggaaagctttgaaacccatctcatctcactcattctgctttaatgagggcattcattggcacacaggagacctagaatcatatttttaattcattggctctgcaatctttttttccccagatattataagcaaagatatacaaatgacctactagtaagagaacatttctaagaaatgaaggggttataaaagtccttatatgaaacaaaattcctatagcacagtgctgcttgggagcggatttcctaagtgagctggagggtgttctagacccctgaaaacatgagatatattactgtaaagtaaaaacttgggatgtgaagttgccctgtgtcctgtaaaaaggataatagcaattttctggatattgtggaggcacccacaggtcagttactgcaaaatattggatcctggttcctcttagcggagggaaagaagtgcaaatgttctgagattttagaatccctaaagacgaaagaattatatagtaaagagcagacgtcactctgggagcgtaacattgtcaataatatgtcagccaacaaaaataacttgggagatttaggcaaaaacattacaactttgttttccatcaaactaaagcagggtttgaaaattttttaaattttcgattaaatgataagacgtgttagtggaaagatgatattttagaattgtaagcaataaacttaactaataacataattattttgatttttcatgtgactttgctcatctgttcacattttgtatggttgacatctgagtacatatctgctttttgacttttggctgttttcatttaatagtatttattggtaagacttaaaacgtttttgcataattttcatattctttttaatagcagcatggcattcatatggttggctatgcctttctttaataagacatctctctaaaaatgagcatttaaattgataacaatttttcctctggtagctagcactgaaatgtgcatttttgtttgtgtatgtcgttttgtttctattgatttatttcttagggaaaaatactatacttaatttgctaagtcaaaggatatgaaattctttatggtttttgctacatgttggcatgttgcttttcaagggcactgtagctgtgtgtttcactagcagtgaatgaatgtataggtactagttttatcatggtcttggcagcattggatgttggagcatttatattttgtgctgttttagtaggtacttaatcatgttatttaaaatggcaagatattttaaatattatttagcataatctcatttttacagatgacacagagatgtagagaagttaagtgattttttcagtttcatagtggcagagttggttctaaatccagatcttttcgcttatgtcttttttctctacaataatctctttattttagcaactttcatccatgaactattagcagttaaaattattgttggtaaatcttgagagttttgaactagtctgtgtcaatggaatttcaacacagaaattatcgagctgcgttgacaatgttgatttttaaaggaagacaacagcactgtgggaagtgtttatagaaatggaggacaggttagggctggttataatcttgtttagccactgaccttgggaaactgagttaaccttccttttccccttggtttccctctgcaggacgaaggattaatactacttgtctttctggattgttgtgtagattaatcagtaaatgattgctgctagtaagtttttgtgggccattaataactgaatggggaatgtgccaaatgaaccatcaaaatatatttaaagggtaaaaagaagaggccagaggaattatttagtagatcagaagtaaacactgggagattttataagggaaagtactccataaatggaaatgtgtcataactaaggaaatacaatgataaggaaataaaatgccaaggcacagctgcatggtcagtgccttctcttcttatttcccctatgatctggtgagacaggaggaagaggtttcagcatgggttgcagaatgtgagatcgaagggagccctgggatatggttagagaagttgggatcccatagagaaggccaagaatagctcactgttacccaggcaacctcatggtgctcagagggtaagagatggtgtgtgataacactctaccacttggctcaatgaggaccctttctgaaagggtgcttctagcagcagctgccaggtggcctggcagagtggagtcagaggtcagatcaatctagggttttagggctttttccataatagggcatccgactgtcagtggggcatgggtctcacagatttggtaggcatttggagtccactgaatctctgatttctggctttctactctagtgtagactaccctgattattgaaaacaacctgactgtcccccaagctcctttattctgtctctgagctaagttgtttctactataggccaggcactccctctatacctgtaacatccttctgaagttgctaatgttatccccattttacccaaggtcatttagtatgtaagaagctcatagtggctgagtatccacccaagtacactcagctagtagacatggggctgtctgactccaaagtgtgagcccttttcctttgtcattctgtgatattatgacagggcttgtggcatctggaagcatgcacatttgaagcttgtactagaaagtgctgtagcttctggcagcttcatgtggaagttgagtagctgtttggctatgtgctaatattgcacgtatttgaaagatgtgtttaagctctgcccatcttaaatctcacccttgacttagcagctgcaaggccagggaatcccatcatgagttctttgttggttcagagatgatgatccctggttaatctgtacatatgtcacctagtaggagtaacaggcaaagtcattaacatgcgtaatttatcagataatcgagcacagcttcatcttaggtcataagaagattgaactcaaaccagatatcactacaggatggaaggggagtataacatgtaatgattatgagcaactgggaagacccagccagttttgaattcactacctttgttaagttgtgtaaactctcaagccttgatttgctcatttccaaaatgggcatcataatgataatacaccttacggtggttgtgaggatatgctctgtgataaagctcatactgttcttagaacaacctctggcctgtatacaactttcaactaatagagtagaggaaaccaacagagccagtggcatagaatcccaaaagcagaagttaaaaggagctggccctgggcatttaaagagggatccagagtgtaaagagggagcaccaaaatgtataaaaatgagcctcccttataacagtgacactaaccagacagaatgttaggacaggaagagaccttgaaggccatggagtcctacctcctaatctgatagaagtggaaactgagactggagagatttaatgaattgtccacggtttcgcagataattaatagccaagttgggatagaatttggatggggcaggatggggtgggtgaactaacatgtattaacatgtattgtctatgggaggtaaggtccagatgctgtacccctgcattacatgtgtcatttcatacaacccccacaataacttgtgaagtaggtattattagcttccttttaacgtgtgaggaaactgagccttggtgaacttaacagttcagcagtgacctcaggatttggacttacgtccatcagactccaatttccaagtgtatttccttacctctcttcccagagtggggcttgaaatctgttggaggaactacatcctgggtaaaaccatggttcttcgaataactgcctccttttaacacaagtacttacacgtacatatgttcagggcctaaggtggtttatttcctgagaaagctgttttgtggcacagcctctctacgtaagctggccgatggaagagcattatgaggtagggaagtattctccccatttggtgtagacaactttggtgagttacaacaaagcaaatacccgtaaagaattctacagatgcagccagtcatgtaagctccaaagaacagtctaaattatgttatgacattagcatttcattgaccagtcctggaaatgagtagctactgatggtagcctggaaatatcgtctttttgggcaagcatttcccacttatgaacacttgaaatgatcaggatattctaaaaactgcagctaccaccgcattggcccctttcctcccaaatctctaccatggattggggaatgaaactttgaatccctatatcagacagctggagggagtgacagagcccctgttttccatctctccccagtctggctaatcagacatcccagtcctccatttgcccagacaacctgtgcctctcttcacctggctgctgcccgtagtgctgtcttcagggcatctagtctagggtcagagggacaagtggcttcttattgtcaaagatttattgccagagtatatggagagaggtacagatgaatccttcttaaagaaatactttttaaagtgatagtcagctcctattgtctcattaacattttagctaagatgtgttctaggtaagccatgaataggctttggtgagttgaactgggaccctgccacctaatagttaataacattttccttcttatcttagcaaaaatgcataccaatcccagacttggcttaaaaataaacttgtgaactagataaagtacctgtcagttaaaatgtgattatttttattgccttgaacatcagtggcttctaataccacattctctaaaggtacattttgcaaggcctcttaccatgtgtgttcttcctgcacgttggccctgtgttccttccacctgtgcttctttgagattacttactgttccctcaattttgtccctgttgtgctttcatcttcagaatacttttggtagccttcttgaatattgcagtttatgctcatggatgctacacaaataggcattagaagatctcatcgtttgattgcacatccaccttcttatttctgattttcccttatgcccatacccagtttcttcccatttttcaaatgcaacatgtcccttcacacctctttccctttgaaaacgctgttcccacttcctggaatgaccgtctctaggagaactcatcctttatgacagattctctttcacagtaagctactttccttaacacatcagtcaccagtctgtgcatcccttcccatggctatgccattgtttacttgtttctctgccctaccagacagcagtgtgcataatgagtgctcttggtatgcctggttctgagtatagggcctggaacattgttggtgtacacaaatgtttgttgaatcattgagtgagtggatgaacataaaggtacaagatgttttttcctgcctccgcttttggccaaactttaaaattatgtatgtatagtgcctaatccttccctccccttcctttttcttttattctcaaagaacttataatatcccattggctgttgttgttgattcctatatactgtgcagaaataagaagggtatattgttgctgttgagtttcccactttataattagaaaggcagagtttttgggtggtctattctttcagtcaaaagtttacgtataacaatccagtcagtcaaaaattccttttaacacagcatcattgccatgaacttttaattatggcctttcaattatggcctttctttggtctggattgtcatttaatagttccgagcttcagtttctccagccctaaaagggagaacaaaaatgcttcaaggaaaatctcaagaagagggtcattcatatttgtaagagcattttgttagacatggctgtaacagagtgtgactgtaaccaacatcccagattgcagacatacaaatcaatttttgcctctctcagaagactatattccctttctagtgatcctgctattggcccaaagttttggagctggtctttaggaaaaaccttcaccgccaaggctgtttattttattcttataatatatgttatacatgtgcattccttttaacttagagataagtgaaaagaagaaaacaaaattacctatgaacagatgtaactactgttaacattagtgtgaattcatgtagaatgtcttctataaatacacacacacacacacacacaaatatcttttgccaaaatataagtcttacagttgtattgctttgtagtctctttttcatcttaacgatatattatgaaccacttttcacatcactgaatgtggttaaaatactttttcccaagaagaatactttcattgtaagatacacataacattataaaaatccaaatatttgatgtgtgtaaagtataaaatatacattcctccataattatatttccaaagtaattacttactatttgatgtataacatttcaaaattttttctactttctgtttctttttataatatcctcaatagcaggaaatcttcacccatttagggtctttattaaggactattttttaaaattgataaaactatgagtgtaatcttgtaacttaaaaaatgaacacatcatgctctgtgtcagcatagcattctgttgtactgatgcactttttatttagctagatctcttgctagatacataaggtatttccattcttttattattctacttgcactgaagtgatgaacatctttcttgctctctctttgcaaacatccttaattatattcataggatatattcctagaagtagaattgtttcttcagatgatgtgtatttttaaaaaattatgtattatcaaatttctcttcataaagattgcaatttctccatgatactctcagtagtatttgagagtccgtgtcacatatttttgggtaccctcagtggcagcaaatcttcaccctttaaagggttttaaaagatgacgatagctggatgcagtggcacacacttgtagtttgagctactttgaggttgaagcctaaggatcacttgagcccaggagttcgagaccaacctgggcagcatagtgagaccctgtctcaattataaataaataaataaaaacctgtaaacgattttctaattatgaaagctcacatgttcattgtaaaaacatgtaaacaatgaggccaggcacggtggctcacgcctataatcccagcactttgggagccaaagagggtggatcacttgaggtcaggagtttgagaccagcgtgggcaacatggcaaaaccctgtctctactaaaaaaatacaaaaattagtcaggtgtggtggtgtgtgcctatagctccagctactcaaaagactgaggcatgagaatcacctgaacccgggaggcagaggttgcagtgagccaagatcgtgctactgcactctagcctgggcaacagagcgagactccgtctgaaaaaaaaagaaagtaaatagtgatacagaaaaaaattaaaattgccaatatatcctataaagctcacatgtaactactgttaatggctggtgtgtatcctgtggtgtggtagatgtgcatgtgtgtgtgtgtgtattgtgtataaaaaggcagtgtggtattaggttacaagcatgagtattggattgagcctgcctatatttaaatcctggtttcaacattattaattctgtgatcttcaatgtattcatttgtaaaaggagacttattaatgcttagtgtatccagcctctaaagattgctgtgaagttaagtaagataaaggagacccaatgtgtacaagtagtgaatggtcaggaaatgttatttgctgctgtgacattttccgagcatgctgtgcagtgacagctctttcatgctctgttgttgaggttctgttactcctggggagggcaggaattggagagacagggggaggggagaacttggagaaggtggccctgaagtctcttgtgtcatagcgacctgctggcctgtggcccactctgcctgtgcaacagagaaaacggtgacacagtggccctacctggccaccagaaacctgatgctgtccccttccaagtaccccagaccaaacttacatagacctctccttagactctgattaacatctgaaccacagaagcagggcagcagggcctctcctttccctttccctcttccccatttcctgtcctctcccctctgttcccctctttattctgacccactctctctcccctccagcgtcaccacccctccttccagaaaccacccttgcccaccggctcctgtcttaacaatctccagcaccaggctttattcaccaggttaccaagggcagtttttaattaaaaaaaaaaaaaacaactctttcacataatactttccaggcatggttcacacatttaagatttctgattttttgaaacaataaaaaatattaggaactggagctggtgaactgggcaaggtaggagatgccattttaaatagaaaatagaggccgggcgcggtggctcacacctgtaatcccagcactttgggaggccgagacgggcggatcacgaggtcaggagatcgagaccatcttggctaacacggtgaaaccccgtctctactgaaaaaatacaaaaaaaaattagctgggcgtggtggtgggcgcctgtagtcccagctactccgagaggctgaggcagggcaatggcgtgaacctgggaggcggagcttgcagtgagccgagatcacgccactgcactctagcctgggccactgcactgtagcctgggcgacagagggagactccatctcaaaaaaataaaaaattaaaaaaataaaaaaaaatagaaaatagagattgatacctggcaacttttctctagtaaagtacctggcacttcccaaagaatcacttcagaaaggatttgagcagagcagcctcactggaatgtttatagtcatgcaagtttatgattacctaacagtcatatctaataaagaggtaaaggtaggagccttttttttttttttgagatttattcttgctctgtagcccaggctggagtgcagtggcacgatttcgactcactgcaacctccaccaggtagaaggctttaggaagggcagataagattaactcttcctatgatttacaaaggagaatatgccagaggtttccctagagtcaagatctctgattcttactgttgagagtttaatactcaagtagtttcttaatctttagcttgttcacaaaaacagtatctaaaatgctatacttttaagtttttgattcataatttggttttcctagcaaccatcctagagttatgatttattgaaagcttctctttctagttcaagaaatccacttagggtccttttttctatttttttttctttcccctttctcatcatcattgttgtccttgtcgtggtgtgtaattctaggatttcagtaggtgtctatgagttgcctgtatgttctatcaggtagctgtaacacagcttgttttgtctgtaatagtacaggataagagtatttgcttaatacaagtaacagttgattcatgcttattatctgtgtgtctttctttacattgaataatttttttcctatatgaattacttcatggtctaattcatataaaagtgcatctttccaataaggacaaaattaaagtgtagttcaattttgataacagaattaagtaaagtacttgggggaaaataatgaacccaaacacagcatagttgaatatgctcaaataagtaagattggattttgttccattagaaaggatcattagtgacctgaggacaagatgactaggtcttttgtgatccatgtgaacccaatcctctgtgttatgggcagccattttcttaaattacataaattattatgcctttaatttatatgacatctttcctccaaaggactcaaagtaccttttgagtatattagatcattaatgcttatattgtttcaggggagttgatatgggcagatagtattatctctgtcttactgatggatgggtggagatccagaaaggtggaaggacaggctgggtcacattggagccaccattagagctgaagtcactgagttgactctgtgttccagccttcaattcttaagcttcctactttctcctttcctgaaatctccccatctcctaaagagaaaaaaacataggcaagacatacataattattacttcatcagcttagcagaaaagccaggaaagcactttcctgaaaagggtgaccttttaggaattttactgtatgaaaattgtatcactgttaaacaaaataaaaaagcggctctttgaaaacaaaaaagttctcaacttttccaaactatctggtccaagaggaaacactgaagccccctaaatcctagagcaggactcttgtgtcctagcacatgaagagacttcatcctcagaagattatttgtgtatattctaagtgtctcctgagggccaggttactgctttgtgggaggcactgagaatgcagaagcaaagtcactgcatttagcatccagtctctgattgtcattattttttccccattttgtaaatgaggcagctagaactcagagagttcaaagatcttgcccaattttgcacagatttgtcagtgggaggcctaggactgggggctttgtctttccttctgatatgatgacatttctcatcatagggtaagtctgcctatcaaaacctaggagattattctaattatttgaggttttattgttagaatggagtgctggttttatcttaatcattccctctttccaaatacttgcatctaactggagaccagatattttgacatagatggtagaaagtacacagacacctcaaaaccaataatacctcaaactgaaatatatcgcctccaaatattgcttgttcttttaaattccccttttgactcacagtaccattaatccaggtacctgaacctcctggaactatgactacattttattcatttcacttcctgagtgtctttctgacctctatggtgcctaaaaagactgccaaaccccaacttgccattcatctctcctggaatcccccaataataatatctaacacttgttgatcacccactatagcctgaccctctacctgcattaactcatttaatcctcacaacactctgaggctggttgatgctgttatcaccatttttactgatgaagacttggtatctctttgttatgggccctcccaacatactgatatttttgtggaatgcattttaggaaccatgaacagatggaatggagtctactgtggtattcagagctcttcatgaactggtccaacctatctgtccaccttaatttcccaccacacttctctctggcctctccctcactctttggacttgtgtgttactgttttctcccctgttctctctcttatttttattttttatttttttccttttttgagacagagtctcactcttgtcgcccaggctggagtgcaatggcgctatctcagctcactgcaacctccgcctcccagactcaagcgattctcctgcctcagcctcccactgagtagctggaattacaggcactggtcatcatgccgagctaatttttgtatttttagtagagacaggtttcaccatgttggccagactggtcatgaactcctgacctcaggtgatccacctgcctcagcctcccaaagtgctgggattacaggcatgagccaccgcgcccagccccttgttctctcttcttgaccacagcaactttccggtccaagtttgttcccacctcgaacttttgtacttaatcatctcttcagtctgtcaatttctgctcaaatgccacctctttggtgaggtcttcttattttacctctttctgcatatccttctttgttgttagttttcctccgctgaatgctagctctgcatgcctgtaatcccagctacttgggaggctgaggcaggagaattgcttgaacctgggatgtggaggttgcggtgagctgagatcacgccactgcactccagtctgggcaacaagagcgaaactccgtctcaaaaaaaaaaaaaaaaaaaaaaagatgtgttgcttccctgggcttcagccccctcttttctacaacaaggggaagttgtcacagagtcgtgaggatgaaattgaaggcgccttattggaagatgtcaaatgtcatgtaaatgttagacatgatcattttgttgttaatatcctgtcctatccctcattgccctaggtaggaggcctcccaatgcatttccagtccctgcaacaggtttctggataaggatagtcatccttataccaacgtggcatttggtttggctttgaacttcccagtactccatagatcactttcatcttaatttcccacctccccccagcctgcctgtatattgtttccaggaatcttgattccatctgtcccctgggtttttgaatgccattttcctggcccttcaagctgtatggagagtcatttccgcttccagtctatcactggactcactaattcttgatgtttgccacccgcccccacctttgactgataaattttcattattggttttgcgtgaaagtcttcagggctctactctgcctgacccctgtggtcacttagtgattacatgtgccagctgaggtaatttattcactttgttttggtgtgaacatgtcccatggggcttgtaactgctgtaatcacttgaccctagtgattgttaaatgctttaaacacagttattttaaatttataattgttttcattaaaaatcccttatagtaacttaactgaccttgctgtcaatgtggcgttatgtgcagggggaggaaatgaaaatattatgatgcaaataatatagtactcatcagagatatgtggcaaatcattagctcactccacacattctcacttggagtcctgcaaggaagatgaaagggaagacgacataattatagcactgtccacgtaattcaatgcagccattcccacacgcagggcaggccactagcctagagaggtgaaagtggagtggagcccaaggttaagtcccagaagagcctcgcatcaggcctgttaaatgtgtagacagcacttctcacactggtgggcggcctccattgattaattattttttaattaatatttcttcaagtttcaggaaagttgcaagaataatacaatgaacactcatatacccgtcacacagatttccccaactgttaatgttttgctacatttgctttattattctctttctaggtgtgtgtgtgtgtgtgtgtgtgtgtgtgtgtatgttttcctgaagcatttgagtttaagtcatagacatcatgcccctttaccctaaatatttcaatgtatctttcctaagaacatggatattcatttacatgagctcactacagttatcaaaatcaagaaatataaattaatacaactgttatgtaatctatagacctttttcatatttttccagttgtcttaatcatgccatttatgacatttttttttctattccaggcttctatacagaatcatgcactgcagtcagttttaaaactcaaaccaaatcaaaacactgtttcttactttgttgccttaaggaataaggatttcttaatggaaacttggtcctatgaaattaggatttggacctacatttctaataatcatgagaattgctgtatattaagtgacaagacaccacactaggtgtgtattttgcaaacacatttatctcattcagcccgcccagcaaacatacaaggaagttattcttgatctgcagctccagatgctgcaactcagagaggtcaccatgctctgggtcacagagctccaaggggcagtatctatgtcccacatcctgcattcttctgcggcatacaagaagggtgggactccaggatcctggagactagtagccacgtggaaacgactgatgttatatttgtttcatttctagtttttacattttactggcaaaggtcagaagatatatttacattagaaagttacctaatatgtattttgacttcaaaagatacggcgtggtgtcctgattaattttaacaattaatgaaatttgtaacaaatgtcaaataaactaggtttgtttaatggaatgctgctagactgctgaccagaaagtgctaaataatgaaatccaaagagccttgataacctggcttgtggtactggacacttggatgttgagatactctgtgtgtttctggcctggctgttagtccttgtggaaacttgaagtcatgttccagagttgtgaattgaatggcccttacaaaggcgtttgattagcaagctttcgtaatttagcctaaatggggctggtggggatgattcagttccagacatatggttacatccctatatttggttttggttttgtttattcttgttttttttctttcctttctgttttattcctaaatccaggatttctgtgaatactggattcacaaaatgaagaatatacaatgaaaatactaaaatatcagttaggtttcctaaatctccccccaaattcataaattacagctaactattctagcattcctcctagtagccccagtactattattactattactagcactaccaccaccatcaccaccacttggagaaggaagtggggatagttgtgcattttcatttaaaaattttcagtatttttccaatatgttatttctggttggggctgctgcttatctgtaaagtgcttttctacaaagtgtaaagaggagtcccctgggcctggtgggtacatactcggtgaatggcagatagctcccacttacccccttggctgctactcttcttgtacagtgaacaacctttgcaaccaaaattaaaagtcatttcttccaacataattattttctggaacatcataaaattctcccctattttttaacgtaaaaagtgacattttgactaaggaaattgataattattttaagaaatgatgtatgttttataggctatttattacaaatgctaaaattaaatgctgtaaatactcccttcatttccaaatacttactgtatatgaaaatgacatataagacaatatcaaaaagtcataggtgacaaataaaaataaatgctagcacaaaacattaaccaaagataggtaataaaaagtgaaaagaaaggcaaacaaaaggaagtcttctgttttgatttgtcccccaaatgaacattctttttgtttgccttattttagcatttatgtagggaaaaaatgacttaattttggttacattgcctgaatttcccagcttttgtcacatccggaatttgtgttaatgccatatttatagtacaccctaaatgaataattaagcagctaactataacatgcattattgatctatcatagatgttattgcagcaagttttgtgtacattatgaaactggggtaaactttttttacattttttacattttttttagctgttcaaattttaagagcaggaaagaagcagcattctttttttctaatttcaggataaacgtgtacaattaaactgtgttgtctcccttctcgctgccgtttttatgaatctcacttatccttctttgtttggaaattaggaggtaaagctccttttggttttgaagagactgtacttgcctgtgagggcagacatctaactataaaatatacaacctctgagctttgatttgtctgtaaaatgttgagaacaatgttaggaagttcttcacttgctgactctaaattaatcctattccctagtcgtttgagactcagtgcccaccaagtcctgtatagttcttccctttattacctcaatttagaattgttaatcaaccaagagcatataataatgttagtggtggtgatggtgatggtagtggtagtaatagtaataatagtactggggttactagtaggaataccagaatagttagctgtaatttaggaatttaggaaacctaactgatattttagtattttcattgtgtattcttcattttgtgaatccattattcatagaaatcctggatttaggaagcaatgtaaccacagagcctgaaaatgtttgtgtatatatagacacatatatatatctccttaacatcattttttatgattttacactcatatatatgtgtatcctagcattcctactggtagctccagtactattattactattactaccactaccaccaccatcagtactattatatgtgtatattttataggctattacaaatgctaaaatcacacccacacatatatatgtgtatatatatgagtgtgtgtatatatatatgcacatacatattcatgtatacacacccacacacacatacttttttgtgtgtgtacgtatatattttgtttgtttgtttgcttttgagacaggatcttgctctgtttcccaggctggagtgcagtggtatgatcaccacttactgtaacctctgcctcttgggctcaagcaattctcccaagtagctgggaccataattttacaccaccatgcctggctaatattttaattttttgtagagatggggatttctctatgttccttaggctggtctcgaactcctggcctcaaatgatcctcccgccccggcctttcaaagtgctagaattaaaggtgtgagccaccatgcctggccctgaatgtgattttatatatgaattccaaaatgaatattttaagcatacacatttaatactatgaaagtgagtaaactaataatttgcctataaaaatagatagaaacaaaaaatgcaaaaccaaaatgtatgtcttttgtaacgcatctggagattttgtcctttgaaaaggccacacaagagttaagggtggtgggaaggcaggaaggacttctatcttcacagtcctgtgcatacgcagctcctagtccagttaaagccttcttatccaacctgacaaggaaagaaaagtgttcagttcatcaaaaaagtcagctaacgtaggaacccatacaaatgataatcatatagctaaatagttttattttaatgtgaagcataagatgtgcatgctttggtcagtgtcctgaggtagaactgaagccttccctttaagtatggacacagtgattataggtcagcactgtctttcttgggtaaatcacacatttaatttctcatctttattaaaaacgtatcacattttcattttggcatatttattggtgaacataaagatgcttgtgaaacaatctgagtgcagaatctttctagaatgctatgatttttaaagtcatttataattacatgagatgattacattaaaaaatacagctggataaactggtttggagataaacagaggtggctctaggacaactgtgcatggagcagaagagcacaggtgactactagagacagcccctggctgctgttagtgggtgcatgttgggcagcagacagtatgtgtctcagagaggctggagactgtcggttaaaagagtgtctagaatatctagaaagatcctaagcagagactgtgtgtggttcttggtagctgttctgtggctcataatctaccataaactcttgtagtagttctcagatctaatgtttgatttctttgcctgcctgggaattgtttttttaaaaatgtcatggatatagttcagtaatagtgtgaatttgttgttcacaagtcagtgtacatggtgagttcctcgtttttaccataagtaaaccaaaatgcatcgcagagtaagaattcatagtataaggtatcagagaggaacttaaattttaagaagggttttatttcttagaaatagtttatacatgattttactaaggtaattatggagactccttctcccatgacagaaggaggaaagatcaagaagcttggcatggcagttctttcttcgtcctttggtagttcttttcatcagggccagaggggttgaagtatgagggtgtccgtgcttacaggacaagctctttcccttctcattagtaccctgttccattgcctaaagagagagaaacatgcaggatgaggaaggacacgtcccagacacataggcctacactttagcagcgttactacgtcttctcgacgtggatagtccagaatttctgaagtgtgattggttcatcaaatatatagtatatagtgttctgtccattcatttgtaaaatataacaaagctcctcaatattgttggtttaaaaaatgtcttttaccgtatacataggcttgaatctaccttgttaaaaattttgtgcttgtgattattagggaaatatgcccagtgttcataaaagtgtttgtgtatgccctggcatggaatatagatatacaccgactaacaatagctataaaaatgaaatcttgcacagagctgtgccctgccttcccagtcagcagtaacaatgcttttggagttgaagggaagcttttccactggggagatatatggggagtatggggggatagcagcttaagaaatggggagggagaagtgctgcaaattttagtataatgcataatgttgaaagaaattctatcccatcataaagattagcaggctgtgtaattcaatttaaaattggttggcgtgtcctgactattataaagcctttcctttttttgttgttgttttatcgccattccattatttgatgtcatataccaatacagaatggagcatacagccaacccatccatacagggtctctttccacatttgcatccattggagaaattgttggggaatgtaagagtttatcttaaaatgaattaagaaaatgcttgctcaattgaatgcctccttgttttctttctttcttctttcttttttttaacacaaaatgaatttcttctgggcaagcaaccattgagagtgaaattcttttaaaagcatttgctggacacaggacttggttctcaaaattccagcattagcacttatctacagtatcatgggcattacagtgccattgaaaatcaagatgcagtagcttatgttaatgcaagactgacagacccacatctgatggcaattacccatactggggggttaataaatgttcttagaattactgtctttattttctttattgcaagaaaaatgggcagcttcctaagccgtgcctcctgcttcttgctaccagccttggtgacttgataattaactgttttcattccagtgcttcatgggctcttctgagtttaatattcatgttagggaaatgctacgtcctttagccaaagtagtaaaaatattaaattaaattcagcaaacatttatccaagtaccctttaagaacaagaaatgaagacgtatagaaataataataataataacgagacttggatgcatcagaagagtgtctggaaaatgaatgcacactgttttttccttctagaagggagcgagcttaatttttattccttttctgaaggggtttcagcacaggtgtggcagagagaattcatcacacttgccagctctgatcaatctaaagtggctccctgaagcactttgttaagaaggatcctcatgctatatccaaactcagtgggaaagatgttatgatttatcagcagtgtctctcatgctatggggtaggggtgtggttactcataccatgcatttgctgtgcctgctatagtgtcattcatctttgttcatattcatgctctatgaatgtggtaggcagaaaattgctgtggtggaaatgtatgcctactttattttaactctttagagtcaatccagactttggaatatctccaatactaagttcctgaaatgattgtgatcttcgcttgatgggattttaaagttttcttcacattaaaggctattctatgtctgtttcaagaggttcttagctgtctgtaaggcaaattgggggtagtgcattagtaaggttgtcaagaagacaagaaaacacatacaacttttggggtcctgtaggatttaggaagcaaattaactttggtttgtgatgctaaatctatagtaagaattaaggttgtacaaccactctgatggtgtggttaacttgtgaagctgttttgcatacctacttggaaaggaattcagagatcaggagagacaattcaattcaatttatcctgttatgtcccccaaatcttgggcagctcagttttctctagcccctagtttctatctcctaagcctgactgcccatcagaatctctcaggcaggtggttaaacattcagattcctggaatctagttcagacttattaaatcaaattctctactgatgagtcctcataattggagctttaatgagctcttccctggttctctcacagccagtgcactaccaccttcttgcttatggataaaatggattgccgggattggggatatattctgcatactcctattatcctaaacccagccattcttttccactctcttttcatgatgacccctgtagacttcatttagctcctctgtaaaagaggataatagatattgcctcataaggttactgtaaagatgaggtaggttaacgtataaaggttttttgtttgtttgttttgagatagagtctcactcttttgcccaggctggagtgcagtggtgcaatctcagctcactgcaacccctgcctcccaaattcaaaggattctcctgcctcagccccctgagtagctggggttacaggtgtgtgccaccatgcctagctaatttttgcagttttagtagagatgagtttcaccacaccaggcttgtcttgaactcctaacctccagtgatctgcccaccatggcctcctgaagttgggattacaggagtgagtcattgcgccagacctaaagttttttaggatggtgcctgacagaggtaaatattggatgtgttggttccaaatctcataattgtcatcatcatttgatttcatttacagggacactgagtatctttgccagaggcagcaaatcaaattataatatcttaccaggctgttgtaagaagcagaaggtatacaaaaagctttgcttggttgaaacactattttttgaatttatgaacatgtaaacatagaacagttaggaggcttttgactgtaagaaacaaaacgctgtaagaaacaaggaatttagtctctcattaaaaaaaaatgtccaggcacaaagcagttttcagcatctggtaattcaggggctcagtgatgataccaggaactcgggttctttcagtattcctcttacatggtggctttgtcccaaaggtttgagaatgactgctgccgaagttccaggtatagcatgaagtaatgacagtgttcattggaaaaacaaggtcattccttccagtatgtctctttgtataggtgatgaccatttccttgaagcccatccacagacttttcttcatgtttcgctggccaggattgggtgaccgcacctccttaaaccagtcattggcaagggaaatagatgtactaactaatcaagataccctcacctgggtctatgaataagtttacctttctggagcacaggcttcccaggggaagatgaatacatgaataaaactgggggctgtgctattgaggaaaggtggggtgaagatttgaatgtgccatcaatagcatctgcttaatgagtctcataatgaagtatctttgcatggcaccttgaggaaagtagcctatggtcttcctagaatggagtcccttgggtatggcaggagacagcactgtagtgaggcttggccagtgactgagataggcttgggtagcattttaaaatatcatgccttgtttccttgtttcaatatcttgtttcctattttcatcctgaaatctttacttttcttgtttcctttttttatgttccttgttctcttttctttcattcttttgtttcctcttttgtccatgttataccaggatccatgtataggacagacttctagccacctgtgtccctttcccatagaaatgatctcagaagagaagattacaggttcctgttatgtggtcagattccaaagttctgagagacttaacctatcatcacctgttatgtttcatggctgtttggagcagtttaaccttctgtcttatccatctacagttgaatagtttacttcctgaagatcacgtatttggcatattgagattctgaagataccataggaactatacttttaacaattcaagctaattatctgtcaccatcaattggccacgaagagatggaaagacacttggttgatatctgagcccactggtagagtgtagcaagaatccctggctagacctcttgaaacaaagatgtgcacagaagacaaggcctgaccaaaaaagagaaagagaaacagtcatctgtattattttaatggttttgagctcatttccctttatagaggaactaggcttaaccatgggtggactgaggactcctgtctctggactagaataaaagtagggcaggaggcccccattatccctccttgctagggtaatgctggtcactgagatcttgtctctcattagagatgcaaagaaaaaatggaagaatatgtttttttttaaggtcatggcccactcagacctagagaacagaatctttcaggataaagcctggaaactgatttacttttttttttttcttttgagacagagtctccctctgttgtcccaaactagagcacagtagagtgcagtggcgtgatcttgggtcagcgcaactctgccccccgattcaagctattcttccacctcagcctcccgagtagctgcgatcacaggcgtacaccaccacatttggctaatttttgtatttttagtagagacgagttttcaccatattgaccaggctggtcttgaactcctgaccttgggtgatcagcccgcctccaccttccaaagtgctgggattataggcgtgagccactgcacccagccatgatttactttttaacttgtacataatttggaagatcaaacgggtttgggaactactggcctaaagtgactatctcaggctttataatcgttaaagggtttgtacaatcccggttctggggcagtgatttttccaagggccctgaggggctagaaatgtggtgttgtggggtaaaactttatccctccctccttccccccacaacaagagcagacctaatttcagtttttttgtttgtttgttttgtaaattcaaacttcttcataaacttttctttgaacaaagttttcccttgaccccacttgccccagcatgcaacgagaaatgatctgtttctgggccaagacacattaggtgccatggcttcctaatgtcattatctgggccatcttggcagagccgagggaaaaatcccatcaaggccactgaatgtctgaggtcacatgaacaagatatggaaagtcaatggtggccaagtagaatgaccctggaaggggaccctggaaccaaggtgcatggccctagtcatgaggacatcttccctctcaggacttctagaagcccaatgacaatagagttctcataggacaccgttactactgcctatttggtgtctcctcagtgaagtcattgtgttgtggcgcatctcaactccccagagtccaattccctataataatgagaatttttaaggagacaaaaatagagcctaagaaaataaagaaatatgctagctttgttgaactattccaaaccacacccagacaataaccacaaggacaacaacagtaattgacgttcagagtatacacacatttagcccaatcttgctaatggattgcattttaatctccgcaaagttgcttcaacattagaccattagtagcttgccttctgaaggtagaaaattaaatattttagaaaatattttcatcacaagggtagatttttaaaaaatattgtctaattaattgtcagctaatcaactatagatgattgcactgagcgttctaatgaaaattgagatttacaaggaactatgtgcttgctatactgttctaaacatctctggggtgtgtgtgtgtgtgcacgtgcacatgtggtgtgcatgcatgcatgtatttcctgccttcttacattgtgccgtacataatcaaggaagtttatttcttagctatctttactgttcgttgaaaaagggctagacagacagaaaatattgacttatccccctcaaagacaccttcctggattgccatatcttggtaattttctctgttactctctttcataggacctgctaattctcttccttgcagttataatctgagttatgttgataggttatttacttctttattatctgttgctcccacctgaatataagttccataaggccagagaccctgttctgtttgctgcattattatattcccagccagccccatcatactgccagtcacatcctaggaccccagggaatatttcttggaggttgtagaaagactgtggtcatttcatggcattctggggccctatttcattatcaaatctcatcctgacttttgagagagtcagaagcttagtgggatttaatggaatctaatgggatttcttttatccaatgctacaggattcgaaaattaggttgagacctgactttgcaagacccttgaaatgagccaaaacataaagaaaagtgagggaagagagagttaaaccacaaagtgggtgaatctgagaatgtggggttgaaagtgaaatgccacatgacagagttaaaaagtaaaaacagtttaacctgaagaactgaaatctggccacactttcctagtaagggatcaactttacaagctttggatgggtttgaatagaagaggttggagttctcagttttggagaattaagttaagccctgcaaaaataccttctttttaaaccagtgtatctaatctccagtttccggtcagaacgctccaaagtaattcaattttaaaaaataaataaaagtagccgttttcagagaaagtcactcttcattttcaccatttaagagtcaatgatctgagccttagcttccactctgaggaaaataatcttagtgaaaaacaaaagctggcatgttagagacatgtagaaatgaaatactaagctagagatgagcctacatattataaaaagataccaatctagaaaatcttttgctctcaaccttgagaaaccaccttggtggtattgatatgaaaaagaggtgctgtattggctgaggataagcaaatgtagccccttagttattgatgaaaataaaagtaaaagttgtgatgttagtatcatggaagaactttaccattgagtttcattaaaggtaactcagtgatagtgtcagagacagaagaaaagcttggaagaacagtagctagacacagaaagataatttctatcatcttaaattactccctggcttaagctcatgtttaagatggctaaatagatgctttccatgagtcaactgaaaaaaaaatggccttaaaccgtgatagtacaggttaaaaacaaaagagtatcttaacaatgaaatttgattagtcctctgtgtctatgaaataagaagaaatgagtgactatatgtcttgggtgttactgcatgatacttgctggtagtggcagatgaatgttaggacccaggattcatgattgtaggcacagtctttagaaaaacttcttagcttctctgaacctaaacattctgatctacaaagtgaatcatttaaatctctgacccggtgattatgtgatatggtggagaaggagaggattggtctgcaaaatcagaagttctgaattgcaactaagtcattgggtgaccttggaggagtcattttagccttgctaggtcttagtttcccattccatggaaggaatgattcaaatctctgaggactctgctaggttggaatttcggtaagcctggaattaaaggataaaaggtcaggagcaccctgctgtcccttgattttctgttggaagcaaaaggatagaactggccttgcacataaattagcatggattctttcatctgacccagtgacttgggggcctgagaagatgcacacacgtgtcctgtttgggcctaggcagtaggctcatttataaagagtggcctctgcaaagccagctgtcaaaacagcagtgattttcctgagaggcctaggggtgaaaactttcagatgaagggatacaatgaagaaatacaggcaccttcctcaaataatgaatgactattccattaactccatctattgattactcctctgagctaccgggaacaaaggctggaaaaatctttaagtgcatagtgtcaaccatgcagcaataattcccttctcttttgaaattgtaacattatttgtgtcatgtatatagttcatttattcatttattcatccatttatttgttcactcattcaacaaaattgagcccttactacaggtgggccaacttctttgccctcttttgcctttcccagtaaaaaaagcccctgtataacagattttaaaaatcagatttagtttattaatagcaaattaacagtatactttgtgatgtatataattggtgtcatccttgaataaaataaaaataggacttataacacttaaaggccattttgtagccaaaattgaggtcttcgctaatcatatccacatgattctcaggcaatatagaattatttcttcattcattcatctatttgataagtaatgattgaggccttctgggaatgcaaagatgaatagaatatagttcgaaccctcctgaggtccatagtcatgtggcagaaagagaactcgttagacaaatcctcattctgtgaactgcaagcacttggcaagctcagacctccagatatgagtggggaagtggctggcagggcacagagagttctacacaccataccacagaacgtttggccctttgtctgtgggcaataatagagaatctgggaagatgttaagttgggtgagtgtttaagtgtgtggagggagtgtatatgatcagatttgtattttgatgagatcacccagctttagtgtaggaaggattaagccaaggcagccttctaggaagggtattactttgctagggctgtcaaccatggaaacacagactatgtggtttaaacaacagacatttattttctcacagttgtggaggctactagcaggtttggtctatgcattttgggggaacacaattcagcccataaaagaagcaaaccaaaaagtaggggaaatctgctctttgacagagtgtatgcatatgtatgaggagggagagaaatttacatgttttttaatgaacaatttaaggcaaatgtagtatgcatttacctgacttcacatgtctaggaacaaagaccctcatagaacaaacacattttttaaattttttcattttactgtcatgccaaacacctttttatgtatttatttttgtgtcttgctttggaacaacgttcagcagacagagtatgctctccaactgtgttccgattacctgaattccttaaaatacttaattcaaattatttaaggaagaactttatggaatactttgtgccttaattatactaattaggagaaaacacagatttaggaagacagtgtaaatttatctcttgataaattttaagatgctgaggcctagatctctagaaattggaaaacccatgagtaaggaatgaaaatgtagaaagtaaaatagacctccaattctgcttcttggaaccttgggtaccaagggccatgatggaatttccagaaatcctttcttcctgaggaattatactacgtactttttactgcttcataccagcgggaggcttgtgggataaagccataaaagcattgccaaagaaatatcggagactattggaaatgtgttccagtggaaccaaaacattatccaaaggagacttcatgatttcacaccccccaggaagtcttagtggctctgattcagggtagctcttatagtagtaaatgttgcccattgaggggtggagaaagcagaatggaaaaggaaatgaatatggtctccattccctctatattgtcactgccactattgatcaaaataaccttctctgaggggtttctttgtaaatattgtacttgaaatgcttcactcaaattttgagttataaaatgggaagaatcaattttactggctcctaaattttgctctatgcagcttcctgtccagcgtggatattattaaaattgacataggatgtgtgtgcaaggtaatatcccctttcgtaggcacttctctaaatttcaggatattctgtagagtggattagattatacagtgagtggggattcagaaaggagaatagaactgtgtattgatgccttcagaaatattatttgatggcaataaaatattccccgaaattcccttcagagggaagaaaatggagtttgtttgcagtaattgcattttctagcatttgctcttacactttccaatataagccaattggaacccatgatttggttttgcttattgacaaaagtaccatgtaaattgatctgtgatgcatttaaagaagatgctttgaaagtttggaaattgagatggctttttcttattagattttgagagtattagggttcatttctatattttagtctaatgtaatattagccaaatatgttctttttcaatttagttttaatcaagttctggaagaccattttcatttagccccagtggcgctgttaacgcagagattttatttccactgtcaaccctccattctggtttctgcagccctgccccgcagaattcctgcattcggaaatcctgcatcatctgcccaaatgttatttcagcatgcaaaaatgacagtagttattacaaaaagatttttaaaattcttatttgcaggcttaaggaggggaggaatttaaaaagcctctaaaatggttatttcttttaaaagatatggcctttatgccttatgttatttttatttaatttgatcatcaccatacttaatggtttaaaatgcaaacacacaggatttgcatttgttcctctagttattcagtagaataattgccacttattttataattattgctggaaggaacacctttttctcagttgctttttaaaggctttgtgggggaaaaataaacatatcattcttcatctcatcagagactttgtcagccaacactactagtttattaaagatatttattaaatactcttttaaagaggtagaacataggagatgggctccttattctgatctaagttacactgcaaaacagaagacaggataaaaataacagtaataggccaggcacgatggctcatgcctgtaatcccagcactttgggaggctgaggcgggctgaggggatcagctgaggtcaggagtttgaaaccagcctggccaacattgcgaaaccctgtctctactaaaaatataaaaaattagccgggggtggtggtgggcacatgtagtcccagctacttgggaggctgagatatgagaatcccttgaaccctggaggcggaggttgcagtgaactgaaatcgcgccactgcactctcacccgggtgacagagtgagactccatttcaaaaattaataataataataataacaataataattatcatcctttatgtggcaggtattgtatttggtcctttcctgctctcacttattccccatacccacttcataaggtagattgtacaattattctttttcttttttcctgatgagtattgtgaagctaaaattatgtgtttggagtctgagtttaacaggtaataagtgacagaagcaggaacttgatccgaaatctgtctgactccaaagtccacactctttcctttatgccacatattcctgtaagttcaggttgtataaacatgcacacaactgatccagatgaaacctgacaatgtctttaccaatttttcttgtgattatctggtggaaccttgatttggatgcggttttctaatgcttgaggaagtagattgaagggtctttagaagctagtctgattgttcagatcgaatttgttgtataaatctttctttataagccaagaccctcatttgtaaaggaaagtttggataaaataaacagtggaagagtctaccttatgattcttttgtccagccagatggcaatactggaatataattggagttgcatttaggtggacggttaccactagggattcccatttagaacatgccatgttgatttgggtggcaacttagagatactcggttgggaagcaaggaggatagtgtcattcatttctactaccttgtggttgtcttaaaaatatatataagcgtgaatgagtatgtgcgagtgtgtacgtgtgtgtgtttaggtcacaaaaagttgtgttggaataaggccatggttgaggcaagaatgcttacaaataaggagttgctgagcagcaataaaatctctgggcagttttcgtggtctaaaaattgtggatattaatggcctgcttccccatcatttgcacttgtcagttgttacctgccatcagtgcaatgcagtagtgactactgtaagggatggggagtggacttttgtcttctttgtgtggactaaggtttatcacatctcctggtgccttgggattctctttatggaggaggctgaagcggaggagggagcatttccgctgtggtgtcttacactggtgctcattcctgcagtggaccaccgggctttcactccgcatcccctgccttctcctgggtttctggctcagccctgacattattgtaatatagttttctgtgtttaatatttcttagacctggtttcccattgcaagcatggaagaaaccctaatgcatgagtttcagaggagaaggtagcagtctgaacctgctgtgtggctccatcagcaagtgtgagtattaacgttagagctgtcaggacttgtgaaaattaatggagcctgacgggggacagactgaggtcagagacagagcttgccctgactgaatgtttctggtggttttgtagctgagtcaagtgagtgcaaactgtggagccaagggggatttctggagtatgcagtgggtaccaactaagtgctaagcattcttctaggtgccaggggtacagcagcaaaaagttggctctgcctcctcatagcttatagaaccccctccccacctccaggctggactcaggccttctctgctatcagcccccagtaattgccaaggaaggaatttagatgaaatgtctccttagcccatcctgagcctcatagttcttccatgctcctagcagttggtattacttttttcctttcatcttcctgcagaattttctgcttggccagttttcaagcccaggttattcttattcattcctcagtgaaatagagaggcttcaaaagttttaacattttccctgttcctgctggagttacaatattaaacatataataataattttaaataggaaaaatttcctccttctgtgtgccttgggtgaaacaaagtaactttatatcactggcattagggaacagggttttaaaacaggcatctggcactgccccattgcaggcaggtttcagaaatgtgatcaaattgttgtatatctcttatttagaaacagtcctgtgataacaggtctgactatatatttgtttgattcttttaaatcccaacaagttagcttttttttctagcacattaccaagggaaagtgagcctgaaggctgtgccttgtgaatttgattttcctgggcacctgggagccatagcaagttcttcttctgtcctgtcatctctgttgtttttcctcctgctatagaatgagctttactgactgtgagtgctatgccccagacatttttggtttccttatatattttaaaaatctataatatgggagaatagaggggagagggcatagggattggcagtcttaaaatatgtcagctttatggaactaggttttcttttatacaggaaaatgacaagccatgtttgcttttggaggctctctttcacaaagaactactgctgaatgctggggtttttctcttggttttagcaggagtaaataggagatagtaatcaattagccttgctgaccagatctctgattttaaaaaaaagggtgtggagaaaggatatttggtgttaaccacgacctgatgattgtgatcgaccctgttttccatattccctgttcatggggaatgaagagtatgaggcaagagttgtcttctgaaagttggcaggctgtattagtctgttctcatgctgttactaaagatatacctgagactgggtaatttataaaggagagaggtttaattgactcatagttcagcaaggctgggtaggccttaggaaacttataatcatggcggaaggggaagcctacacgtctttcttcacatggcggcagcaagcagaagtgctgagcaaaaggaggtaaagccccttataaaaccatcaaatctcgtgagaacttactatcatgagaccagcatgaggataaccaccctcatgattcaattacctcccaccagatccttcccacaacacgtggggataacaggagctacaattcaagatgagatttggatggggacacagccaaaccatatcacaggcagattcctgggaaaagtaaatgttctggaattgaccttggattttggtttgacctaaacttgaattttctagaggaattcattctataatgatttatagcagaaaacctgattgcagttgtttgatacttatttttgaggaacattaacttgtattgagggagaggggcaagctagagaggagatcacgtttggccagagcagtgcttatatatgtttattttaaaatgctgatgcacatgtgcccccagtcccctcattgttctctattatcttccacctagttcagctcaattcacattgtttctttacctccctagtccatgtaggtgtttgaatttattacctcagacctccattttcctatcaaaatctcatcctcataattgtagcaacaagtttttagattctgggacctcacataaagttggccttctcttcactgggtaggctcccacattctcctgggagcctgtagataagaaattgtaccaacagctgcagtagcattcggggaatgttttaattaagccaggatgtgttttaattgttacagcatgaggctgacactgctttatttcccatacaggagaagtctgtgatatagccagagaagcatctagaatggagagttctgtttcgtgggtacaaactaaaagggccataaatgcttaatattagataaaaggttactatagatggataatggcatgaggaggattcatgtatgagtaggccttaagtcaaactttatcaagttgtcacatatgtggggtcatctgaaaactactggtctgggagccaaagagctagattctggccccacttgtggcctgtgactgcacttagtaagtggcagcacctctctggcactcagtttcttcatccataaaatggaattgcatgaatcagtggtttcctcttaatttttttaagccagggttaactttcttagaatgatgaaatctttccccagatggtaaaatcaaggaaagcatagctgctctggtgaacctcagagaaggtcgttcccctctgcccttctccatccctggggaggcttcacggagcacagcttcaaaccactagattgtcttggaggacccttaggggttcatgtgttgtgattcatcagagccattataagtggcatgttaaatgtccagagttttataagggagttatgctgactttgacataagttgctatgtgtttgttttaacattgttatagagttcatcagacatgtgcatagctggagatcttaaacttttcatctattccttgctgcatgctcatagaagaataaccccacctgattctaagaagaaattctggatattctgcatgagtagtcactcttgagagaaacagtctggatgctatctattacaggttatactaatcattcatgaatgagaggccactcggcacattttttggtatttgataaatactggaagacagagatatctggatgagagaaggaggcaaaaagttgtgtgttaagggaatacattgtgcgaggttaggattatctcaacagaggtgctgtgtttgcattgtgtgcaggttggagacctcatagccgcactgaccttcacttttagatccaaatgcttattggccctaataatacttttgttagtttgaaagacatgttggaacatgccagtttctgccatgagaaaaatcaaaatgttctttttcgtcttcagatgctttgctttgagagtagtgacattgtgcctggcatcagggagtggtccaatttgtggataaaccaatgatttattgatggcgattgggaaagatggtcatgacaataacataacaacacagctaatgtctgttgagtgaatatagagtgtcagaaactgtgcaggttgtttatatgcaggatgttgtttaatcctcaccatactttagaagcagtattttatttttaccctatttatatctgagaaaactgtagtttaaaaagagttggagattagtcggctagactggatgttggggagaaggaacaggacacttcatgcgggcttaaagttggaagaaaatgtgacattggcttaaaccttaccatagcccaagatgacaacccgagttcctggaattctatggaagttaccaggaagtcttgtggaggttcattcgttccttcacttactcaacaaatctgagttgtgtgtctgccattttgaagatacgggactaggtactttgggtcaataaggaacaacaagccatgatccatgtcttcaagtctatggggatacaagtcacatgcaaaagcaaaactcaaaaatggagtaataatagtgaacgtgcactgatggtttactctgcaccatgcatgtgctttagaggctaaatttcattttatctttgccaaaactcatgaggtaggtgttattatccccattttgctagcacactttagagaacataaggaatctccaaggtcatacagctaacatgtagcagagactacagagtccccattcttatccccatgctgcgtccacagtttaaattgtaatagttttaaaatcgaatcattaggaatagaaatgtgagaagcacagtaagaaactattacatactgcccatagaagtaaagatgaataaggagagtgtcatggaataagcatgcagatgagataggatgcaaaggaagctgaggaagaagagagaggagaggaaatatcagagagggaggaggagaacttggagagtgccacagcagtaatcaagggaatggatcacaccactgtagtgtgatcaacagaggtcagaattcaaataaagccatggctttggccattaggaggttattagtcacattccagggacgcttttggaaggagagtagaagcagaagccagattgcattgagtaatttttgagtaaccatttggctgtacattgttaaatctattaatatagtggcccatcaggcagaacaaatgtggtaagtgggctgtatgagaagaaatcagagaggggagatctcttggcagactggaggtcagttttgcctgatcttttgatttcccacaagaagctggaagtgcagaaacttttgggtgatatttcctgagttctagatgttagttcattacaaaaacaaaacaaaacaaaaaacaaacaaacaaataataacctcagttgagggctaagcatgacacatctgagggctgaattggtcccaccagcagcaagcttatggaatcctcttttaagaagtttagaagtgaaatgaggaagcatctcaaagaagcaaaaaagtcaaggaatgtttacgatcatgtttgaggcacgtatgtgtgtgtgtatgtgtcaagggttgtttgtttttgttttcttggagtgggtaaatataaactcaccaaggaggaggattcaatgtatagagagaggcccaaaatatcaaagagaggagatgcctggaaaaggaaggtgcttatgggagtgggaggaatcagattaagaggccaatttgcaaattgaacatccctactatgagaatccaaaatccaaagtgttccaaaatctgaaacattttgagcactgacatgacactcagtgaaaatgttcattggagcatttcagattttggattttgggatttggaatgttcaatcagtgtaacacaaatattccaaaatctgaaaaaatccaaaatcctaaatgattctggtcacaagcatttcagataaaggatgctcaacctctgttagaaagataagaagatgcaaacagatggtgtgatgggaaagtgaaaaggcagaagtgaagagaacctccctccttctgtacacatgtggttagagggtattttgcatgtctggagaggggctcagttggagcctgggagctagagaggaacctggacaaattttgtgatggctgctttggggaggtagtggctggagtgtggggcacttagaacgtcaagtagcagcgaggaccctgttgactttcagttcatgagtatctacttatgtgacaccactaagtgcagaagatacagaatagataaaactcaaataactgcctcttttatggtctcacttacattctgtagctctaacctgaactgatgagcaagttttccacatctcattaattcacttcctaccattgtcactttattgtccctgtaagttacctctactatttgctcagtaattttcttgaaattacctcttattttacatataaagatagaaaaaaggaagctatatatcattacttatacttttatattgtatttgtccaaacaatgcattcttaaaagtagttttaaaatacaaaactatttgacattttgtcaaaggttcctttccatttcacctaaaataatcttgtgtaccattagtagaacatagaccatgccttgggaacgatgaaactggttggttggtagcgttctttttttttttttttttgagacaagttttgctcttgtcacccaggctggagtacagtggttcaatctcggctcacagcaacctgcacctccggggttcaagcaattctcctgctaccacacccggctaatttttgtatttttagtagagatagggttttatcacattggccaggctggtctcaaactcctgacctcaggtgatctgcctgtcttgacctcccaaagtgctgggattccgggtgtgagccaccgtgcccggctggtagagttctttgggtcattcagagcaaggattttttttccatgttagagtatatatatggccttggttttttttatacaagcaggtcagcttagctggcatgatctgaataaaatggaaaaaggcaggcacctctttgcctgacaattttaaagtgttgctatttgaataccaagaagtttgaagcttgactgcagggccttcccaattaatctagtctggaaaaaaaaaaacaacgaaaatgccatcaagtaacaggagatttgtcagctgccctgtttacacttttcatataaaacataaaggttggcagattatagatgaaaggtcagttcagcaaaaaagaaaatatgtcagacaatctcataacatcggtaacagaggatagaagttggaagctactactggattctcggaaaaagatgagtttgttggtgatgtgtaaatatcatcaccttttttgtggctcttcattttggtggctacctttttatgctgagtctccaaaatttgatttaaaagacaccaaagatgcttgtctttctgagaaagatttactttgcagcagttttactaaaaagaaagaaagaaagaaagaaaggaaaaacccagtctgaagggggaaaatatacttcctttgccatagtggctagtctcacccacgctgtccctgaacccgagccctaaaacgaggataaattgagaaacccaggcttcctgcaagagcggtggcacataatgaaagggtttacagtgagtcccatcatcgtgaatgattaaaggggaactgggcaactacagtgtgacttgtacaggtaaaatcttctgctctaagaatcacacagtaaggaccggccttggaagacattgctgtctgggaaaacgttttagcctgttccggctttgggagcacaggtgaattggggcggggagcactattagactcatagggtcacagagccatgatattagagttgtagggcctctcacaaatttccagcatgtgcagtactgggaatttgtggccctattgatatatctttcatctgcacttgaagttctggaattgtgcaagataccaccattctatccaaacaacttgctatgtacatcatactcttaattaccaaattcgcataaacatgcatttgagggaggcttcctattcttttttgaactcttcagcatagccttacaaataactgaggccaaagacgtgacatacagcactgtgggctagtagtcaaagatatccattgctgcttggcctcagcgtttctggtttcctctctctgcagtgttattttctatcagactgctttcatctctctcttaagcctccccattattgcccttgctatatatgcaattttattattgtcagaaatctaacaattaataactaaagaaaaggcagtaatatacaaaacatggtttggcagtcttaaaaactgcttcaatattagcaaatatgtttgtgatgtgctgctgagactgtgtggacttcacaatgtaatctttacagtttgaattgctgaaatccaagtggactgacgatggaacttgctcccctcacctccccccacccccccgcccacaaaattctcttccccactaagtttccttaatgaaatcattgagactctggcttgctggtaaggaccagttcttacaacaagtgtatccaatttcctgctagtggtaactttaattcttcctggaatagcaggaaacattaatttcacatcagacccataggtctcagaaagctggaattataggtgccattgtcccactctttttttcctccaaaataaaataaaataaaaagcagcagatgaacagtgaggcttgagggatgggtagtgacagagtaaggaaaagaacattaatttcaggtggggacagctgcccggcactatctccctttggattttcgttcttatagcatcacggtgagttattaatatgtatgacccgtactttattcaaacattataaatctatgcagaagtctggtgtttgggttttcctttatagctttcattcttcttcccagaattatctcattttgatcaggaaacttttgcataaaaagcacacactgagaactcacatttccataccataaatattaaaagagggttaaactttacagtttcttctcccatcccaataggaggaaagttagccttctaatcagggggcccttactaatgttctttttattcacaacccaaaaaggaaacttaaaattagagttgaaatatgaaattatactatctggttcctttaatgtatgtcaattatggaatgtttgactatgccatgtctttagtatgaagcatatactaaaaatctagtagttatctaagttgttaagaatagttggttagattatgttttgaggaccaaactaggtacagaccttctcttaaggatcgtgattaaagagctttttactggataaatataaagtgtggattcattaccctgtggattcatcacaatgaatacatagcatacagaagagggaaatggaactagaaaacttaatgtctttttagcaacgttttagctacttagcagcttcctatttcccgttattgtcatttttgttagcataaagtagtagtcataaattccagttcacatggaaatgtaaaggaatttgcgagctatttcatttgggtgagctgtctgctaatcacacagtctcggctgttgtactttgtgatgggaaatgaacgtgctaattggtgctcttttttcttatttcaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggtaagtgatgattcaaacagttttccacattgctttttagctcagtaccaagaaaacacagctcagatttagatgctttaaatgaaaatgattaggatgaaaggaaaccttattgctgtatttccaacaaaatacatactgtactgctgcaaaatgcaacacttgttgttttcattgtgatagagatccctttaggcaagatcaataggagttaaagctttcctagatatatacagtcatgcctccctcagtgtccatggggtattggtccaggacctcccactgataaaattccatcatgctcaagtcttttatataaaatggtgtagtatttgcatataacctatgcacatcctcgtgaagactttaaatcatctctagattacttataatacataatacaatgtaaatatgatataaatcattgttatgttttatggtttaaggattaatgacaaaaaatatccaacatagaggcaatcctttttccaatattttcttttcttttcttctcttttctttctttctttctttctttttttttttttttttttttttgaggtggagtatctctctgttgcccaggctggaatgcagtggtgtgatctcagctcactgcaacctccgcctcccgggttcgagcaattctcctgcctcagcctccaaagtacctgggattacaggcacatgccactgtacccggctaattttcatatttttagtagagacggggtttcaccatgttggccaggctggtcttgaactcctgacctcaggtgattggcccgccttggcctcccaaagtgctgggattacaggtataagccaccgctcctggccctttttctaatattttctatccttggttggttaaatccctggatgcggaacctctgattatggagggctggctgtatatgtttatgttactggggctgggtgtatgtctgtgtgacacagaaggatttgagaggaggtcaccatgctacccttcacatagattcagctgctctgaacattccatcagccttaggtaactcatttccctctcattttgtactggaagcagtcataaaatatcttgcttagattagggtttctcaaacctccctacacatcagaattaccgtctctgtagaaatatagattttgaagcccttcctccagagactctgattgtccttcctgagatgaagcccagcagtttgtattttttaaagttacctgggcaagactgatgcacaggtggtttgaaagttactggttgagagctggcactagaattctcagaactaagctctggaaaacttgaaacaggtacatgtatccttggaggccagacaagaagcgtgtcaatcttgattgtatcagttgacagttgtcaggttttaaaggagttacttcacagtgtctgagcctcagttttcacatctctaagatggtgaagatgatacctattttagagggttatgataaggataaaataggtaaagtttgcagtggactgaagagaatatcggatagtttgcttagggtatgaattataatttttctggccttgggctctcccactaagtatttatgtgaacttaggcaagtcatttaggccctagagccagtttttttttttatctttaaaatgagaatgttagactaaatgattgtcaatatcagcaggttctaggacttttttttttttgagggtgtatatagagcaaaactaacctgtgtgtgtgtatgtagagcagaagaactcacctttactcacttaatacagaaaagtaccccagtccttcactaggagttgtggataggactggaaaaagacaagcagactgaattcagattggtcactttactcaacagtttggcttgtcctctgtaagttaaaaggttgagatattttctttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgcgagatattttctataattttttttctagctttacgagttggtatccagaaggactggtgagtgggtacaggaagtacatatctgtttaaaatcaaccccgacaatgattttgaactcttaattaagtacttcctatatgccaggcattgtcctacattttttgtatacgtgtcatctcatttaatcctcaaaatacctttaggagatgggcactattatgattctcatttggcagataagaaaatccaggtgcagaaaagttaagtaattgctcaagaatcgccacagataataagaggtctgatttgaacctgacaagtctgattccagggtgtacagcatgactgaggggtggcaggggttgggatgtggtaattggtggttataatcctcagatccagtttatacctagctttatttagtaaggtacgtcaatttatttttttaatgtgtgagaacgtggtaaagggcaagagaataaacagcagaaatcagtcctgtcaaactgtaatctggggtcatgtaggatgttgatattagcatttctgggtaaagggcaggagacagagcatttccagcttcacagcccagttcttaatgtcagtacagtagttgaggaatgacctctgattggcagaggtgctctacatgcaagttaagatcattgtttaaaaataatttaagattacttttgaaaaaatccttaaaaggcacaggacatttaaggctattcctgagcaagcagatgttcagaaatccctggactgatagttgctgaaatgatgacagcaacaaacttcctccattatctgagctgattcaaatctgtttaggacagggttcagctaaactagattgtagctgtgatgaatgagggaatgattttggtcctcaggcagatcttgcagcatctcaagcaatcgaacaaacagactaattcagatatgtgatgtggcagggcatgatctgtttttggtggtgctgcaaactgcagacaaagtttatatctgaactggattgatatcatttaaaatgttttaattttaatactggcaaggtagcaaagtcaagaaaataagcactaatcagtcttctgaaatgttctcctaaaggtgtccttagacttaagtctgttgagatttccacaaagcttcaaccatttcctattgagcatctctttacaatgagggagatctttaaatgatttttgccccatccattggaattgttgatactttgtattttgaccaagaatacagaggttgacaaaaatgatatttcagtttcatcatctgtttttgggaggcatcagtagtttggatctcactgtgaagatatttcatcaaaattaatattcccagagctactgataatctgaacatcgatttagaaatgtctgcattagcatttctgtgctagggaggagagtatttgccatctttaccacttgctcagtgggaccttgggtgagtttcttaacatctgcctgcctctgtttcatctctaaaatgggagaaaacattacggtttcatggttgttatgaagatagaattaatgcatccacagtgcatagaagactttttagcatggagtaagcatttgataaatgttagctattactactaatagtgatgtgttaatgtttccaaactactttatacctctgtcaaccttcataaggagactatgggactaggagtgagattagataagttttagccctagttcaccttctgcccattgggtgacactaggcaagtcccttaacttcttcatttagttgtaaaacatgaggaatgaggtctgcccttgtttctctcatatgccacccacttaaatggtcatcaaagttagaattttcaaaaacaatacatatttgtgagcatgcttgaattcctttaatgtcttgtacaatttttaacctcttttattattaagaagcaacgtttgggagaacttataccataggtaccacttttctcccctcggaaattagattttttccatctctgagatttacacataggtgagtccctgcttagtaacccaacagatatttcaacccaaaataatgtaaattgattgtttgatttccctgttttcacagtgacttttttggaggaagtattaagttctgcattgctgataccgctagtggttttaaaaatagaaatcaaaataagaaccctgatattaaggattcacaggtttctcaaaagtaatcgccatcagactaggaaaatagctataattcatgtatttagaagatatggattgtggcttggtctagctacagaaaaagaatattagtctgtatttgttacatgttgataacttgcaacacagctgaaagctacctcaagactagggagaattaaagtagtgttttctaatttacagtttaacaggaattggtatgtagaaaataacttacaacacaccagagcatttatatatgtttgcaaccgtaatgttctgtagtacttactagatccccaaggaagaggctttgaatgtggtttgataggtctgggaaaatccagtggcctaaactgaagatgttataagtgggatgccaggtctggaaggaaaggggctccctcaaatgggaaggcaatagttgatgaattctttaggggcacccttacctcaggaggccttaaggcaggttttatggcatctgtatgtattccttcaccatctcattcttccaagaatctggaagaaaggcatcaggcatctttttaacagttcagccacagatttgcttcacttctcctattgttgtttttttctcattcttttttgggagtgcagaagaagaaggttttttgttgtcaggcaggtgggtcagcctcatacatacttcgtaccatgggagagcttgtggattgcttgcatacctaaaattgattctctgccaccagtggtgcccaattttgtctttgtgactcactctcagctctgtaacatctttctcaaaggctgagtatggttagaaagggaacaaaattctaatctgtcaaatactagcccctgtggtaactaatggcatgtctggctgggtagaggtaaggtagagttttgaaatcatctttgtatttttgattactgaatctgtagccagctttttaacacaagcaatttggggtaaacttactcgtgggactaggctcttcttttgctgttttgatactaagatactgtgcagaaaaaaaaaaaatccacatactaattgatcagcagccaagctgcagaaagtgaaaggtctatattgcaccgactggagcagagcagttgtattgttcagcgaaagcctgcaccttgttcttctcttgaacagaaatacagagctggtctcccgtggcttttaatgaatatgagtggggctttccaatgtccaggaatttgatctctaggctgaccaaagggtcaggaacaaagaacacattttttcacgttagagtggacccaggtgtaatttgtcagatttagtaactgtggaggaagtgccttaacttctccagcaggaaaattagatcaggcctaggcagtgcaattctaaaatggctgaaataggaagagaaagtctgttgagttgcattttcaaaggaagtgtgagcaggatttgttttcccttcctctcttcccctcatttcctatcataaccatgttgaattcattcattcatttagatgtaattttctcagcatttttcaaagtgggagttgatttcactctctgcagcatttctaattgtgtttgcacacaaatagctacaaggttgctcacatttcccttgttctgatcagtgcaatagtactttatgtttactctgtcaggaaagcgtcagatgtttttatttccaattataagttttgtaatgcatcatgtattttgctgacagtcttcaagttcttgaaatagtgaacaaattaacagcagatattgagtgagaggattagaaaaccaactggcaactcatatgatagaattcagatacagggatgggtggaatgggctcatttattttattttctcagtcatactttgtaattaacttaggcaaaaaaaaaaaaggagaagaagaagaagaaaaaagaaaagaaagaaacagctccttgttcagcagaaaaatcctttggcactaaagaatgagactatgcaaacaatattggttctgtacgacgttttcagggatttcagcttttattcaggagggttcagaaaggtgttggcacagaaaaaggtcttgtgtgtgtgtgtgtgtgttaaacaaatatgcactctgctcttacatgattctgtttaaaggcccagggtaacatttcatttttcttggcacagggcccatagactctcccattatgaaacctatggctgttctgccctagtctagagttacagggctctgtttacatttttgcctgtttcagaatgcagctgactgctcttaaagcccggatcagattcacttctggtttaacaactgccctgtttatttgaaaaaggagaaagcaaaaccgatcactttgcttcctacctcgccattgatgaccaaatcagtaaataccatttccaaagccagtttatgcagaactggtcatgtgggatctcactcgtccctttctgccagctctgtccaattcagccttcaaagcctgccgggtgcctttatctgatgtgttggtggtggttgtatggaagaatgtggaggtgctaaagaagtatttgtctgcattcaattatgcttcatagcaaccgttggcataatttatatttttgcctgcacattctgagagagccatttggcaaacaacaataataaatttacatttggatggtgtatttcactcagagaactttcatatgtattatctcatttggggctcacaacaattctttaaccagggtatgtattactaataataattaacaatagccagcatttacagtgtttatatgtcaactgctgttcattattgcctccttttgacagagaccaacatagagagtttttgacagagaaagtgacttgcccaaagctacagacttaatttgagggcaaaataggactagaatccaggcttcctttgcggagtttgctagactaaaccaggatatcctagatgtctgtctactccgtggcctgagcaactcaggaagtagctgcttttcatcttagaagacctggacgttttcatctagttgcaaaaagggtgtacagaaatccaggccagcacccttcaggggctctcaggattaagtggtgaggtgtgcttctaggggaaaataggatcattgagggaagagaaaaaacaagtgactcagacactagggtttaaaaagaaaaattggccaggtgcagtgacttgtgcatgtaatcccaacactttgggaggttgaggttggaggatcacttgagctcaggagtttgagaccagacagggcaacatagtgaggccccatctctacaaaattaaaaaattagccaggcgtggtatgtgcttgtagtcccagctacttgggaggttgaggcaggaggattgctgagtctgggaggtcgatgttgcaatgagccgtgagcacacccctgcactcagcctgggtgacagagggaaaccctgtctctcacacacacagatttatgtcttaatgtgttataaggcatgagtcagctcctgctgttcctgcaccacagaggcaacttcctccacaacacatatcaggaggcaagtataggttgcatgtggctttttccctctgaagaaccatgcagtggagagagacagcagccctgggcatatgcaccaagagggaagtgctggcagtgtacttcggctgcagtcagacctgccatgggcccacactgtgctccacagaagacctggacctccactttgggacatggctggctggctgctgggtgttctttcattttctcctattacactaataggctccttttaatccagagttgctgctggtggatagaaagagagtataaagtgattacaagctccatcagagcaaggacctgtactttgtcctctatgcataccctaggcaagctcagtgcctggcacatagtagatgcttggtccctgtcttctgaacgaatgaatgagtgaatcagggtggtggtggtagagatatgtctctggctggtgaactgagaatttacacagattagacacccagtgacaaaaggaaagaaagtatttccaatacaagatcaggcacagtcatggacatacaaaacggaaagactagagatgatagagcaaaatggaaccaagcaaagccctaaatgatgtccatgggctttaataacatgtgttaacaaggtacatgtacctagattcttcctgaacactcagaaatctagcatctcttcaggtgagcatcgttcaataaaagtgagaaatgggagtaggacaaatcttacattaaacctcacagtacggcagtgagagttttcaaagaaagcctccaccagcaattttaggctttttggtatcatttcttcagctcagacaccttattcccgtactgtgagcagctctagaaatcactcttagttacagagaccgtcgcttcaaggctgcagtcaaagtagttggtgtcaagtttgagattggtcggaagctagaccaggtgggccctcagaacgtcctatggacattaaaaccaattgtcaaatatacagtattcccttttctcagtggctgaattctcagtgattgagttcttagcgtcgtgtagattctgtaccagttatattcaggctacttgacaaacactgattacttattttgtactctgaactgtaagtgaagagtgaacttctccaggtcttgccagacagtgagcccactagagtcccattgacagtcttaacctgtatttatttggttccagccttagctgcttctgtcttcctgtgatgcatttctcctctgtggctcagatgtgttcacaagttagtttaggtaaccacactggatactttcatccttctcctaatctctgatgaaggtgagatgggttttggagcacacatatatttggagagatgaggttgctccttccactgggtgctcctcttttgccagcaccacatctgcagagccgcaggacatccttccgccccttctgatgagcctgcatgctgccaaagttgtttcacaataaagccttaataatcagagccatgttgtgttatgtgcttcatacaggagaagccccctgccttctaggctgttttgtgagagcaatgtcaaggcatgatgtcacccaccctctcaagggttcatctataagcccatgggaggcttggtcgggcttgtagagccaccatgtgcctagggacatcccctctgatggcgaaggctttgttgaaactgttctccaaaaaaattattgctaattctctcttcccttaaacaagcagttccttaggctacaaaacttctggcagggcctccccagcaggaaggcatgtgctccccacattgggcatagctcaaacatctacaactctgttttacttacagaaggagggaggcagtggtatagagctccgcggggtttggccttagaaacaggctgttcccaataagcttggctctcactttgattatttagaacttatttaccttgttacacatgttatgtgtaacatgtgtaaatgttacacatgttatttaccttgttacacatgttatgcaatctctctgaaccagtttcatctgtcaaatgtgtatataagtaataataataactactatttattgagcatcattcacatacaggtaccagacgtaaaattgttttaaagcctcaaagcaaccctataaaggagataaatattaccctcatttgggagatgagaaaattaaaggttagagaagttaaataattcactcaaggacacttattttgcaaagaactgtaaatcagtcccaaatcggtttgcttccaaagcctttatgttcttcactacttctgtatatttttcatgggattaaaataagatcatgtatgttaagttcctggcactcggtgaatgctcaattaatattatttttttccccgaaaggtaacagttgttagttttgtaatggctattattttttggttttgttttgtttgcttcgtttctatggtggtattaccatggtagaagagaagaagcaaaaaagagtagaaatgagataaataggaaacttagtctaggaaaatgcttacccctgtttgtgtattggtgggggaagggggataaaggaagagagaaactgtttaaagtgaatattgtacagtttctttgcatggcaggttgcttatgatctggatacgtagaaaccatttaagaaaggaaccccatattccgctgcatttggtcaaaaggcatggaagagtggatagacgtctgttaaatgaagacatatgggcattttgaaggtcacttatatggagtatcattttcagtgtatgagtaatgttggcagtgtgtttccacccaggaaaaataaaagtaatcttggatggtgactataaattaaatgtggactgttccatgagggctgctccaacaccaagtgagtgtcaaactttgaagtttctgggtttagcagaatgcatatgcattctgcaaagagctgcaaaggtgagctacaaatctgcattaattcaggagaggatatgggaagactgttttgcttaaatataaaaaatcagcttggttaaagtgtaaatacagttactataactaataatgtccaagtataaaatttgtagcaagaaaagaaataaacaggcaatgagaagtacctggtatagaagggcatactagaagaagtggttaagacctagcttaaataatagtcttcctaggatgaaatttcctaagacagcatctgaaggtgccagtgatatttaatgattaatttagatattttcaggcccaatgtcttggtgtggtgggtttacaggatggatcacattaaataaaaaatggtgctaaaatttcatgtaaatcaacattgaagactaagtgaaaccaatgctatatttgtaaaggaaagaaaaagaagagcagagtcaacatattgatttttcattctttcctaaacttggtaatgaacttcttttatacattatgtacaaaatgattgcatatagaactacgtgcctctgatggctgcctggtttaataaactgtgattattgtttttctctctacatttcaagctaccatatgtactgaatttctgggatatatcaatctcaaagctaaacctaataggatatactgactttccatgccacacaaggcttcatgagccatgggaagtagctttggagcgccatggttctagaaagaggattgtcaaagacagacactcaggaaaaaaaaatgttttattgtcttaatgatttaaaagttcaactcttaaatcactagccataattcaggcctcttattgagtcagtcatcagtagaaaaacctttcttgctttgatctttgaagaacaaaataaaagatgctagactaaaacctaatcagaaattattgatggcaaaactaactagttggaataggctattggcagaagtctctctcccacttttcttcttttcctttggtgttatgatttaaggggaaaaattatggaagacaagtttgttttaaaaactcatagggttcatttgtgggttttgcatttgtatatatatatttttaaataataataagaaagcacttgagaatgaggattttagcctatgctgatgctactgcttctgttgctaaacattacttaatgcttcctgtttttcagaagaaatagccaagactagttccttttcttatccacattcagccatttcccttaaaaagataagttctgaaaaaagtacttacctgttgggcagtagaataagtagaaaaatggaaaacccaaatgtgtgtgtacaatgctgggtctgacctttatgcttttaaataattcttactggaggcaaattctgtgtggttgccggctttcatagcagcttcagaggcaggcccatgagagacgagcgaattttcagggtattgagtgccttgctacattcacactgtatgtgccgttcaagattactattgaagggaaaatcacaaggtattggtttttaaggagggtattcgtatttaaggctatttgctgtaggaattaccttctacagagtttgaactctgttctgaaaagtctgagagaaatagaaacagttcataggaaattttgaagtttggctagcctgtaaaccacaggcttaacagtgctctaaagtcagttctgagactttgtaactcttgatacataattatgaatgcatttttgctttgttgattgttccaataaacagaatcagtggattattggttaagcagaatacaaatatgccagagaaaattcattctctttgtctcactctgaaaatattgcatcaaataatctgaacgagaccaaaaaagctttttgtctgagtttctacaagtaacagtagaaaaaacaatgaaagggaaatagttaaatatagaaaatcatcaaaaatagaaatcatgcaaaaagtagacatctcgattcttaaaaattatgtttcccaagctgtgcaaactttcctcagttaaccacatactcacatgaatgaagatttcacaattccagtaaaagcattcttacattcaccttgaatggttttgtcccttgaagaactagcatcagtcatcagacagcaatagtatgtttttcttcttatatttagcagtaagcattttaaaagccatatcctcaccaaaaatgtacagatggatcattgcattataaaaacatatactaatatagtcagaaaacaaaaactgaaagataatacaccacaagttataacagcgattttctcttatgaatgttctttttttctttctcttattctgcttttcctgggattttgtacattcttacagtgggtaagttttatttttacagtcaggaagaaaggccacattctgtagccgtaaaatgtgtgtctatgagtaattggaaattaaccctgtccttcaaacttggtgccgtcatcacgtatatgatccgggtgtgtgtgtgggttggcacatatgtacatatttcacagattatcccattcaaagatgggaaggtggaagtgtctgtcctcaacaagtactgtggtttgcctggctgaaatgcaaggaaacccccaaaagcaccagagccctgcatttattcagctgaaaaaatgtgttttcttttttaaatcagagtctcctaagatagaagaacttagatggctcatccagtgctgggttgaatgataaaacccagacctttttggtgctgcgttttgattcatccctgaatgtgacaccctggtacttgggttcctgggtctggctttacaggatgtgacttcagtcaaggaaagcctggtgcctacctttgcttatttgtattctagtgctgtaagctcccctcctctcatgtgtctttgttctattaatctgcaaaacagggctcgacttgtgattagtccttggagcttgtttctattaatcagtctgcaaaacaggtcgacttggatgcttttgttcaagagcttaatgtgttctccttgtcaggctgtggttcaggctgctcggtttgctttaaacgggaccagatggtgaaatttggtttttatacgctgattgcactgtcaagaaggaaaatactgtttgaaaagacaacaggaaaatgctagtgtggagttgtagagtgatgtttcaggaggaggaaaagtttatggaaaatataacttatgtaacctggctgtggtgtataataaactgcacggtgcagttgactggaacagaaaataaggcattattcatattatagtctagaagcatggtgtcaaggaaaggtcgcctattaataaaattttatgtggatttgaaatgtaattcttttgattcttaaagtgggaatatcattcttttagctacagtattagctactgtaagaagacccaatacaattttgtgcatttcctcactttttcctttccaccctcccttgtgccaaatgaccttgccacagattaaaattattctacctgttatgtagggaaaactctgtatctcaattttcttatcttcattatcaagggacaaaaactgacctacctgtggagatagagtgtgggctaactgagtgatagttataaattgctttgtaaaatgctcattatcaccatttaaaaaattctcctaactctaatgtgcaaaggatagcgtcactggaaaggaattgaaatgcataacttttttctagtgatagcgacactctaggaagaacacagtttttattggaagttgtcttttacatctctaaaaatttcaagtaaatttagcattcattacttgtgaaatagctgccccctccaaaaaatctgttgaagtatatgcaaggagcaaagtctcaaaactccaaattaaatttgtcatcagtgataaatttagtcctgtgagatagtttaataagtgcttcagcttgatttattggctttgttagttaacaagagtgtattatgtcttgtacagaacttagcagagcaatttctgactagaccttccttgattaaaataaaaaactgaaagtctcattttagtcacggcgatggtaattattttaacatgaaattggaaggtaagcacactgcagtcctgtcattaatatttaaaaaaaagaaagaaaagaaaatgtcagaatgtgaagggaaaggcatttaaaaggttctagttctttatgtttgtacgtactttatttcttttgtgtgtatgcagagcgtctaggctgtttcactggttggggctgaagatgcagcccttgcatatataatcactaatgagtgtcaggattcagctgctaatttgaaaggctttgtggctctttcaccccaaacacgagaagcttcattaggcgctgttttgtccagcctgacctttgctgatctctagatcacagctaaacaccaacattacaccaacaccctcccagttgaaacagtccagacatgattcctttggtgcatatcttatcagaatctgctactgacataaacttgggtgtccctgtagcttgccacataattaggattaccttcccccaaagaggccctatttacttacaattgtgttcagttgattggagatttgaatttgagagcaattagcaaatttctcagtctctctctcttttttttattttctaaaaaaggcacttttataaggcatagcttttaaaatatgttcttatggctgtttcagtgtaagcaacagacagctactaataaggtatttctctctttgacttaggaaaaatacataaaatttattattagtgatatcagattttaaaaatggaaagaaaatcaaatggtatttttttttcctttagaggtatgtctttgggagtacactatcctcagaatcaaaccttgtagcaagcaggtggaagagacttttctgcttacactattttaaatatcctgagcaatgaaacaacaggcatgatttatttgtcaagcttttggttgctggggagggaagccttacttttcagtgttattgtttgtagattctccccctactcttctcaattgctagagattattctgctttagtttaaaattttactgtatatttgatatgaagcagtagctaagtggagatatcttttgacattatatgtaattatcaaccagaaaaatgcatctttataaacttatttttcaacagatccagtcctctacgtcaggtctccggtgaccttattttgaagtggtttgaattctctttcctttttagagtcataaaattagagatgggaaagagctctctgattgcatcactttttccacccttttggccagtgtgatctccctccctccagcatattccctggtgttccattcagcctagtttaggataagaagaccagggaggcttcttgtccaggccctctgggaaaatgtcccacggcccttgacatgtggataagcttttaggcatgcaagctgaagttttctcctgctttgagactgcttcaatattcttgagttcaatgtcttttcttgttgttcctttcttctaaagcatcaagaacttttttctctgtcaaacagcctgctcatattgtgaacagcaacaaaaaacccacaacactacacacaggcatggttttcctccttcttccgttcaaaacgacaacgttatttaaggtgtttcgttgttattaaccacgtgtctaagacatgcctaaatttgaatggttcataaattttacctataaatgaatctcataaatccttagccatttcatagaccctgtgactacagcgtctcagaatcttgttggtttagagccttttcaggagtccaggaacaagatggggatactgacaacatttgtttttagatggatagaagtaaattaatcaaaatcctttgtttatgatgcattgccatcattggtctgtgcctagcctttgttatcatcatgttatttttccatttatgagtaatgtagtgaacatccattaacccacagagagcctgattactagaacattgacaataatttgtgtttatctatgtgctttctcgtttcttatctcctgccttctttttccaggtatacattaatctgaattttgtttttttcattcttttgcttatttagatgcttcttataatacacacatctaaacaatatatagttattggtttcgaacttaatacaaaagttactgtgggtttctcttttagttatggaggaataagctcctaacaaactaagtctcctgcaaataactataaataacaaataaaataactacccaagggctttggaggtgcacagaagcaagtaggtttttggaggggagttgaaacttagaggaagcaactccaataaagtttttcatttctgttggtttctggagggtagccacagtttagtaaaacggtttcatgatatggctaaaattctgacagacagcccatactcttttgggcaggagaaaccatttgaaaacgctcagagtaaccagagccaccacagagtgagggggaatcctaggggaaaaaaagagagagctaaataagagaaacaccaaattctttgtgtatattctacaaagtctctggaccctgagtcatgcatgtaggggcagattgaaagtgtctaaactgagatccgagctaccgtccaccgtagatatcaacatttaaacattcaaagaagaagtaatgaaatcttacagaaaatctttccgaaatttgaagacgaaatgcttcccaacatgttttatagccagcatgacattaataccaaaacctaacaaaaatgtgttaccaaaaaaattacagaataacatgcctcatgagcagaaactaaaatactttccggaaggttagcaaatcaaatccaacaacatatagaaaggttaatagattatgatcaatgtggatttataccaggaatacaagatgggtgtaaagtgaaaaaaaaatctatctaattcatcctattaacaggataaaagaggaaaactatgtgaccattttaatagatacagaaaaagcattcaaaaagactcaatattattcataataaaaactttcagcaaccaggagtagaaagcttcatcagtttaataaaagactacagtcctacacttaacatcacaactgatggcaaatattgaatgctttcacactaagatcagaaacaagataaggattcttggattgatactgctatttaccattgttatgaaggtcctccatggtgtaataaacacacacacacacaaaagaaataaaaggagtgaagattggagacaaagaagtaaaattgtccatttctgcagatgacagggttgtcattgtagaaaattctaaggaatttacaaaacaactgctagaagtaataagtgaataagaatgaggttatgggatgcaggattaagatacaaaaaccaattgtatgttttcataattgcagcataaaatttaaaatgaattttttaaaatgttaattacagtagcaccaaaaccttaaaatatttaggagcaaatataacaaaagatatgtagaatctcttcactgaaaaaccaaacaacattgctgaaaaaattaaagaagacctaaacaaatgaagatatattatgtttgcgaactgctcagttctccctaaattgatctgtagattcagctcaatctactgattgggtaaaaatctcagcaggcttttgggctttgaaaataaacaagctgattgtaatattttttgaaaataaaaaaagatttcgaatagtcaaagtgagtataaaaaaataaaagttgatggactgtactatctgatttcaggcttactatgaagctttgattattcaaaacaaagtaatatgaaaggtggacacatagatcaatgtcaaagaaaagtaaatccagaaacagacccatatatatacagccaaatgaatttggcacagtttcaaggcaatttaatgaggaaacagtagtcttcgataaatggtacctggacagataaatatcaatatggaaaaccgtgacctttacctcataccacatacaaaaataattacaaaacagatcttacacttaaatttttttaaaaaatgaaatctataaaacttctagaagaaaacttaatctttgcaaccttggaatgggcaaaatttcttagattcggacacaaaaaacataaacaacataaaccactgaagaaaataatgacaaaattttaaaattttcagtctttgaaagacatcattacaaaaatcaaaatgtggtccatagtcttggggaacatagtctaggggaacatattttcaacctataaatctggatattatgtaaatctctatccagaatacataaaggagtcttacaacccactaataaaaaagacaaacaccccaataaaaaatgctcagaagtttgaattgactcttcataaagggatatatccaaatggccaacaagtatatgaaaagatgttaaaaaacattagtcatggctgaaatgcaaattaaaaccatagcaagataccactgcacacacaatagaatggctaaaatttaaaaagctaacaataccaagaatgacaaatatatggatccacagatagaggcagatatgaatgtaaaatggaacaccctctttggaaaactttttggcagtttcttaaaaagtcaacccacatctactgtacaacctagccattctgctcctagatatgtactcaagacaaataaaaatgtatgtccacataaagacttgtacacaaatattcttaatagctttattcacaataaccaacaccaggaaacaacctgtacattggaatactactcagcaaataaaaggaatgaactatactaaaacatgggataacatgaatgaatttgaagatcattatattgaatgaaagacgccagacacaaaagagtacatttactgtgattccatttgtatacaattttagagaacacaaactaatttaaagtgacgaaaagatcaatggtcgcttggactggggacagagggaaagacacagactgcaaagggtatgaggaatatactgggggtgaaaaaaatgattggtatcttaattatggccttgtgtcttcgttatagtatgtatatatctgcaacattttataaagttgtacaatttgaatagatacagcttatcatacataaattttatcccaataaaatttttttgagaaggatattcggctgaatgtcatcttctggggcttatttcattaaacatttattcgatatgatttaacaaatatttgaagaatgtaagaaggaaggaagatagataaatttatatcagtcacttctgtagtgggagagaaaaaagatgaaaataaatccaagtcttcttaaacaaaacaacccaattctagatttcatatctatccatcttagatatcaaagaataacctttctagaaccatgctcaccataacttacattcaaggctattattgctttcagtattaagggaaaacttcagtttgtatcagcaacattctctaatctgtcaagttatgcagttttttgttttgttgtgcttgaaatcttggagcagcaaagcaagaggggcatattagttaaaacacttttggctgcaagtaataagacatcaactcaaaatgactcaaaacattggaaattactggcttacataacttagaagtcctcagggatgaccaacaccgagaatagcttgatccagataccaatgttattattggaattcacttcttatttcttattattggctgggtctttaagtgttggcttcatctgtagacagactcctcttgtggtggctgctggcagtttgagctttacattcagtcaagagactctcattgttttagcttgatttgcatgtttttctttggaccaatcagtgtgggaaggaggatggaatgcactgattggcaaggtatagtcatgtgctccttcccaagccaggcagggtggaccccatcggtaccacacaaattaacagtggaataggagtgagttttcaaaggaaaattggtgtgctattaccagaataaggtggtttaaatgttccacaggcaaaaatcacagttaccctctctctcaaagataaacacatgaggtaagtgacgtcactaagaggaacctcactagtggaaaaaattttaagttcctggtcctagttgtcttccaacctctttttccaaggaccatggccatctgttcatggcacaggaagctagaacactctcaaccgtggtggtggtgatgatgaattgaaaatcctggaatggtaaatgccttcttaaacttccattaagcccagcaatctgacagtgtggctgtattggttagctatagctatgtaaaaaattcaccacaaaatgcagcttcttaaataacaaacatttattatcttacagcttctgtgggtcaggaaccaaggtgcagcttagctgggtcctctagctcagtctttctcacaagacagtaatgaagatgtcgtccagaatagtggtctcatttcaaggcatgacttgggtggaatccacttccaacattactcaggtggttgttgataggaatcagttgctcacaggttgttggactgaaggcctcagtttctcatggttttctgggttttctgtttactattggccagtgcccttcctctatgccttgccatatggacctctccacagggcagctcacaacatggtaactgtcttgaatcagaaggagcagaaagatgcaggaagatggaaagcagggtcttttggtaatctaatctcagaagtaatactccatcactttggctgaactttttttttttattagaagcaagtcactaggtccagctcatatccacacccaagggaggaacaattacatatgggcatgaataccagacagggagatcgctgggaacatcttagaggctacccatcatcttagaggctgcccatcatagtggcagtggcaacagaggaaatactttgctaatatctcttgccattgaagttttctgttgagagccttaaatcatggactggatacatgaggcggacagaggcatttccagaagctaggtaggacctttggcaagatggagtttatgttcatggttactaatgcaaaccagataaaaagacaaaaccgaaactgttagagagtttgattgtgaggtacagaaatgattacagaaacaagctgagaaaataaatgcgtgacgagaggtgaaatagagatacatgccaaggcttgtatttaaagtgttcaccacagagagaatcagccaaaaaatgtccaaaaccaagggaatggtttacaaattgcagtgtgtccatacgatagaataccatgtagctgctaaagatacttttttggaacagtggcttttaaactttttttaaccacaactcacagtaagaaatctgttttacaccaaaaataagtatatataactatttgaactgaaataaaaatttcatagaggatgtttatccattgtacataatatgcactttgatatttttgattctattctacaacattttttatagtggtaaaatgtgtatattgtagaatttaccattttaaccattttaagtggcattaagtacatgtacattgttgtgcaattgtcaccactatctccagaacttttccagcttctccaactgaaactcagttctctagctcccatttccttcttacccagccccgagtaaccaccattccattttgtgtctcaatgaatatgactactctaggtaactcacataagtggaattacacatttgtccttttgtgaccagcttatttcacttagcatgatgctttcaaagttcatccatgttgtagcatgtgttagaatttcctttctttgtaaggctgaataatatttcattgtatgtatacatcacatgctgtttatccatttatttgttgatggacacttgggttgtgaaggtacttggagcaaaagtgtgaaacctctctgtgagcatcaggttgaaaatctctgttgagtcacagtatcctaaactgcaactaaggtcctcttctcccttcattttcatgcttaattattattattattattattattcgagacaggcccttgttctgttgcctaggctggagcgctatggcaccaccacggctcactgcagcctcaagcttccaggttcaagcaatcctcccacctcagacccccaagtagttgagaccacaagcatgcaccacaacctctggctggttttttagttttttgtagagatgggatcttatgttgcccaggctggtctcaaattgttagactgaaactgtcctccagccttgcccccgcaaagtgctgggattgcaggcaggagccactgcgcctagccttaccgcttaatttgagagacatattctgtagatatacccaaatgttgtgcacaaatggcgtgcactgtagctgggattgacaagaatcacgctttgactttagcaaccctgaaaaatgttttttttttgtcatttggttgcatgtggtttatagagattattctgagtctgggcattaaattgattagttgtccttcaaaaatccatgggttatggttctaagagaaaaagatagcaaatcaggacacatgtgcacccctgcatcaatggtagaaacttattcctgtgtcttctcaagtttcatttgttcattaacttaactaccatttatcgaacgcctgctcactgtaatgtcaggcacagtcctaggtgctgggaatatgggaatggacaaattaaaatactgtccccagaaaaccttattagcctcttagtaaaagagagagagaagtagatcatttaacagactgtcacaagtgctacagcaattttgtaagatgacttgggagacagacatgatgagcacccaattcagcttgggtaaggacaagcttcaggaagactgagacgaatctggaagaggatatttaaggcagaaagggcagcatgcccaatgagtagaagcaagttagaatgcaggacatgtgtggtaagatgagaaggtcataagggcctcatgtgccgggtgagagagtttggatggtatcctgtggttttggtgaaccatggaaaggttttaagcaggacaattatttggctatatttatcttttggaaagaactctagcagcaatgtggactaagatgaagggaatgggaaggaagtgagaccaggaatgttataattgtccaggaacaagatgttgaggatcttactttgaagcatcatcacgtgaggtgaacaggaaagaaagacccaagacaagcggagaagacagaattgaaaggtttagaactaatgggctgagggcaagggagaagttaagattaaatttctggcttgctggctaatattaaatgattctctagtaatctgataatgaaccactaattgagtctttttccaaggagccctattgtgagaaacgtttgatgattttctcaggatatagctgggcaccctttctaggtggcacatcctgcaagcttctttcttccattatctgtggaggtatatttatggagagaatcttagaggttaaaaattggtctatgcaggatggctagaggcagaggaggtgggaaagaagcaaggaaagaagcggccattgaaactagaacatggtactaagggttaggataaagaatgtagcaacatgagtctggaagtagaaataagccaccaggcccttagctgggaagagtgggagatttgggggatatagataaaaatagctcagggcacagatgatttagataagactgtaagtgatatgaaggcagttggcttttagaaaaagttttgtagagatataattcatgtatcgtacaaatcacccatttaaagtgtataatttagtggttcttggtatgttcagagttaggcagtcattaccacggtcaattttaggatgttttcatcacataaaaaagaaacttcataactatgagtagataatttctctaattctactaatggccatttctctgccctctaccccctgtctccagacgattactcatctcctttttgtctctatatgtttgagtattctggacacatttaaaaaaaattcctcccatctaactataatttatatattcttcaatcaacttttaagtggtgcttgctgcttattatgggggcttgtttgcttgactgaccatactgggccagtagggtaggggacaagtgaagggaggttttccaaaacctcttacattagaatcatgagctgactctccagctgtccacctcatgatggaccatcctatgtgtaccttaaaaatgaaaatgaataataaattttcataaaagaaagtgctaaaatcaaagtggataaagtgattaacatggacagataaaaaattcagtcaccaagcacttgtacaaccactcacaagttgaagttgcagcaaataatttagatattgctggtcgaatgacatgattctagctgggctgaagctactctccatggagttctctgggtaccttccatgacacagtgataatgagccataagtgctttccttgaagaattcttaagaatcagaccatgctcctttagggaaatttacttgttttatattatcagattaataagtgtagagagggaaaccatttgcctgctaatcaatgggggatatggaaggagtgatcatgataatgataatgatggtgaagatgataatgataatgataataacacattgcatttgagggcttactcctgggggaggcactctctgaagggctttacacacctctctatttagttctctacctgctccttgagtacctttaactatagaaaaggaggctaggttcaagagatattaacattatagtaatgtacttaataggagaatatacttaattggagaagtaggactgaacttggctctttctgctatgctgctgctacatctccgattctgagatttttcatctataaaaaggagtaacagtaggcatgcatccttattaggttgtttgctgctatgggaactaggtgagttaatacatgtaaactttctaggaccatgtctgtcatctagtaagtgcttaatgaatattagccattattttgtattattgttgtcattactattcaatactacttttgatattaaaaaaagatagtccatattttaagaaaaaagtagatggtaagaaaacagaaatgcacacacataaagtcagtgaaaactacacttcttttccacttccatcaaagactattaaatgtagggcctgctattgtatatttattcagacatcaatcttaatcagctcctttgctactttggcggtaagggcattgtaattctatttttatcggttccttcctgtgcaccagacattcaaaatagcatgagtaaggatcaaaaatatcttaatggatttggttcccagagatatcagtgaccaggggaagagttttgcagaaatttcttcctgaactgataaggaaggtaagtggggaaggtgtagggagggctggctatgcagcttgctgttaagtctgcatggtgtgaaaggcaaagatccagtggtggagtgaattacaagggtccctggaagaatctgggggatcagagcataaatgcctcctattttcaggtttatgattgggaccagtgttgtgtaatcattgaagataatactgacccctcatgaggtagccatggttttggtgaacagagttcctggtgtgattgtgttacacacacacacagacacaatatggaggttcctatatgattaatatttttatttgtatatcttgcctgggcatcttttctttcttttctctctcctttcttctttctgcttctctcctaattattttacctcttctcctccttttaccctctttttccccttggcctctctttcactctcccttaatgccattttatattcagactagtcatcatcaaaaagttatcaaagtttgtaaactgagattgatgggaagagaaaatgagattagaatatccagaacaactatagttcttacagcaatgcatacagtggtaggctatgccacatggtgaagtgtgacacaatcttaggtggtgcagaggtgcacatttgttctttagtaattatgtatttattgcatgcatattgaaagagagagagagagagagagagagtgtgtgtgtgtgtgtgtgtgtgtgtgtatagtatgccatatttgtgatttcatggatattcttgtttaggatgaggataaatttatttaagtaataaaagtgataccatatgtagagaaatacttagtaaatattagtacaggtggtacacagatgtagctaatgaatcatgactctagtacatgaggactgaagcttgggatacactgttgtaatacatggcatcttttacttgcatcgggggcctctggggagagctgtaggatgtggttgttggtccattccaagtgatctccaaggagcctccatgttgttttgccttggttctgccatagcatcagtaagcacatcttggagctaaggattctgaataaaaccagccccctcctacccccaacagttccacagctgcatctcttgatgaaagcccaaggcgtgagcaataactctgcaccagcaactcgagtttttaaacatttaaacatgtgtagcaggtgtgaatgttattctatgatatgcagatgcaagaaatttcacatcaatatatttgtttgtttgtttttagagtagaagtaaatctaaatctgagtcttgtctcttggagtgggaaagaattagatcgcacttgtaatgggggttcactcgaccttggctcccagcccagggcctgggggagatccaggccatttggtgggagccctctggactgtggtccacactggccactgctgatgggtcctctgttagtatccatcaggtactgggcccttaaaatcaggcaatgtctctgttttcactgacttgggcttggggatcccttcccaagctgggagtgatggcatgatttgggacatcacacagctgtgccagctgagagcttgtcactcccccactaagcctgcccccttgccaggaattccagctgagtcctcactactccagacaatccctcccttttcattctagaggaatccccctcctgcttaatcttgactgtgtctggaagcccttcaccctcacccctgtctccaaaggcactcacctggctctcctcccatatgtgttgatctagccttgtgccctcagtgacagcaaaagccagaaagtgtgggggtggggtgtttttgcaacttctgtttaaaccatcacatacaaacacccctgaggcaaaggggcacgaggtcttcttagaataagggagagaaaatcaaacacagattaatatctctatcaacaattctgtcatgtgaaggaaaaattcgaaatttttgtatatgcataaagggtatgttataatatgacacatacatacacacacgtattcaattcagaggctcagaagtgtgttcaaataggcatatgtattaagcatggtttcccgttgttaccagagttggcatggaattatagaatctaaatgttatgcttgtataggccttaacaattatctcttccaaatgcattttatccaaaaatgcagtaggtatttggggccacaaagcactgtttcagttgaatttgcaaaagcattcaaactgggagaaaataatagaatcagcccagtttctggtctaacctttggttcatttgcatcactgccccttcagtattgatgttttaaaactcaatggctaccctgatcctttgctctttgcattcagccccattcctcattgccctgctcccctctgcatcaaagggcagattgacctctgccatctagggtccagcgatccctgaagggccctttcctcaatggatccagctggacagcccaccattggaccggatgtcagggtgctcctggcctccagctgagcagcacctcttcctttcatcactccagccccatggcagggtgcagcatctttcggttgctaaatccacattcctcttctaacacttttgaaagtaatgctccaatttaatattaattcctagattgaattacctgactctatcataccttgctctcttagctgaatcctgattcaaagggggaagataagtctattaagtttcagagactaaaatttgtaggtcagaagcttagattctatatagaaatccacaggaacaaataataatacctttcatttttgtcattcaatagttatagatctattcttcttttgcaggcttaagagcaaagagtgtgcactcatggagttacattctagcaaggaacaggccaactgaaaagaaaagtaaaagaatatcaggcactgagaagtgctgtgcacaggagtaaaataggatggtattttaatatttggggaaggccttgtaattactataagcttggatgtagctttcaaagacactgaagccctatacagtcatccctcagtatatgtggaggattggttgcaggacccccatgtatactcaaatcagcacatatatacaaaaagtctgccctccatatacatgagtttcacatcctgcaaatgtattctcagtctgtgtgtggttgaaaaaaatccgtgtataagtggacccacacagttcaaacctgtgttgttcaagggtcaactgtactgtttttgctgctgcttcagattctacttaccaaaggtcacaaattagggctacatttggaatctaaatatgttgttttccatgtgcagtattttatttaaacaaagcagaaaaggctaggctgggcatggtggctcacacctgtagtcccagcactttgggaggcccacccaggtgagcggattgtttgagaccaggagttcaagaccagactatgcaacatggtgaaagcccatctctaccaaaaataaaagcaaaatttagccaggcatgatgccgtgggcctgtaatcccagctattcaggaagctgagttgggagggttgcttgagccagggaggctgatgttgcagtgagctgagatcatgccacagcattccagcctgggagacagagtgagaccctatctccaaagaaaaaaaacacacaaaaaccaaacaagtttaaaggtcttcttgtggaacatttactgtccagtgtgtggtagttcccataactatttccaattgttttatattacagcctcaccagcttaccatatctacatgaactccaaatgcagttccaatgtgaatttgagatcattttaatttgcttagcatcacttccgtttgagaacttaccatataccagatactgctgaacagttcatcttcacaacatactttgtgaagaaagtatactaactctaattttcagaccacattgcttagacctagagattacatgcctaaaactatatagctagtgagtagtagaaataggactgtttgcttactactaaagcctatctcttaactgagttgaattgaacgagcctgtgatagatatccgtggtgtcttatttgtgttagcaatgcctccccaacctgataagttccttgaagacgagttagttactcgtctaaatccccacattatcacaatagaaactaaacacaaattatgaaattataattttataaaattataaaccataaaagtgaattgattagagataaaacaacaaatcatagctttgaatattcccaggtttgtctctgaagttgatcagagattcttctgataagcaaaataacttagcaggtttctgcccaatggcacaaaacagacacatgaaatgccaactgtttatccagatgattagaaaacagccagtttgaagaagtgaaaagcctgagtttcaaagtggcttattaaaatcaagtacaacaagaaactaaaggtaaactttttgacattaccatggcaaagtgagaaagaaaggatgacatgtgtaagtaggttgtgttttcaatgtagtgttatcaatttctctttcttgggaaggatgatccctcattgtgaaattatgtccatcctactttttaggcttaaattttttaaaattgaaatgtagacgatagtcaagtggtatgtgtgtgtgtgtgtgtgtgtgtgtgtgtgtgttagtatcctttcatggtagaataaaaattaacaacttattagtacctaaacattccttgaaattttactagtccatgagatccaagtctgataacctctgcctctgataaaagatcaacttaaacaagctgatgtatttatcatatcacttacttgttaggataatatttacattgttattaaggtatcatagatatatgtcgatataactaatcaaatttatattgaacacttgctatataccagtttttagtcaaatagtttaaatgtctctttgaattttgttttttaggtattgcgtgggtaaatttcaacctagctcttccctgacctatattttctaaaattcaccattgtagggttcaaattatgtgttatttcatttaagtgtgtgtgtgtgtgtatatatatatatataaaataacagtttagacataatcccatatcagttaggatttttatgttccatgcaattttatgttaagaaaagtcaacccaaacaatcttgtacaaatgcaatctattgtctccatattttaaaacttcaaaggtagatatggctttagagattttgatgtggccttaacatgtaacccagatactgtttcttcctttacacttctgagctccatttctcacaggttggctccatcctcaggcatgctgtctccttaggctttcaaaatgatggccagccacttcgcagaactaagctgggaggaaagagcaaaatccagagactgagcctgctggctgatttggctcctatgctcatgcctgcaccaacctccagggctaaaggggtggaatgcacaaatggccttagcctgggtcacaagtgccatcttgctgggcctgaagtgcagccacttcactgtggatccccaaatggaagttggggctgttggggagaggaaatggaggaatgagtataggaaaccaactaacaaatgtccactacgagctgtttactgggggtaggaaataaacagcttgtctttgaagctcattttctttacacaattacaatcatttggtgtttattttcttcagttgttatcaggattacattgcaattgatatttcaaaattgccctgagtggatagccgagaaaaccttcgtagtgagataaatctgtacaaagacaaggtggtagagatttctcacttcttatacccctgttgtaagtttaccatttgaataaaaatggacagattcaattgcaaagtcattgaactattgctgactcttgtttccttttaggaaaaccacaggttctttaggaaagtcaacttttctccctccaatagttaatgctgttttcccaactgttccccttctgtatgacccttttctttccagatttaaaatctcttcatatgtgccttttaaaacatcttgttaaactttccattcatcaaataaataccagatgatagggactgtgcccttttccatactttttgccatgtggataataaatacatctatttacttcattttccatcaattaaaaatactacagtggctttttatttaatcgattatatggaagttagaggggatgggaatggaacattattagacttcttgtttgcgagtacttggacattagtaaacttctcttggagatccagtccaggaaaatagattgctggccagaaatagaaacagcattttttccccttaataaaggaagtcattgtttaaaataatacttaaaaattttaaaaagactaattgtccctttcctttttaagagtatttttgaacatacttttaaaagactcttggtatcttcatattattttacaattatgcagtgattttttaatgcagagcgtgtattgaagtctattattccttcccgcccaagttgagtgtataagttgtgggtgatttttgctctctttccagctgtgtcatagaatcacacaaatgagttcatactggggcttagtgcttgtagattttccattttgtttgctttttgctgttttcagtgtattgttaggttaaaggaatgcttctatctttgattactccctggtaatggggacatctttaccctggaaagcaggaggtaatgaagaacaggtgttcaatgtgaactttcagttttgttttctcagaaatgtgcccaaaagtagggcaaagctttccaagttttttaacgcagattattgtattgatagctgcagtatttcccctggtctccctccagcacccatatcccaggcctctgagtttgacagcacttgaaggagccatgaaaacttgctaacttacaattgataagttgatcaaatgaatttatgcaagacagtgagtgcccagcatctctgcctcaatgtttacacaggataatctcctagaacgtagcaaagttttcatttgtggtaagaaatagatgttgcttcccttcagaatctgaaataagattagacaaaaaattctagagataaaattgtcaggatgaattttgcttaaatatctgagggccggaggaacatttactcttcataaataagatttagcccccatagtcaacttccagggaacatctctattttttcaaggtcttttttttcatcatatgcctgcctcagggtgctgaactttggactgtaaggtcaggcaagtctccatctttttatcctgcaacaggcctgacagtctttgggactccttttcctaatgcagacgttgtagtttgagtcacagcagctacggagtgctttccactcgagcaagggtagacttgctggctctcaacttcgctgtggcacaaatgcagtactcaccgaggccagttctgtagcatctctggtgcagcgtcacccttttcctaatatattcttttcatttttttattggtaaaatatacataacataaaatttaccatttttaactattttttaagtgtacagttcagtggcattaagtacattcacattgttgtgcaaccatcaccaccatccatctccagagcttttttcgttatttcaaactgaaactcggtatccattaaatgataactaccattcctccttcacccgagcccctagcaaccaccattctaccttccgtctatacgaacttgactattttaggtgcctcatataaatggaaatcattcaatctttacccttttgtgtctggcttatttcacttagtctaatgccctcaagattcatccacgtgtcagaatttccttcctttttgaagctgaatagcattcccctgtgtttatatatcacattttgtttatccattcgtcaatggacacatgggttgcttccacctattgactattgtgaataatgctgccatgattgtggttgtacaaatacctgttcagattcctgctttcacttcctttgggtatatacttagaagtggaattgctgggttacatggtaattctgtgcttagtatttttagggattgtcataccactgtacacagtgactgccctattttacattcccaccagcaatctgtaagctactttttagcagacataattcccatcacaccctactctcaacaatataaaaccagtattcatctgattcttttcttaatttaaaattaaaaattttaaaaatatttatttgtttatttaatgtctttattttttagagacaagctcttgctctgttgcccaggctggagtgcagtggcactatcatagttcactgcagcctggaactcctgcgatcaagcagtcctccctcctcagcctccagagtagctgggactacaggtgcaccaccattcctggctaactttttaaaaaaattttgtagagacaggaatctcactctcttgcccaggctggttttgaaactcctggcctcaagtgatccttccacctcagccttccaaagtactgggattacaggcatgagctaccacgcccagcctgattcttgtcagtaaaggtttttctccatttttggggtgagggggaaagttggacactgcacttatattgtcgccacgggaagcagaaatgtatcaaaagaagacaagaagaaaaaagcaaaaactatggcataatgcagaagaaaagccagcattcacaaaggatacaggaccctctggatttaaacagaaaatgctataagcagggtgtgaaactcccatctgtccattgctgcttccttttagggtgtacctgatcttgtgtgtgccaagtacaaaatgccccgtgtgcctttgtaacggccaagctcccagtgctttctcattcccacagtggccatgtggtctacaaagtgaagcagacgccaggctgactctcaaataaagcctccttgctgctgtttgcctccagatagttcaagccatttcctttcatttttggaaaaaaagagtgtcagtttggctttctgaaaacagttgccacctttgggcaaagctaattaactacaatacacatgttcagttcaggatttccaaagagaaagaaatgtttgatactggtgtatgttacccaacctgaccacacatatggcaggtttgggccaagaggagggagcaggaggacattagttctgatttcaggtaactgttaactcgttctacttcttggaataatatgataccagagagagagagcttctatgtgaagctttgtggatttgaaaactgctatactgaatattttatgatcttgtcaaggcctccccttatcatgtgacctcaaggcgctaccatggctttcatcttgtgaagtcttgaacatttgtagttgcagaaaaacctcaagagactcagtatttcaaaagccatagtttaggttttattttctaggctgggatgtttgtgggttttcttattataaaattagagttgtcatagtgatgttgtgtatttcaaaccagatattctgtggtcgcagcaaagtctcactttaggaaatggatttctttatgaatgtgctaacattgtgcacagaaagtagcacaatacagataaacaggcatctttggtaggtggggtgtttgggtaaatttaaatttctgaggattgaacaaaaactcctttaccttaagaactgtgcaagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaactgtgcaaaattgtcctaaaaaaatttaagtagtctagtctctagatgtccgtagttaacataattttattgttctcactcatccagctttagaacacatggttcctgaatacaagtctcagctttgacctcagtgcttgttaacccagtgcctcagcccttcttagacatgaatcagaacctttggtggtagagcaggaaattggcactttagcacccagggtgatttttatgcctactaaagtgtgagaacaactgactttgaagctgtaggtgtttgggttggtggcgtatttatccctagaattgctccgtgtaatttgatgatgaggacatctttctgtttctttcctccaaaatggaaggcaaactaaattaaaatccagttaattcaggttctgagttgattgggacatggataattgtgatctttttgctgatttctaaaatattttcccttcattatctgttggatttcaagtgcattctgctctgtgttatagaatgagggttgatgtgaaacttagggagactccaattatatacatggttcaattactggttccataatttagggtgtcctcttttcccattgactttcactttcttcgtacttaaatggcaaggttgtactctctgatctcagtgtttctttccatctctagcatcttatgatttccttctttattttctaactttttctcttccaccctcaaaacattttctccatgcatagaactagaaaggccctttgagatcatttcatcttaatctctcattaggcacgagagaaaataagctgaggaacaaattggagatgctgctttgaaagagcccacatgagagcctggggcttcagctctcacagtagagctccttgcactgtggcatgaattgcttatcgtatgtggggctccatttcttacattccagccctgcccgataagtatttggtacggcagcagcagaggttgctctcaacatttggacattaggaatttaatgtgttaggattgattcatatgtgtcatcaaattgtatctggggacagagattctggggagactcacgtatgagtttggctggccacaagtaaaccccagatgactcttgttactaattctagaatacccaaacagcatatattgtgaacttttttgcagtgtacttgaaagggcatgacctttgcactccgaactatgttcaaatcctggtttgggaatttattaactgtggaaccctaggcaggttaccttacctctctgagccttatcaacataaaggttgtgaaataactagtttgtggattaaatacgatcttacatgtaacgattcctggaatttaatgggcaccaagtaaataccagctcatggatctttctttacttgttggtattattagagtttgaaactttgcaaacttgggacacataccaacaatttgaaaatacaaagggggtaattttaagcttcttgcgatatcagctttcagcaatttaaaaagaaggaactgttttttttttttttttggaaaattaggaagtcaaaatgccagactcatctataaatgcgaagctctttttgagcttttatagtacgggcttatgacatcagtaaggatccagccccttcattattggaacctgtcacagaccagggcaggaaacctctcccttattgtgtctccactttttcttgttctcagagttcctttagaacatgtccagggaacattgctggatgtgcattctcaaagcatgttgctgtactccataaatgctgataagctttttccccagaccaacagaagtcatataagtgaaaggacagagaagaaaatttatcaaagaaagagtgagaagaagattgacccccaccaggaatggaattttctctctatagcttactcctcttgatgaagtattaatttttaacaggaatacggatcacttttttccaggtgtgaattagttcctattgtgaagtatttgtcattccaaaccatttttgttcttattgctagctgtatgattgcatgaataattagtgcccatggagtgctttaagagcctaaccttcctggaaagacagtgctagtgtaaagggtcttatatatgaaaccattatggcactgtttaaggcattggaaaggtccagaatattctgtacccatgagaaaaaactgggctaaaaaacagaaagtgagtgctaggctacttctttttagtcctctttctatttgattcttagggttacagaatatcaggattgtaatattgcttaaagtttatctaaccatcaagtacatggattcctctacaacagtcctgtactacacacacacagacacacacacacacgcacacacacaggattggggagaaacacagagaaagagagaaagaaaatgagaatgaatgaatttatcaactctgctttaccgcccaagtgatgtatggaatgtgaccccaacatctgttaccccatatatggtcaagattgatttttgttggttgggtaccagtccctcttctgctcattgccatgtgtttattcccctcaactgaaccattcatcagttaaggatatgtgtcctactcaaaccccttttctttgaacccacatccatctaatgtctttgttcacatgtcagacagctcctcaaatagtcaaagggaacttggcattttccttaatcgtctcttctccagttgaattttcccagattcttcattcattccttatttttgagaatgaccagcaaaactaaaggaatggctgtaggttccttccattatttatataatgcagcttttccatagagaagcaatatttataaaggacaaataaagacatgtctgcagagacagtgaaattcttagaaagtatgctgtacttgaaaggcaagacacagaggttttgaatgcaagctgtgatgaaacattacccagggcagcgtcctgtctgtgttagagtggagaaacagagtcatggagcctcttggtcaaagcgtcactatgtcaatcttgcagagcagaacggctgtcaggttaacgagtgctgcatgtgcccagaggcagttctgagcatggtaggactacccaggtgagggctctttacctttgtgagtggggagctcccatacctcatcatgttaagccaagctgatctggaaagggacacattccaggggagaatcgggatgcttaattgatttacaccgttgatgaagcgcacaggcatgaattctggttgcctaccatcccatatggggaggaaagcgtaagttgtagaagccaccttttggcattaaaaaacaaagggcgctggagtaacataaggatatatacttagctttttctttttaatgtatgaatggaaaacaccttttatgcttcaaatgtatattttaataataaaaatagaactattgccaaaattcactccagaaggcagccttttttcttaaagcacaaagagaaagagaggagagatcaagtgtcttctcttttccatgataattgcttgtagtccctgctaactggccttttgacagggtcactggcagagcttgtgggcccccttggcgatgttggttggtgggacagagtatgggccagtgcctcagcaggaatggggcagaaaacagtaggctggttcccaggcctgtttgctctgagcaccagccaagccagggttggtttttgctcacctgtcattgcagcaatatgtagtgacgtttcaaactgctagcatggaaacaaggtaaaaacttcttgggacaactgggaaatttcatttagacagaatgtcagaccttagcctccagtgtaaatactagaggctttgctctgtccagttatgcagtagcatttggtgtggaattaaatcagaggctagtgaaaatccaggcaggatctaaatgtgttgagtacatttaagtttcttctctaatttaggaaaccttatgcttctccaccctttggcactgacaactacctggaagaggccctaacagtcttgaataggaatatgatcgctagattctctatcacagaataaaaaatgaagagcttataggctctctgattttttttaagtgctttggtcttcagaatctggcccagcactagttgttttgatttgcccagcaacctaacccatattcttgaataagcaagcaggatttcagctctagaagggtgagctgcatatattcacacaccattctattcatttttcagatacaggattttttaaaaaggagagagaacagggtcattttcattctattgcaaacgctttttatgtttcagggatcaaattatcaaatttcaggcaactttttttttaaactaggtcatgactttcaaaggccatctttattatcctcagcagaaacattaaacttgtaaaaaaaaatttataattttttttcctctggtgattttttttcttttatttccacccccacacatacaaaaaatgctcggggaaaatgtttgccttcacttcctgctattcagcactgtgtattgttaaactgatgtagtgtttatacacatcgtggttatggctgtagcccggctattgttgaaggatgttagacagccatttatcacagtacgccagtaaacccattgtaaaaatgtcctactagttaaatgaggcttagatttaatgaggctgtaagagcagaacgggattttgacatactgtaaataaggttcctatagaaatgtcatcaggattaaggtgcagattccttttgttttcaagcaacaatagtctccttgccaaggtaaaaagaagccccctcccttttaaatgaatcttttgaggaagttgttgtttgctcagaggaatgcatgaaacaagggtgtgtggccaggagatgacaagatcagagatgacttctttgggaaagagacgacactccccagaactcctttgtatatcacagccacacctggagccctcaaagcctccttgttcatacctgctgctgcatgtgaatgccattcaaatgtggtcccagtcccctcctcaaggagggcaaagccagcctcagaaagacttagtctgagattcctggccagcctttgaagagagtaatcaagttagacatagcaggagggcatttgccctttcaagccaagtggggaaacagagccagtcttctttgcttgatcttatcagtgttcaatgagatctaccattttgaaatcacagaacaaactgtagaaaatgaccagaaattcttgtgcattcaattttccccatgggaaggaaaaatcagttatttccccaatgtctaaggaaatgaattcagagagaacgtctccatacgcagccagaagtaggtacgtagggcttggcgttaaccactggggttgcagtacactatttacaaaaacaggcagtcttgaaattgccctattggagagaaatttgattgtcccagaaataaaataaagtggtctccgtcttcattttgctagggctcctggaaagcctcaattcaaagagatcagtgttgaaaaagactaaattgaaggatagcttgagagccaatagatgatctagaggcaacccatccacatctgcagtttccttagtatctttctgaacctggaacgctttagaggtgtggagtcttcttcgactgagtcttcaatttgacataacagtgtatccctttaggcttgaaccccgaactcacaaggtcttagggaatctgttgcttctattttggtggtcaccagaggcttaattttagctgctgagagattagtcttttatatttatttaatgttctcagtgggggaagaaaagttcaagggttgtgtttgccttcaatgctcactgcacataactcattttgcatccttgcagcaaatgcctgctaacttcatcaggaagtcacatttgggcaaggtgcagtatgtgctgggcattcttagctagaagggccctttctgcaatgtctccatctttagctgcccccaccaaggctcttttttttttcccagatccctcttttgctgtaagtttccaccatcctttttgcagagccacgtagaataatgttggcagagaaacttagcgatgctctcttagctcttttatcctaatagtggtttctgtatcctcacactgctagacagaatatctttctcaagacaaccaaaggcagctttttcaagaaaaggatacagatctggatgcacaacagtgaatcaggcataatcctgccactccagagctcatgaaccagtgcagtcattctcaagctttagcgtgtgcagtacataccttacccccagaggtgtgacttagtaagttcgagttggaccccaaaatcttcatttctcacaaacactgcagtgattttgatgcgaaaaacctcaagagaaatactgatgtagtgaggcagagggaacacagaaacatcatgaattacaaaactgcaggaaccgcctgaaggaaagtcagagtgctgtgggaatggagaaggtatgggtgccacaggatgggcctgggcagggcccacagacacgatcgtgtttaagccagatcttgaaggatgactcaactgtggacccttggcagtgctagagggaaggccttctgaacaggaaacaagatcaaggtgactgaggtgaaaggggaaagggcacataggggtcagtgcagccagagtgctgggtgcagggaggattctgtttggagctcaagaatttggagtttagtcttaggcagtgagaagcccttgaagatttttaagtagagaagagaaataatctgctttctgctttctttccacagtgaccacaagtgaagctgaggtggctttgggcagcattaagtgaacaaaaagggcaaaatgagaagaggcaggaaatgggaatcgttttacggctccctcctacttcccacatttctttgaggccgaattaattggtgtgattccattctcaatttaagaaatcaaggttaaatgacttgcccacaattgcattgagctggaactagggcataggtctgctgtctccagatctccagctgacttcccaccgcagcctgtcagtcagtgaaattaatctgcagtcattcgcagacacctgaaaatgtcccctcccacccctcaaattgcataataatgagtcctacagcagaaaacagttgtattctttcaaaagtttctctaatgtttttgaaatacacaaggaaatagtaaaagttaagtgaacatttgaaatacaggcttcttttatcattaaaataacgtctcccatggagtgagagtgagggtggtagtggtggggttcctgagattccaaatagattgtacttctggccctaaagattccttattagcaaaatctttgaatcagccaggtttgaatgataaataagaggacactgggcatttggaatcttcattatctatcataacaaatattgcctctggcaaagaccacatccctcagtctgagctctcacttcaaactgcaggggggccaggttagcagtgggaattgcatttctaagtcttgacagccaaggtccttagacaagaggggcctaagctttgtgacatctaatcctcgaatgtaacaaaagcagctaaaaggtgaagaagggaagcccaaaaggagaaaaaaataagggggtgagatacagcttcacattgagtttcaaagctggaagacagcttatagatcatgtagtcaaagtccccatcctcatctttacagagaaagaagtctagtcccagagaggggaaccgatttgcccagacccctacagctagttaggggtgacgctagcatgaagaagccacgtggctcttgtcaccacaccaagctgttgctctcatgtctcatgatacaattgtgctcacagattatttcccatggatccactgggatagtttatgaatcctttaaatgcaaaaattaaataatactgggaagccagagagcctatgagatcgggttcagtatttttactgtttactggctgtgtggccctgagccagatctcctctgagcttattacttcttctgaaaaagggggctaataatctatctgtacccgatacagagtttctctgaggttaaaatgtgtcatttaatgtggaaatgctgtacaaactggaaaactccactaaaacatatgctgttaaactcttaaatataaaacttgggtgctgaacaggcccctaggaagttcacatatgcagctattatttttctgtgaatttgtttatagggtgtttagaagcacctaggagtggccatattgcttatcctatgaatgcaggttttggaaccagagtcagctattgtcaaaaatcccagttcccccatttgctcaattctggttatcagtggtttacttcacttctccaagttgagatcttcatctgtaaaatgagaccaataactgcatctaatttataggagagttgtgagaatcaatgagataatatatacaaattactctgtgtcacacctgaaataaaggaataacttatacacaatgtctatttttactcattttgctttagttgttgtctttattattctgatatagacaaggagtaggactcttggaaccccatgagggcgggttttaggctctttgattaaccactgcatcttcaggtctgacaaggcctggcagtagcagatgctcaattaatattttggaaaaaagtaatgagttcatattgtaggggaataaagaagggggaaaaaagaccctttcctctaccctcttatgttttgtggctggcgcctgtgaattcaaaagacactagaaaggttagtaggagaaaaaacatacagatttaattgatatttttaattttacatgcacaggggctccacagaaaattgaaaaccaaaaaaagtggttttggggggcttataccattgaacaaatggcagtaaattgtggagatatgactagacagaggaaagggggtttgggcatctagggcagatgaattgtgagaacatgacttggaaattttgggggaaactaatggaagagaagggtaattttagtaaggtctgtttaagcagacttatcttggtgctggctcctcacttctcatgatagggtatctctctttatcttggtttaggaggaagggaaatttataccaccatcacaaatggaagtttatgccctgtttttaggcagaaaaggggagaacagagaacttttcctgtatctgctgattctttctttttttattgaaacaaggttttcctctgtctcaggctggagtgcagtggcatgatcatagctcactgcagcctctacttcccgggctcaggtagtcctcccacttcagccttccaggtagctgggactcaggcgcacgccaccacaccctaatttttgtgtagagacagggttttgccatgttgtctcagctggtctctggtcttcaactcctgggctcaagtaatctgtttacctcagcctcccaaagggctgggattccaggtgtgagccactgcacctgtcctatctgttgattctccgttgctttcagctcaaaaatactccttatgacaaagcggcatagttgggggtggcatatcctggactccttcaatatataaacacagcagaactttaacatttatgacatcctgattaatgtaatttttagctatacataggggcattcattcattcattcattcattctcttaacatttactgagcaactaccatgttccaggcactgtgtttgatagtggatatagattaaggaataaaatagacacaatccctgctgtggtaaacttaaaatctagtagaagagactaaaaaacaggcaagtaaacagatgactaaaacaaaataatccagagttatgaattatggtaagtactatgaaggaaacatacagcatgtggttaaaaatagtggggagtggccgggggtggtggctcacgcctgtaatcccagcactttgggaggccgaggcaggcagatcacctgaggtcgggagttcgagatcctgaccaacatggagaaaccccgtctctactaaaaatacaaaattagccaggcgtggtggtgctactcaggaggctggggcaggagaatcacttgaacccgggaggcggaggttgcggtgagccaagatcatgccattgcactctagcctgggtgacagagtgagactgtctcaaaaaaaaaaaatagtggggagtgcttctctgagatttcaagaaaggccttctaaacataaaaatgttaatcctttgcctttcatccttgtagaataaagttatcataaaaagcccatttccttgtaggtcaaaatagacttatagcagtaacctcctgaatggcagttgtaaggatagatgtgataaagccgtaacactttagtgtgtagcaggataatctgtggaacccgtgtaacaatcagaagcctgggcttcagaccatagatagggagtgaggcttctaggtgggaccctggcaagggtgtgtttgtggaactcatcaggtgctcctgctgcaggctcaagtctgagcgcccagttcaatccagggagctgttgatttcttggctggttgactttgctgaacatcatggctccctccccacaacagggatgttgctgttgaaagcatgacatgcgtagggtttgatgtgagtgacatcaagatgtcctttagtattccattgcaaaccctttcccctcttaggaaaatgatgcccttgtgatttgactcattctcccccaagaaatgatgctcattcacgtctgaaaaaataccccctgtatagtaaatggtgacaacagacagggatttccctcatcttaagccagggcttctctctgaaaacatctcagagtgggcttcagttttgtaaactccctgaaattgtaggtaaattgtgtgtccttggtgtaaatatgaattttatctttcgagggtctatagctttcttcacattcttaaggggatctgctccctaagatcataaatgtagtactggatggtagggtgacgtctcgtggatccttgtatctccagcacctagggcagggactcacgaaacctctcaggaaataccggttgattgaagtaaagattcattctgaagcagacccctctagctatcagcaaaggacaaaatccacactcggcctttcttacttgcccctgtttaactgcgcaaactcttgtttgctgtgccactctctttcgtatgcccgtttgcacctggcttcctatttatcagctatcaatatccagcgagtgctggctcttgtcagtctaatttctggttgctgccgcttcttgacaccccacactttatcacccacacactgctcggctcctattacaactggtctcagcattgctaataaacagcaacaccaaagccatattttctggtccctgtcaggccactgctttcctgggtgaaataaaagtcctattaacatgctcctcctcattgcctctgacagattgattaattaggcctcctctttagatgacctctgcactgacacgacaaggaggtggatataaaatgaatagtttgcccatataatgggctactgtgggtttggggtttttatcaaatcagactgtcggaagttacgaacttgtatgaaattccatggcttgcagcagcagcagcctaggatggcttttggtccagtggaatctgtcacatacagataggacttgaatgccaggcactgcggggcaggggagaacccacctgacaaacagccgcctgtctacctgaatgatctctcgtttatgcagcccagttcatagagtgcaaatctaatgttcttttaatgttatcaaataaaatcaccttttgttttccacagcttttctttccctccatccctccttccctgctagaacacccaatacgttaactttgtggttgctttgcctctcagaacgctaatgcaaaaccattacaaaagagcacttgagttaaatgtccacatttccattataagttgttgttttcagagaaatcggtaacttggacataaaaagtcattttagactgggacttggcgtcggggggggctccgacagtcttggcaaacaaattaggctgcttgctttccattaagagagtgtggattccgaggggtgctcgttggctgcctttgctgttatgcacttctttagtgagggaatggcttgggaagccattaaccagattgaaatatacaaggagctctctaattgctttactgagcaggctctgtagatatttaaaatcctgcctacaaagaagaataaaacagccttgcagagcatggaggctgcagcaagcgaacacacatggacaaagatgcccagagatggaaggctgtttcttctgcttacttgtattgttttttttttccctttggagtgagttaatttattattttaaagcatgcctactaacatctggcacttttagaaacatgccattctattacagtgtcttcctccaaagaaaaataatttcagtgatgccaagatcaagccggtgaattcttagcagagcttggtacttgctaggtgctcaataagtggtaggcaggctgagctgaatgatgagtcttttcaggagaaattctcaatgggtgaaaccctagaaagagagtaggagaggggacttgccagtctcctctaaccgcacacagaattcccagggcctggaaggaactcatagcctttgactttgcctgcaaagctattcattttatattggtctaaatttgggctgagtttgcagctatctgcaaccaagtgagtgaaatactgggtggtccatggagaaatgatggtattagaaacaggaccctcaagaacgtacacatgtacacatgccactgtcaccactttagagatggtaatagtgacactagggaagagagtagttgcttaaagactgcatgaacttgaacggatatttgtatagccaggttcatagcagcattattcccaatagccaaaaggtggaagcacctcaagtgtccactgacaggtgaatgaataaacaaaacatagatacctaaaatggaatattaatcagccttaaaacagaaggaaatcctaacacatactactacatggatgagccttgaagacattatgctaagtgaggtaagccagacacaaaagaacgtatattgtattattccacttgtatgaggtacttagagtggtcaaattcataaagatggaaagtagaatggcagttgccaggggctaggggtgaagggggttatcatttaatgcgtagtttcggtttgggaagatgaacaaattttgaagatggttggtagtgatagttgcacaataatgtgagtatacttaatgccactgaactacactaaaaatggttaaaatgataaattatttgttatgcatattttaccataattaagaaaaaaggttacactaattagtgacaactagactggaatgcaaatcccttgaataccagtctaacaatagaatggaaagatgtttggtctgggagtcagcaggcatggaatttagttcctttgtattagtcgaaggtcttcaacaaatcatgttagccctttgagccttgttttccatttataagagagggttgaacaacattccagctctgccagtcttacatacccagagcccttcctcagccggggagtctcctagtggacattgtcctgaagccagcctggattttgctctctttatttttttttctttgtcacaggtcattcaggcaatgactgcatacctagactaggtgttgtcaggggaaaggagtgaaagagaagatggaagctttaaaggaactgttcatctctcccaaacttaatttcacaattcccaaagaggaaaagaaattaatgtatttgctgttaagaaattgccatatgtcctgttcttttatcccaatgtggatgatcattgactcccagaaatccctgagaaataaatcggagaatatgctgaaatttatttaattaaggtagtgcaggggctggttccatattaaacatggtgatggggatttaagataataatgctaccatcagtacatctaaaattgtttaatgttttactgcaaatattttttagctagaagaaattaaacaagtggggaagattctcagaaaccaacacagcccaaaatgtgcagataaagaaccaaaaaataacgtagaaaggagcaagattataataaatatttttaatgagttaatttatttcctctttttaagtcttaacttgtaacattatttgaaatcacagtaaatgtacattttatttcttgtttcagccctgaggtgagtttatttggaatgtttgttttaaatggatttagccatcatggaattaggtcatcttggaaaaatgtgttttttctaaaaaaaaaaaaaaaaaatagaatgatgttctgtgtgtttgagagtaatttagaaaccactgttaatttccagtcctgttatggactccttcttcaggaaggtaagtgcttttgatgtgtttgaagcattttgtgagacaagcaaaacaatttggagcaattgaaagtgacaaccctgccccgagcacatggcttcattttcattacgttataacgcaggtggaatgcagatcatgccgggtcagttctctctctcagtatcatttattctacctttctgtgccttaagagcaaacttttcacttaacacaaggatgctatccatttggcttcttttttgcttttccagtgaatagccatttgcttatcgacttgtttttgaacttactataataagctttagtcaattttcttttaaaataattttttggctttaactcttgtgagatagcaataacacaaaaaagacatttattttgctttgaaactagtgctttttccagaaggtcttgtatcccttaacaatttgcattcatccattcatcaaatgtggattgagggcaatgtactgttccaagcctcggattactatggagaagcataaggtgggttcatctctgcttaagatgagtttgttgtttcgttatgcagtcattcgtatggtgagaactgtcagtaattcatactatcttcaagtaaacacaaaaatccatcacgctagttactggtcatcctcttaggatagaagatggtgggggagatgagtatttattatctccacctgcctacaaagtgtttctcattccctgagttcattctacagagccatgatttgaacccaggtccttactactgcaatctggatactttccaattaccatgacatcttttggattatttagtctatcacttgtctgctttcactccccaccctcccacctgcaatccctgccccgtcttctctctttctctccctcccctcctacaatgagaaagtgatatataaggaagacaatgagacaaaagcctgaccctgaagtcagacagaccagagcttgactcccatctgtgctgggtgaccttggataagttatctaactttactaaaccccaggtgcctccactgaaaacagaagatactgatacttcagtaataataataagctctgacacttaaagaattctgtccaatgcctgacgtggagcaagcagtaagcctcagttagtgttaactgctattatgtttacgatcttcccatcataaatgctttatttatttattatttttttaaagtagcatttcccactaggttcccagcagagtggatggagaagcaggtgtggaggattggtttcaggagtctgtgtgtctatgagcagagaaagtataaatttatattgtgtctgaagaatttcttatgtgacttgattaaaaaaagataaggatgaaagcttaatgacaatatttttttttccttgagacaggattttgctgtcgaccaggctggcgtgcagtggtgtgatcatagctcgctactgcctcaaactcctggcccaagcaggagtagctggagctacaggctcaagccaccatacccagttaattttttaaaacaatttttgtagaattgggatctgtttatgttccccagcttggcctccaactcccgagctcaagctatcctcctccttcagcctcccaaagtattgggattataggtgtgagtcaccgtgcctggcttaatggtgataacttttttttgaaaagagccccaactgatacctagttgaaatgttacctataatgtgatattttctgggactctcccaggtggagttggtcactctagcctctgtgtcactgtagccactgttcgatagctatacacagtgaatgctcagtaatatttgttatgtggctgaatgagtgaaataataagtgaatgacaacacatcactttattttaaaatattttcacatttggttccctgatcagaccttgatatggttggatctggaaaggagtcttgtctctcccgttttccctgctgtcctgacatactttttcacacatagtgggcaatcagcaaagcttcccctattgctttttgtagactctttcctattagagacatgtctccaaacattcacagattttatttgactaaatactcacatgtagatctaattagttgggctctatttctctgttctctaaaagactccctgagtatttcagtctggagaccactcttctatctttttctccttccggagtttcagaattttcttcttaaactgccatctttgggagttcttctctgttcttcttcacattcttcccaccttctttccaacagtttttgcattttatcttaaacgatgtgtcttgaaaagatacaaaatgctccttctggccatctctgagccagttttactatgagccagagatcaacaaactgaactttttattttacatcttctgcatgccaggcactgagttaggctgtaaggatacagtggtaaacaagacagggttctgccgcatggaacttacactcctgtgaaggagcagtttcatgggttgtgaataagagtttcagagggataaatcaggaataagaagcagcctaacctagcctggggaatgggctgtgacaactgtgatgaggcctcagcacttgttcccactgggaatcaggaatggggaaacctatgcaaaaaaaaaggggcaagagaatgaaggctgtcatgctggaaaagctgaggccgaagctttagaaatgtttcctactttcagagttgggattgaattaaaggacaaagtgggagagaaatatgagcctaaaccacagaatcacagatcttttgccaggctcctggaataggggggcatcttttggatccataattaagtcactaccacaagattattgtcaattgttagtatttcatacattacagatgtttctaagtgattggtttcatggaaggggattgtggcagacgttgtttaaaaatatgacctctcacttgttccatttctgattttccacatagaacagatgatcttgattgtgtcatggtcaacccagaattatgacagtctgggaagattaggaggagaataaactgctacttaaaccttttctcagcagcattggaaagcatgtgtttccagcaataactcctgggaactatttggtcagtatatgcttcagctgtaattaaaagggcatttccttggttttaatttcttttaattaattaaaaaatatgccgtctgtgtagggggagttatagtcccttcctagatgtggaaaaatgtgatttctgagaccaaaaagcagtatttccaaaagagtgttctgaagaccactagttctgctcggtaacccagagaatggattggtttgagatttgctgctcactctgtcctcttggagattcacgagtttgtcaatgtactaaaggctctgagaagtcctgcagtaaagacacctctttaactcagcatttcacatatatgtttgagcaaagcacccgtttttaagcccagacatattacgattccacagaacacactttgggaaacatggtagtaatggtatttcttagcgtcctctgcatgcatcattgtggtaactctgagctgataggacttagaagcagtcatgcctcatgcagaagtcaaaggagaggcctcagccagatttagtggcagctccgattgtttattgagtgaaatgaacgtgtcagcagtagactgcagtggaaaaaacactgggcttggagtcagatggtcagaacctattcttggcctggcactaccagttttgctgccttgagtaaagaggttaacctcattgagcttctcttttctctgtaaaatggctattacctgccctacagctgccctaataaccatcattcattcagtgctccagagtccagaacaggggtcagcaaatgttttctgtaaaggactagaaggtgtaataaatatcttagactttacggcccatatggtctctgtcatggctactcacctctgccattgcggtgtggaagcagttgtagatgatatgcaaatgaataggtatagctgtgtcccagtaaaactttttttttttttttggagacggagtctcacgctgtcacccaggctggagtgcagtggcgcgacctcggctcactgcaacctccgcctcccggattcaagcaattctcctgcccgagcctcctgagtagctgggattacaggcatctgccaccacgcccggctagtttttgtatttttagtagagacggggtttcaccatgttggccaggctggtcttgaactcctgacctcaggtaatccccccgcctcagcctcccaaagtgctggaattataggtgtgagccaccatacccagccccagtaaaagtttatttataaaaacaacaagagagatttggcccacgggccatagcttgctaattcctgatctaacgtatgtcaaggtctttacctatattactgctaattctgcctgtaggattaacagaacacctagatttataccagagaaaactgagacacagagatgttaagtaacttgcttaaggcaatatagttaataagtaggtctaagaattgtgctcttagctaccatactgaactcccttctcttatgacatcaaaaaacaggttacaaattacaaaggtaaataaatgtagataggatgtagtattatctgaggaagttctcgtttacttgggctataggaggcaattcatgagaagaagcatgtattatatagtatgcttactatgcccttttgtctccactgccacttctgtactatgctttaccttctcctcactcagcaatgactggggtttctagggcaccgtaattcaaagaaattgcctttttctgaaaattaccaaaatccactagcagcctattgaacataatagtgacactgcaaatgtgcccgaaccttcagacattaaggtgccaggatgctgtagacttgagtgtgtaataggaaacatctgagtctacagttccagcaaatgtagactatttcttaataaaaaataaccctgtgtacatccacttaggttttacttcctaagtggagtaaaactagccctagagtcaagtttgaaattattttcataattttgggtaattaagacacttcccagatctcattagcaaatgcctaaaatagaataattgccatataattagtgactggcaaacttttagaggtttgaaggttttgttcttttctgaatttggaagtacaagggcctaatcttgaatttatcagaacccaggaaacttcgtaactagactccattcctttcccaattcatttgttttagtcctacctgtcttcttccaccaaattccacatctttctatgagtttcttgtaagcattttgtcttcttctatttagatatttctccttggctggagtcttgtactttaacaactatttagcatgttccttctctgagtctgacactgagccaaatgctaaggggaagatggtatctctgcctgctaggagcttatagtctagttaagatatgatttcatgataacagccaaagaagagatagggtggcagatgattcacttaagtctgctgtgctctgagatttagagttagggcatcctactcttctctagcactttaattgctttttagggctgcccttattatcttcattgatctcaaaataattctggcaggtagtacagataggatcgagaatagtaatgtctttcacctaaagaagctgaagctcagaagagtttggcaatttgtctaaggttatgcagttatgtatgggtttaaaaaataatagcaggtcttctgccccctggccccgcctattttttaccgtgatgcatcagcacatggcacatagattcccaagtgtctcaccccattatcttgtcaagggaaagagtgtaaatgttgaagttggacaactttgcatccaaaacctagctcagccactttggtttgaccgttaggtcagtaatttaacttaaaccttcttattcctattcttcataggtaatttgagactgcaataagtcaattgcaggactgtggcagggattaactagaggacaaatgtgaaagtacctaataggataaatgaaataataaatggaagctcttataaatgagtatatcactccatgctcactcaccacacttcttctcaagtctctctcctttactggatcatgaactccttgagaaaaagagtcatttcttggtcatctctgacacatagtagggctcaatatactttgttcatttaataaacacctagcgcttatggtgtgtcaggcaccattctaagtgctttgcgtattttaactgagctttattataatcccttgaagtggaagaactactattatacccattatgcagattaggaaactgaggcccaggaagatatgccagagttcacccaactattaagtggtggaattaggactcaaacccaattgtctggctccagagtctatgctgttactcatcctgggctgctatcagttggactgggttaggttgttcaggccccatcagctttgcttcccccgagattcctgctccttggctctggaggcacattttgttaacaagtcgggattctttggtgaggtcagatttcttctatctgcctcccttttactgctcttgattttccagggttaataattcaagatgatagctgaaccataggactaaatttcaaagcacagagtctagaggtgttttaaatgaagagggaaggttgtgcaaaagtcaactgggtagaggaaggctggcgactagatttaggctagtattcagataagtgtggatccagaagagccccagctcagagtcatgcctaggtgacaagccaggtttttattctcctaaaaggaaaggacttacttagaaacagagagtagccccttccaagtcttctttgccattctagggttgaaatttgatggggaaaatagaagctttcaggtctcacttaagagtcaatgacaacacaaggaaatctgtctcccagtccctttttcagcttctagttcagttaacatacttttacgtatttgcaaagatgtgtaagctgtttaatagaatcatagaaaaacctaaatgaacagggaatgggatgtattaaaacaaacacaagggagttaaaagaaaattcattctgagttgtgggtaggtaacttagtgtttaggtcccagttttttattgcatcctaatgcttgagcccagcgatgctgaggtaggcctggtgatgacaatattcattaaagttaatttcctgatagaggccacttaaatctgattgttgttttaatttgtttcactgctaatttccttcgcttaaatagaggaagctctctgcccctcccacagccagcccaggcagtttcagggaggtgacagccatcacggcattcaccaaccagagaatgccatcatgtcacactctttaggcaggagatgatgtctttatttatctctagaacctagaagttgcctgatttggaaaatataggtgctcactttcaaagtctaaaagtatattgctttattgaatatgaaatctcctccattactcagctagacctaaatccatctaggacttaatgggaaaaatgtgagtcccagcagtgtccaggatttttgaattatacatactcattttgttgtttgaagaacaaatataaatacagcacaggctaaaacatcaaagcaggagagaaaactcccacagtaataataatagcaaacaaaatgtttattaaattccaggctgttcaaagtctttttcatcatggaccttgtgcggtaggtgcttttgttatctgcatttttacagatgaggaagctgatgcctggagaggtaaatgaagctaacaacgaggatttgaattcaggagggttgccttagactctggctcttaaccccggcaacagtgcttcttaaactctggtcccaagactgcagcatctgcatctcttgagaccttgttagaagtgcaagttctttggctccatcctatagccacagaaccttggagtggcttcaagtgactgatgctctctaaagtttgagaaacattgcattacaggatgctacttttccagacttggttcttacattccataaatatttatcaagtactcaataagtggcagggactattggagatacagcaaaagcaaaaatgcctcccctctggcggtttacagtttagagagtttacagactctaaagaaaattaagtaattcaaatactaaaatactaagctctcttatctcaggttggcagattacattctcagttagtaaaaaaaaaaaaaaaaaaaaaaaagatgctaaactttaacactaatagccagaggaaggaacaccgcataaaggagtttagaagcttacttcaggtgacactactgaggttgcaaacccaggtctcttggttcctgatcttagcatctctcctatgctatgctgagcatgttttcctcatctcctttgccctgtagcttgttagggggaaaaaaacatgaggtttatagacaggctgacctgagaccaaatcccagctctgccacttactgatttcattgcacacagattgacatgaggttggggtttgggggcagagttgacagtggttggtagaggcagagctggaaattccagtccacagttcctgccagctcacaaaactgggagagattccagtctagggaagggatgtgaatgatgggtggtcaggctttgttggtccagtgtctgtcactgctcttggactcacaaaacttcctgctcttcaactttgtgagattttgaaacacagttttctctccttctcactgcagtatgcttagccagagtcctcagaaggagcatagattttgtgtgtgtattagatatgcttccaaatgtatagccactgtgatcgagtgtcactgccactggttcagagttttctgtttcagggaaagccagtaaaaacctgacttttggaaatttccgtttattgaaaaaggcagacagcaccacttttgatagtgtgcttgttaaaaggctttaagaagaagatatttgactggctagcagacatttcacataagagatggtgtgtcaccagataaagagtagaggggactggggagaatgggataccatgcagttataacccactttccagagaacagaattctggtccctcgccttctaaaacactggcaaaataaggaagtaagaaatgtgttctttgcagaactaataactcagaaagcatacaaacaagggcctgttaggaatgcactcgcaaactatgctaattctggtttaactcatgattctgacacattgtcctggccccagagaaacttgggtagcaaatttgaaggagaagaagaaatattgaaactggggattctgaaggcaaccaaatctgagtttggatctcaactttaccagtcagatgcatgaccctaatcgagtgattaaacactgtggacctttcctcattcgatcgtctgtaaaactgaaaaaaaaaaattagcactttatatcttccagagttcttgtgaagctaatgcattgaaagtacccagcagataactgtacaattgtttcagtgatggtgaatagcaacaaaacggaaaggtatcacttactgagagcttcttatgtgccaggttgatctaagcatttcataggtatcaatttatttaaatatcactattattattggagttagactgtgttatctccgtgtactctggcaactaggaagagcttttaaatgtttttatgcagaactggaaatgcacaagcttgtattaatatgaaaattgtgatttaaattagaaaattctcaatatcttaaatgaaaattattgctccaggatgataaaccaggatgatctgtggatccagttgttacttcctgggggtaaacacaccatggtttgagaattacagccctgcactcctctttttatctcacctctgctgttcaggggctattgtggatgagctggtgatggtaagaggggcaagtgaggaagggatatgccccatgaccttgtctcttcccccttcccctgcgaattctggatccctgcccacctcctcttcagctcatcagtagtgacatgccaatgtggtaggcagcataatgaccctgccctaaagatgtccacatcctaatcccagaaatatgtgaatgttaccttacatggaagagaggattttgcaggtgtgattaaattaagggtcatgagatgggaagattatcttggattagtggagagggctcagtgtaatcacatgggtccccacaaccgggaggctggagggtcagagtgagagttgtggccacagaagcagaagtcagagtaatttagggccaggagccaaggaatgtgggaagcctctagaagctgtaaaaggcaaggaattagattctccctcagagcttccaaaagaaaccagccctgccaataccttggttttagtacagtgagactaattttggactcctgactttcagaactataagataataaatgtgggttgttttgttacagcagccataggaaaccaatatactaggatagagtaagcctagatttcctctgaaatgtgaacgaattttctatctatctctgttgcaaaagagagaaacttttatccctttgaaaatttcccactacagcttcagaataatcatgggcttgagacatgatagcgagggaccaatgtgagaaaagaaagcagtgacggggtggacctgccctttggataatgtttcctaaagtgacattcaaggagatcggcttccagggtttattctggcatggtagttaagcacatctccctgtgactttggaaatctttagcctctttttgcctcagtttcctcatctgtaaaataaggttaatcacagcattcacctcaaagagatgctgtgtgtaatgtttcatatagtacatgctacatggcaagctttatgtaaatgttagctcttatgaatagccattattttaaaaaagtgaaacagaatttatagggggtccaatatgtttagaacaggatccattacatcaaacaggcttcttttctgcagggtatctcagaatctttactatggtaatgttcactttataccttaaaattggagggaaaatgcaggaacatttctcaaacttatttaaccatagaaccctttctgatctgtaacaatctcagcaaatcagatttattggtcatagtatgagaaacactacccttaaaagttacaccaggaaaccttggttcacctctctccaactcatagtccctgtacccagcttctagagccatcaccgaactggagattggggacccccatcagaacagtgcaaggagaaacatgtgcctagtatcaaaagctgaagattagaggcttttttccacgttcacattgttctaacattgtatgttatcatatcagttagcttggctcctggggacttgcctgggaacctagcattgtttccataccatgacactttagttccaaccaggcaacctagaaatagtttagaatgtaattcacaagttggggacctgtactttagcttcaaagtaatgctgttgatttgtgagcagataacctagaaatatatacatcaaaatgtttattttactcttcaaataagcaattttcaaaaaagaattgtgtattttatagggtggaagtatagcatcactaagttgtattcattctagggcgtatgtttttaaaaaaaaactagtgtcattactttgcacaggcatgccttgtgtaaatataggaaatctaacttctggggaatttcatttcaagaaatcagacctggctcacataaagatacctttcaaaaatgaaatatagcaaatttagtcaagcttaggctgttttgttttgaaagctataaagaagtaaactataacctgctttatttttagcagacacctctagaaaaccttgcacaatgttctatttataaaacagagtctgttttcatgcaaagttgcttagtaataagagaaaagagcaagactgagtatcggaaaaatgaaatgtttctgttttcaagattccttgaattcatcagcatctctttaagacacaacaaagcaattgacctggttttagttttgactatgagaggttacctggagattgataaattggatttttttttttttttgagacagaatcctgctctatcccccatgctggagggcagtggcgcgatctcggctccttgaaacctctgcctcctgggttcaagcaattctcatgcttcagcctcccaagtagccaggattacaagtgcctgccaccacacagtttttgtatttttagtagaaatggggttttgccatactggccggactggtcttaaactcctgacctcaggtgatccacccaccttggcctcccaaagtgctggaattacaggcgtgagccaccgtgcccggctgaaaaaaagtggaatttgaaatgaaagtgcagtctgtcttttatgagttatgccactgagtaagcgacagaggacctaaataattatcaggtcatttcaatatcacattatatagaacatttataatttcatcatcctttaaggcattaacaaaaaaacaaaacaaaacagaaaacaacacagaagaaaacgtggttgagtaaattcaatggctatagaagattctagaaagtgaaagtaatgacccaatacaactagaatgtagtgtaggaaacaggcagtttccaccatctgctttatcattctgatcaattttgtatcatgctgtttcctaatctttacaataacaataaaaccaacatttatttaggggttattatgtgccatgcactctgctaggagctttatgtggattatttcatttaatgttcccaacaatgtgtcattgccatagataatataattatctccatcttacagattgggaaacagattcagagaggtgcagcagcttactcaagttcacacctttggaggtgttaaagctggttcagacacaggtctgacttcagagctgcactgttaagtgctacctagtgttaagtggagccaacagtgaaccaacagagaatacacacacgctgtgtgccagaggctcaatgtagagacagaggctggtctctagtctgcctttttatcgtaataatccaggaaagcttaggaatcccccccaacccgctgcaaaaaaagccccacatcatccatgacaaaaagaatagctttcctgtttttcttcacatttttcgcagccatttcttagcttcggaaaacttaggtgtgttcatctcaccttgcatatatatattgcatatattttatacacaattgtctgtttacctggctgcctcctcatcctctttcatctctaattctgatttttcctgaatacagaacctggtgggaagtcatagttctgcacatgtatgatgggtgaatggaagagcatgcccagatgcagattgaacatagacatggtgtgcagtgtatgctgtgggctggtttttctcaagcaacatgatgtcttaaggattttctgtgttgccacctagtcttcagaattaacatttgcataatatgtattttactggatattccaatcatggcaaattttttaaccattcttttttctgcagaatttagaaataattgttcccaatattttgttgttacgaattacactgtgtgaacaactctgtgcatagcatttttacttacttttggattatttcattaggatgtaatttctagacagggattactgaatcatagtataagcattatatatggcctgtgacagcattttccgatatgaatataacgtgaactacataggtaattttacattttctggtagccacattaaaaagtaaaaacataaaataaaatttggtttaatgatatattctatttgacccagttatcagaaagcaatcatttaaacatgtattcaatataaaagctattaaagtattttcacattcttttttttaatatgaagcatccaaaatatgatgtgtgtttcgcactcacagcacatctccgttttcagactagctacatctcgggtgctcagtaaatacggctatcatattgggcagcacaggcctgtgatatgtctaatccagtatttttaaatgacctttgctttttaaaagcccaatcttaatttgccttgccctttcctaacctcctccagttacacgtagtatctggctcattcccttgggcacttattttaagctgtcttgactttttcattgttatgaatattttcttgacctctattttgtgtcaggcactgtgctagatcttgggggacaccaagataaataggacatggtttgcaacccactgggagaagatagacatacccataacacaacgtggattcaaatgcttgtcggaatgagataggaaataattttgagaaaaaaagacacacacaagcaagttataatgcagagcatgacaaattccagaaatgaggattaaacaaagggctgaggggattggggaaagcttcttggggaaaatctaattatgaattgagccttgagggctcagtgaaattttaatgggcagagatatgggagaacagttttgcctgtgatgatcttgttatcccaaccagatggcaggttggtgaagagtggggcattgcctcacattgcatttagatctccccagagcgccctgccagagttttgcagtagaaggtgctcaataatgtttgttgagcccaattaataatatatggttggctggcacacagtgagggagacaccgggtctgtgtgcttgctttaacctctgaattgaagggcagtctaagctttttactcattcctctgattgtgtgtactgccagtttgcagtcacagttttctcactttactaaatcggtctggactgaaactagtcgtttagagccaaaatggtagataaatgggggctaacactttaacttacatctgacctccttgtcacttattccaattcccccgagctttcaaacagcacaaacaggccacagggacaagaaatgacatgggaattagaagacacttatcagaaggtgctttccttttatttgcaactcacacatataggcctttgtttgacaatcttgctagagccttaggaatttttgtcttcattccacaggtaaggagacaggaattcagagagggtacttattcaaggttatatagcaagtaaattggaaaagtcatgactagaacttctcttttctatctcccaagtgaacgtcttctttttattcgcagttggcccacccatatcaaatgtcatcttccattgctttgtgacagatctactcaattctttggtatccacatcctacatctgaaaagtagagaaaaggtaaacttggaggtcatatgaagtatggagaagataagttagggaacaaaaaccaaagggttggtgatattaatatctataatgatattaacattcataatgatgatgataagagtcaccatttaatttttaatctatataggcaggctgtctgctaaatgtattacatatattatcacatttaatctgcacaacatacgtgtatggttgctatttttatctccgttttatagatgagaaaactgagatcaaacagatgaacttgtccaaggtcatattgctaagtagaaagcagctggaatttgaatccagacctaacttctaaccctcttaacttaatcattgcactacaaagttctggttcatgccaacttagcttagatgaccttagacaagtcgctacaacttctatttattttttatttttagagacagccaaggctggagtgcagtggtgtatcagagctcactgcatcttcaaactcctgggctcaagggatcctcccacctcagcctctcaagtagctgggactacaatcatgagccaccatgcctggcccccaaaatcctatttatgtagactgtttttcccaaaattaatactttgctcacctcttggtaaactgataaatgtgagaattatttgtaagcagcaaagtggtatacagatatataatgttgtgtgcatttaaactgaaatttctcagtcagatgagagatatataccagcaacagagtgatgtctggcactaagcaggtgctcaataatgtggcttatattcattccatgaatgaatttaagacttcctttgctgaagatgcttttttattgccacatatggaaatgggtggtaaagagaaagaaggcaggccgtatgtcagcttcctgagcaaaagtccccacacccactaatttccctacccccttaatattctagggcattaatgggatgtagctagggaagaaaccaccttagaaaaagtagagtcgaagtagatgttgaattctccaaattcttccatccatgctccacttgcatttagccatctggagagttttacattgaataatttttcttccaaatgatatatagtcattatagaaaaagttaaataaaaaaagaaatagaaagggaaaaaaattcacatcacccataatctttcccctctcccttcacccccagagataacctaaccattaggcatgtccgtctgtttctttttcttcaaagcattttttacatgtttgaattcatactgatacacgaaaggtaatactttacttttccactgaccatcaaggaatacacattttctcatgaacttacaaactcttcatgaacattcattcttaattcagctgacaaatacacatcttctctgtgccaggtgatggggacacagtagtgagccagactcattgagtttccaattgaccttatgtttaatggctgtatggtattttattgtccacttatcaattgtcccctttgggtctattttgcaggtagcaggctttcttgctagtaaaatgctccccaactgtatatccccttgataatgccctagaatattaaatagcatacaaaagaaaccagtattagcaacataaatgtgtgacaacacacacactcattgtaaatgaaatcaaacgtaataaaattgtgaattctcctgtatttgggggcagagatttcatcagttcctacttgtttattaacatcaattcttgagagttcgctatgtaacaagacaaaatccagctactcccgaacctacctttcctctttttcttattttgttgggaaatctaagttagaaaaacaatctacctgcctggttgccgtgacatgtctaaagggtaggatggggaagaggaggcacaggtattctctgtgagtttcctgagtacttggcagtcttcctacctcctcccctgtcctgttcgtcctgtgctctggagccagccaggcatgtgacacacgccacccttgcaggctcagtctctggtaggatgtgggtttttgtgtgttgtggtcctggtttcagctgcagggccttattatggaatgtataggaggaaacggaaggacctccctcccgctcacaccagtcctgtcacagatgccccaggtcacctcctggcctcagggcctgtctgcatttggaactgctggattaattttcacatcattctgatgttccccaagctcctctgaaattaggttatttaaaaaagaaggccaaagtttaaagacttctgtccagggcactgctacctatgaactggctggctatggatttgttctggaaactgtattcaatttcattttctcagcacctgccatgctagagcctggctcattataggcatccaggtgatgtctgttgaatgagtgtataccctgggaggtaccttactgagcccatcctcactgggctttcaatccagtaactgtgcacttcacaaagaaagggactgggacttattatccgggtctccctgtggtcaagcttagtgcctggcacctactgagcattcagaaaccttcttagataaaaaaaatgaattctgcatacccacacaatggcatatcattcagctgtaaaaaggaatgaatttctaacacatgctacagtatggaagaaccttgacaacattatgcagggtgaaataagccagacacaaaaggactattactatctgattccacttacatgaagtacctagaatcgttgaattcatagagacaaagtataatagtggttactagggactgggggagaaggaatggaggagttagtgttaaatgtgtatagaccttctatttaggatgatgaaaagaatttggagatggatagtggtggtgaaagtaatcggaagtaatggcaaaaaccgcagttacttttgcaccaacctaatacttactgctactgaattatagcttaaaagtggttaaaatggtaaattttgtgttatgtatattttaccacaataaaaagactgccatgaaaaaaggaaaagagaagacaaatatcccttttctttacgtctacttctctccatctgttaagcctccctttttctttcaaacctggatgatgggaactgtgagattcctctttgaagaattctcactgctgaggattggacattagtgcaggtcccactgggggctgctaagttcaccgcgtttcctctcctcagggtcccagggctgagcaggaccagcccttgttttaactgaaggcaccctggtaccttgtcctttgatttctgcagcagcaaaacaaagagccacttatgtaagcaccaagtcatgtccaaaatctgcctcacctgtccaccaagacagaagtcctgccatgatctttcctctgcctcgtcaggctctctttgcatgatggatgggcgtcatgtttcttacagccatgtagaaggaaacagattgaaaatattccccttcctgctatgaacttgtttacaagattaaaggcaggtatgcttgagagggctgggcggacactataagattatttttaataattcagagcacgccaagttcgaaaactggtcatgttgtcttttgtttcttggtttctacagtaaactctgcttacaccacctcctttccagcagaggaaaagaaaatcggtaacagaggcttaatgctgacacttgttctttattagttacaaaaaagggacacagcgggtgtgtttgtaaagatgtccacgtgtgctgcctgggtttaagaagcccccatgagtagctcatggggctcaggtgaccacctcaggcacaatttgttcctttcctgtccatgacacacagaccacattattcacccaggcctgccctttatcaaaacaatatctcttttcatcccaaggatctcataacgaaagaccaagctacaaagtcgtagtgaagagatgggatcagacagctggtgagagagaagccagcactaccctttggaggcagctgggctggtggtttgggctagccaggcttcccaagcagctgcaaaggggtggaaatcttgccctgatgttaagttttccttccctctcctagcgatgtcaattggtgtgtgtgtgtctctttgctgcacaaggtgtgaagttgctctgtgggctaatgcaagacatcttttgaattgtgcagaagaggaacttccaggctgcccagaggagggacttgggagttgggggtggggtggtacatggccttcctaaacaaaatccagagctaagaagggaaaacgaggcagggaggggagggagcaggggccaggtgtctgcctttcatctggatattcaagatgacacatctggtgccaggaaaactgctatttctaactgacggggaagctttgcagtcaagggagggctgagctgtcaggtgagctagagatcaagaattatcatgacagcttcatggcatgtgaaaggcgctgtgaagtgcagtatgattttaaccagcggtggttaaattagcttctcttggacctggtgtgatgtgcagtcggagaggggccgatggcggctgggagtgccaggcgtgaagaaggttgcaattcagaagggctaccatttagaaaagaaagcgtatgtgaaaattggctcccggtttctgagttttgcttaatagaggtgccaggcagcagtgatggcattaattagtagcttgtcaattccttcggtgaacctctcttcaccccctattataaatattccaaggacccaaagtaaccgcttgtctgaacttccccaatttaagatcttgtcaaaatctgaccacctgtactagctggctaagcagccttgactaaccgttttgccctgtgctcttgcattccacaggattgtccatgcaagactgagccagtgagggagcgagcaagtgagcgagtgagcgaatggctttctgaaaaacttccactcaaaagtgaactgaggaagtaccttttaataagtaatcagccagaggaaatcaggctctgtctagccatctagaaatgcttgcctatgcattggggactttcaaaagtctggagcaggagggtctatgatttgatggaccatggcttgggaaattctaggaagaaaaaaataatgtgagcaattctctctgtgtatgtatatatgtacacacacatacatgtatgtgttaatatatatcatatgtaaattaaaagctgtacattaaccctctgtgccaaaaattttacaaaagttcattcactttatccacataggcaaacattctgtttttatttgtaaaaactgaagtccagagaagccaataattggccagtctggaacttgaacttgggtctgtttgactccataatccatgctcttaaccgttgccttcaaaataagaatggctaacttttaaagagcctgcaggtgctcgttacgctaactggcacagccaacctgccagctcctaaagtctgggtgctatgtgatctttgcactttccccttcacagcttctgtgccaaatccgagcacagctgccccaaggcttccaagctgtaatccctgcagaaggtgcccagaagactatagtaataagaacccaagtctttttgatgcagccagctcaggacctgtctgtgcattgaaaatttgtggacgttgatttgtaacaccagggctgtgaccctgagtagcccacctgaggataacaggcaccaacttcctgtttccaaatcctgctttcctaggacgcacccagcccccactgaagtttgtgggggagtaaattgctattcacctgtccaagcctccctggatttatggcttggcagctcccttctgcctgcaccaccgtactgtgtactgcaaacacagatgaccttttcagcgatttcgtcctaacttgcttccataaagaaaacctgttttgtattgacattgtttggagtaagttctgcctatgttaactcccttagcccctgcccctggaatttcagcccagggaggccaagtgcttacaatttcaagagcaagggggagggtgctttgaaagcatccccagcttccatccatctgagtctttggtccagtggcttcaggcagatggagttgctctccttccttctagttttctaatctctccctagaaggggagaggttgcaggctcaaattggcccactggcaatagggtgctttgtgggacatttttttacaagttggttcccatgtggtatttgttagtcacagctaattattaagtcctttggctgaagcaatagacattgttcccttggattccctcctcctcctttcccccctcacccccattgctacacaacaaaacccattgtggggctctggaggttggctgtgcacgtattttccagtgaacccctgatgggctcactgctggggtttcatgtttcaggttgaaactcaactggataaagcattattcattggcactgacacattcagtgttctgctctgtgtagatatttctctcacactagacttggtccctcacaagcagtttaggtaattcactgagagcaattcactgcagttactcagaacatggataatctgcacagaactataaaatattaggatttttagatatggaaagatcatcaagtgccagctttggccagctgtgttcagaggtgcaggttggaaaggaggagggagctgagtgagtaagcaggctccaagttccttcttcccagtccccacctttgcatttgcctgctttgtgcattgcatttctgcgtaagatttctacaacctaaaagcaatcttgaaatccagtaattgagtccactctcattcattgctcaggtgaggaaactgaaccagtgaggaccttttgctaacctaaggttcaggtgagccagtgaattaatttcagcatgagaattagcacacacatctccccacttctgtatgccccatttgttatgccacgctgagataattctggaatccatcagtgggctgctttttccattgcctgccactgtcttgtggaaagaccttacctagaggatttagaggactggaaagcccccagaacagccatatcatactatgtttttactaaaggccacctcggttgcacaattccatggcacctcttggagctgtacagtacacagactaagattctgtatggagcagccttacttttactttacatatatgagagcaaaaactgaaattgtgctagtaggttttggtcagcattgtgcaagggaagaacccaggctttggagccagcagatctgggttcagatcttggctctactacttactggtcctgggaacatggacaagttacttgatatccctgatattcaggtttttaactaaaaatagagctgataatacctaccttaaaaattgctgtgaagaactaaatccaataacttacgtaaaagctctaggtaaaagcacatcaaggccatgataaatgtttttttttttttcctggaatataactgctcttcttctcatacacatatggatctgagttgaaataaaagacagacattgttaaacttcatccttaacttggaaacttctggattttgtcacagcttaacattaaccaaatgaaattttgggtctctataaatatagaccataggtttgtcttatcttttacagagcacttataaaactgaggatttcctgggggaatatggctgtggggttttaagagaaaattctgcaagggaaaacaggaaagactgaaaaatttaagccctgttcctttgcctctggaagcccctgggtgtcctgtgggttcagagattcactatcctcgctgacagcaaaatcagatctcctcgttgtaacaactacctgagtgtgcttgagacttgttaaaatccttctttattagacgtccagatgagaaccataggcccagaagcttgttttcaaaatctagcaaaacagatgcttttgcttgtttttctctgtctctctttgtccaaaatgctcactgagttttcattgggtttcgaagttgcctttttgttttgtttttacttttaaaacaaaccttagaagagggtcactgtaaaatgaaggggaaggatgggcatcccaaatgagaaaagctgtattttagactctaataaaaatgtttaagaacctgaaggtgaggaatcttaaaggacaagagagagaaagactgattctttgaactctagaagggtctacctggcattatccccaggcctccaatgccaggtgcctcccaagcaaattgaggtaggaaagagagcactaccttctcctctctaaaagcactgcatctagctgagcaaggcggtgtggctgtgttgactgaccatgtgccatatgtcagctgaggcccagggccactcccaggtccctgcattttataggcagctcagacgttgtaggtactgtaccaattttctatttctgctctatcaagtcacagcaactttagtagcttctaacaacacatatttatcttacaagtacgttggtcagaagtctgacatgggtctcactggactaaaatccaggtgtcagcagggctgcatttttttggaggctctataggaagatctgggtttttcgtaacttttccagcttctacaggttgcccacgtttgttgcctcctagtctccttcttctgtgttcaaagccatcaatagcaggttgagtccttctcacattgcatcactctgatcttcttttctacctccctcttccagttttagggacccttggggttacactgggccgacctagataatccaggataatcttactattttcaggtcatctgaattccatcagtgactttaatttccccttgccgtgtacagtaacattcacaggttccaggtattaggatgtagacatcttggagtggaggagacattattgcttaccccaggtacatacaatgattgtatatattaggactttttaagtttcaagaaacaggatctaactaaagttaataaaaagaacaagattttattggcccttagaaggaaaagttcagttggcttcaggtacagctggatgcacatgttcaacaacatcattacagtcctctcttttttgtcttgggtttctttgtggtggtttctcaagcaggggctatctataggacagataaaatagctccctggcaattccaggctcatataagtcttaagattcaggatcccagagagaaaaccctgacctcttcttagatagcaccagccaaatcctgagggtgactctcattgacacaacttgggtcatatgtacatccctaagactcattctagaacagggatggaatcagtcttaccagaagcacatgtactgagtgggaaagggagtggttctccaaaagaaactcagatgttgtcaccaaaagacggaggaaagatctgaacagacaaaagcaacaggtatccactccactatgttattactggatttcagaaccatgaaattgatatattattccagttcagagctcactaggcttcaagcaacaagatactcaagcttgaaagagtacagaagagtctcacccagagcaaggagtaaattaattcagatagtatataagaagaggaattatatggtggcaaacattgtttttggaaccagactgcctgggtttatatccaagttattaattgtgtttacctaacctctctgtgcctcagtttcctcattgtaaagtagagatgataatagtgcccacctcatgagtttgctgcgaggcttaaatgagttaatacaaataaagtgcttagaatagtaccttgacacagaaaaagcattaaataacacaatataattattctcctcatattcttatttctattataagcaagcaccccgggcatggcttaaggacttggaaagtggttaggaagcaagtctgatactttcctagtttctccttttctggctagggctacacagtctcttctctctggaactttctccaccatatcagcgtgaactgaggtttgcacgtatgccacagatttttgcatggctttcaatgaccattcttctcgctctggtcttgactatacatgtccaccaccaaatgaaagctgtgtcagtgtttctaaattcaaattcttgaaagaatctgattagtctggccagtgactggctttaagtaagtgtgcactccatttgattagctgtgattgacaaggttagggtcactttatacacaggtttacctctttcatttggcatggaaggggcaggttaaactgaaagggtaagttgggcttggccagaaaattgaccgacttgtctgttacatgtatgccttagcaaattagaatttacccacagaacaaaatagaacagttttaaagaatactgataagatctagatgtttgggaataggataacactgggaactacttagttctaatgtgatttagcctgtagtatttgcagagagaaattgatcagtctcccattacttgtatcttaaatggtagagacattttcagcaccgatcagaaatgctcaatggatggacaaagactcattcccttctacatggaacatcaatctcaaaaactcattcttggagcagaagttcctgggatggaaaaaggctcatgttcattgtcaggagagtggattccagagtgaccagggatgtccccaaatcttccctttggtggcagaagaaaagttctgtgtttactttctgtttactgtgttccttctcacttttcagagcccccgtattttttcagaaatctcactccagggtattcaaaccatcttaatggacagagtgcctgtgtcagagccctcatccttttctccaaggactttagtgagaatctttctggaaaagtagaaagattttctcctccctcctcactcctcccctcacagtgattgtgagggagaaggagtactgcagaatttcttagctgtgagatgctacaggaagggtggaaatgctttggatcggggctgggtatcttaggaagcactgagatttaggggaagacaaagcattgtcaagattttgatagaggcctgctgggaaagtctccactgtaaaggctcttgtgcccctttctagtggaacaattcgtaggctccacgcttactttcaaatggattggttttgaagcagtcaacaaaaaagcatcctgctgccagggccaaccatcaaaaagagaaaagagagcaatgcaaaccgtgggggaatgtgcgagagagaaatattgcagagcggagccgtggctctgctggcctgataccatgtgcattatctcccccaaaggaccccgtggtttaatggatggggctttaacctacccagaggtcagtctctgctggacaagtggaacctcatccctgagggcattgacatactcatgacacatggacctcctctaggtaagtgaagcaaaggttgtcctttgtcatccagatgcctttttttccaggcataatgaataatgcttcagggacataatcattttcctccaaaaaaaaaaaaaagtgaatacgaaaagaaaagtcaatgtctttaaagaaactcagtatgataattaaactcagcagttctgctgggcttacaggtgttcttgaaattaaattttttgatttagtcaagtcagggaaaaatcaaatgagtatggtgtgccacagtcttctgagcttgataatttattttaagaactgtattcactttggagtaagggggtggggtggagaaaggaaggaagattcggacctcccaatcacagggcttttgaatggcaatgaaatgatggaaatttttattcaaaggagctcattttccttttccatataatgctggaacctggaagacctttaaagtttaacatttgagctgataattttagaaaagaatcctttttataagctgaggtatttcagtaagaacttacactgaaagttacttaaggatacttaccctacaggcacatggaggctgcatccagatttatattgtctgtgtgcttcaaagcctacccactagtgagccacattatgggccaaagaatgatcagttgacttattaccttttaatttttcacgaacttgttatctgttggtttagctacagaacattcttcaacaaggactaccgccctgatcccacatctactcagtacccattatgccaggaccctttctaaatgactaaggtgtgctcaagaaattcagatgtttcacttttaatagaagactgttcgattttttctttctttttaaaattgtggctaaacacacacacatacacacatataacatgaaatctacccttttaacacatttttcagtgtacaatgctaaaagagtttcttaatcatcttggtttggagagagggaaaaaacactttatacaaatataaataatttccacaaattttcctgtggtttggagtttttatccatgttacccccctcctttgccatccctaaaaataaaaagaaaaaaaaataacattcatttcctaatgcaagtttaatttttgtagatattttctcctccaaggcacttggtgctgctctccttctcttacaagggaagtggcccatgtttcacaaagaaacagtggaagtgagcaccatggcggaggccatagtggcacattttagtgatgggggaagcaagaaaagaagagccagctctgttgcagacatgggaattatatagatttgcacaggatcagcagttcctgacttcttttaacacttcagaatcaccattcccatgctttttcatcatccccagaccacctcaacccatgttttaaaatattacacttgtcaacaacctttatcaagtcataattaactaagttccctattttacaaccattagagtagctacatcattaaattgctagctaaatattgtgatcagcatgagttacccagtgagagcatcctacagagttatcatttcagctaccttcatccttttgcctgagcagcctaattgggtgcaggcatgatttccctttggctatttatttcaagggacttggacatcttcagcagagaaacatttacatgactcgagtattatttggaatacaactttgaacagaacaaacttatcaagtcattgattttggtataaaagcaaatggcaataagagtaagtctgaattgtagactccaaggatttcagacatcccaggaactcttaatagggaagctagcatccctctctttatggtaaaggtggagtaaatgagagagtggctgtgagtagagcagagtgacagctacatcaaggagttcccaaataaaaggtcaggcaaagtcttcctaaggtattgttaaaccttagttaatatagctattgggattcttgtgaaaacgtgacattggagaggggagtggagagactggccttgaatttcttcctgctggtgagggatgccacagtgccgtgagacttcactgttatggtataagcaagatgctttctcagatgtttgcatatgaaatggaatattttcccccttcaggaaaaacacatgcatgaggtaatatgccaatcaatgtagcttaagaattctgccccactattaaaaaagttttgaaaacgctggatagatttttgctggggaccccactttcatctattttcagactctctagtcactccttaaaccccagcgaatatgtctttacagagacactaaacgttcatgtctgcagtttggcccgaaaaagcagaaagctgttccttactgcccagttatttctaaataatagaaataacctaatggcgctgtggaatgggtttccagagattacgatttagcctttcatcctacctgccttctttatgccctatcctgctgaggcgtatggattccattccaggccataatcatccagatagctgacttttgctataattgatgtcagtttttatggattttctgcattaagtgtagaactaagtggcttttactttaaaagtagtcaattagccccagcttgctggatgccactgtgaggtcacatttttgcctgtcgctggagaggacaggaccacaggagcaacctagctttccaaagctttggtcatccggaaccacaaggggtaagacttagtgtatctaaagagagctgggtatcttgtgaccagtttacaggcagctcctctcagtccttctttgaatcatcttagaagtaaactgctataagaaagatataataaaatagcgaaagtaactgaattgagggagaaagagatattatgggactgccgggaataaatgtcattgagctcatgaagaagatttgaaacccatggctgaataaatcaaatctcctacagaaaaaaaaatgttaattaacaggaagaaaaaaaaatggaaaccaaaaaaaaatttcaagaacctaaagaagacaaagtgacgagtgaaaagtttcttaaaagccattgtgagctttaatggagaggctaggattacagataatgtaataaaccttctgtgagttatggcttcctgaaagtctaaatgaaaccttacctgaagaaagaaaattaagtgtattgattgcattttgcccttaggttttcgagactgggttccaaaggagcttcaaagagtgggctgtgtggagctgttaaacacggttcagaggcgagtccggcccaagctccatgtgtttggtggaatccatgaaggtaagaacagcggaaaagaattcaaaacattttgtgcccctgtccactatctcagtctacaactaggaataagtggagtagttgttttcaaactttttagcagcgggacccttttataagatgaagtcttatgagaaacatctgaatataaagctgataaatattttatatggaccttctctcttgtaaacagagtggaaagtaggaagcacgtctggtctactaactgcaaaccctgcactccccctggcagcttctggaatctcagggctttaacgaggaatgtttgataaccactgctttagagcaaccccaaggtatacaaggagtcattttctccttaagagagttagaagaaatggtctggatattagaagctattttaagcctctatagtcccctcctacctgtaaatattgtgtttcatatggaattaacacaaagacccaggaagacaaggcattctctgaaaaatagcttaggacatgcaatgaaagatatgtaacagaagtggcgggaacctgcacatttgcaggtagacttttccttactaacctcagaaaactatttcagacttctcagaaatcatcggagctattagctcaggctgaggttaagcagaataattaaatctctcttaaataggaactggtccagttgccatttttctgcctttcaaggtaagctgagtcaggttcacagaaccgaaagcctaacaggaatcttcaagggatctgggttttctccgacctgcctttttcaaatcatgggtaactgggctttgagacagacacaaagccctctttcagcaagcctaaggatttctgtccctagcagattttcccagttacacacgcttgtgtgcaatggccgtgtttacgtgggcagccgctatattctctctagctcctgcttatggcagctctctggagttacttatgaatatgcagtcaagttgaggtgtttaaggctgtgtgcctgaggaagcaaaaaacaaagtttgctttttcaaagcccacaaattcagtggcttcctggttaggtgggtaataaagagcatattgaaaatcatcctactgaggccagagaaaattcagtttgctccaagggcaggtaccagctgagtgggtggaaagcagggtgcagctcccagagagtggatatcggcctgccctggctttgagctatgctccctgaaaaggagggtactgccctaaggtatgatggagggaacaccagtgatgggggaatgcctggaggggagactagggaggtgggacctcatatctaaactaagcaacatttctggaggactgttattctgaaaacaggtctgaattcgtgcagcatgcctatgagtttgcattttatctttgaaaaaaatcattaattacctttaaactagccagacaattggggaattccactgaagccccaaaataataaacttgcctaaaagggaggagatcatattcatataaacttgtctcacttttattcacttaagacagctgaagagggcaggaagagggcaaataccaacctcttgatggagagagataacaagactttatgaccccagaactaaacagcgcagattttaaatgcctcttttcttttcttaagagatttttccattgaccctcattaagttctccacaggctttacttggagaaattttagccaatgtggaaaaaagccttttcagttacttctctatatcttggtaattttatttttttcacagctatgtttttatatgcgataagagcctgataccaacatagaatcttagttgaagaggctataaggcaaatataaggtattcagggaaatgtgccaacttgcaaacatgctaaacattttatcatattgaaaattatcaaaggaacatatataccaaagacctagggaaacaactttctcccaataaatcacaaaaggtttatattgcatatgggaagtgtttttgcttgatctagtatccaggtaagcttaggaaacagtgacctagggtgatgtttctacacatcacttcgacatgtgattagctgacacttttgaatgaaatggaacttagtattaaagccacacaattcaaaaatcatatatggttgactttcgtaaaggcagttaagagattatttcataaataagtaaattgagtgtctacatttcttaactctcaatgcagtatcctttcccccctcacctgccccatatcccacttggaatttagttgtgtttgcccctgaggagtaatccttatattactcattttattccctagaactcaatagttaacacaaggctttgaaatgaaaatcctattttaaaaggaggaaaaaagtttttctttattctccctagtaaagaaatcacagcccttcttcaacaagtttagcatttaaataaagaaaaaaaaattgctcttagttgaaggagaagattctaccatttaaagaaaatagagtaaaattgggcagtagcttctgaaagtcattatatctgaggaggctcaactgaatttcatctcactgcccactgacaaaaattttttgttttccttgcctgacagccctacattccatcactctcatttgtatatattacagtaaatgtgacacgctctccccacaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccattcacaggctggcagatagatcgataaggcactcagtgtactctttccttccatcatgctgtcatctgtcttgccttaggtttcatctttggctgttgtaatttctacaggaacagagagactggagttaaggctgtggatttattttgggcaagtttgtgatagtgagtttggggaaaccgttgatgacagagtaatcactgcacattctcattttccccaagagcagtcaccatctcctcctcacttttgtaatgatgcccacccacaaaatgctgtggcaaccaagaggggatagcagaagggtggcgaaaaccagagaaaataaaaaagacatcacccagaagaaccactgaagcaaaacagcataatcttggatctgcagtgcaccctcaaagtcttatgtgtcagggctcattggattgtattctggatatatgttccttcctccctacctattgtggatcctttggtgcaatttctgaaaggtgttcttgatttcagtaccagcagaattgagagaatgttctaagccagaattcctgctcagagtcacatgtaaccatcttggtctgttgtagttgttaatagttattaagtatcttggatgtcaccataggctgtgttggacatttgggtccaagcttgcagagcagatgcttgagcttcccatgggcttcccagagggagctcatgactgttgcagctaacatggaccgaaagaggtgctatgacaagtggacaacacttccttgaccttctacatcagtagaagagggtgttcacttcaagccccatcctagggggttggagtgagaggtacactactgaatggaaatttcacctggttagtgtactagaagccagagactcaggcctctggcttctggaaaaacaagcctcccagagataggtgggtaatcacgatcacaagtatgtatgcccagcccttgagagtacgtctgggcacaaactaattgagctaagcacttactaaaattgctttccattttgtggaggcaggaagctacccagtgtactaaaactagaaggcagactcatttgtggataaagctttcttcagccagtccaccatttcatatgcacgagctgcctctgagggatttgtaagcactgtccagatgcccagagctttctacactgggccttacaacaacaaaatattcaaaacagctcttacaaattgggcacttcctatccgtccatcaccaggcaccctgttgaacaggttgtgtattttgtttctaatcttcacagaatcctgcgtaaggtcacataagcctcgctttacagataggaaagtaagatgtaccaaaattaaataactttccctaggaaaaatggaaggttcaaaagcagatctgtccatagcccatgcccttttaatcattctttgtctggactggataagttgatggatgccctctgagagctgatataagacaggcacggtggctcacacctgtaatcccagcactttgggaggctgaggcgggcggatcacaaggtcaagagattgagaccatcctgaccaacatggtgaaaccccgtctctactaaaaatacaaaaattagctgggcgtggtggcacatgcctgtaatcccagctactcctaaggctgaggtaggagaatcacttgaacccaggaggcagaggttgcagtgagcgccgagagagtgccattgcactccagcctgggagatgagcaaaactctgtcagaaaaaaaagagagactggcacaagcctggggatatatcctatccctcaagtagcagctcgctgaaacaccctgcaatgtggctctttgacagccgtacatggcac

SEQ ID NO: 14260 - DNA, 25377 bp, Human
aaaggagagagaaagagaaagccgactttcgctggtctgggactcagggccgcggccccacttgccggcatcctccgaaagtcgcgctcctgcgaaatgaaacctcgcccaggaggccgcggacctggacacccggcgccacctccttcacctctgacccaggtttcctcccggcgctgcgagctcccggggaagggttagagccggcagccctccccagcccggggaggggagagggttatgcgaccccacctctggctagggccggggaggcctttgcttcccgggagccctgcccgggctccttggtcgcagggctgctgggtcccaggcaggaacgagagggtgaggcccacatgtggcccggcggcccagggcggcttgcagcgtcctcactgtcccggctgccaggggctgcggcgacgcggccagtcagcagcgagttcaggtcgcgcagattttattgatgagctctgactttcagcactttccctaagtcaagaagagtctagcgtacccttcggctgcttcatttcagcctccctgcctcagctcttcagccctattccccctcgccctgtcctggggtgtgtacagcagcccaggccttccttctccttcccggctccgtggcccgaagccgccgagagagctcgggacagcgcaggaccaggcagccgctcgctctcctgtcaccttaactgcaggctccgaggggcgcctttggagtgtactgaggtgtgtcctaatcgtgcggcattcaacaaatggacttctggtgtgtggtcagaagagaaaagccatttacttactttcctccccggttttctggcaacagctgaaggggagctgcctccgtggactgagcagacccaggagagggagtcgtggtgcggagacacacgcaccacacacagatgaccggtggcacacacgacacacgctgacataccgacatcgccagtgggacacacacacacacacacacacacacacacacacacacacagagagagagagaatccctcccagcattggtcatccgcccccccacccaggcttccactccccctcccctcttatctcccctggcttcccctcctctcgggcgctgcgaaaagcagccgcacttagtcaacaaatggcacgtgggagaagttggtgagtgtttggtgaggactcttcagggcttttcacaagaaccctctgtacacaaagtaagtggcgtgtttactcgggcctctccagccagagctgtgcctctgctccgctgcgcaccgcggcttccgaaaggagaaaggagagaagaaagggcggggagagcggggtggaggatttggacaggccctggaggcttgggctggggaggcctctggcctcgtttagttctcggcccggcaacctcctctcggcctaggcttcgccgcggcctccgcagctggaatggagctgccaggacccagtgacgctcccgcccctttcctcttcttccaaggggccaggtgggctggggtgcggccgccgctgtgctctgtgtcttggggccccggctgggatggggtgggggcgggcgggggcggggcggcaggccacgctgtcctggagttggcaagaaaggacagcacagaaacttgcaccctccgaggactgggagtcccgagtccagcttagggggagtgggggcgcgacccccaacccagtaaaccttcacttgaccgctcaagttcgcggcagcagggcgggccgcgccgaatctcggcgtgcgcggagcggggagatgcaggcgagcgccagagcccgggctcgggggccctgcgccggggagaggagccgggacccaccggcggagccgaaaacaagtgtattcatattcaaacaaacggaccaattgcaccaggcggggagagggagcatccaatcggctggcgcgaggccccggcgctgctttgcataaagcaatattttgtgtgagagcgagcggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggtgtgctggctgcagccacttccctcacccacactctttatctctcactctccagccgctgacagcccattttattgtcaatctctgtctccttcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaaggtgagtccgcttctttcttctcgctttatttttattgcaatattcagacaggtctcccccttcctccccccttccttcctcccctctcgccggtcccctcccccactgctacgccgggagagttgggccggagaagtttccacgcaggagcccaaactttctacttccagcgaaagcccgcgtcggagggcgactgccggcgagcgggagcggcgcagggctcggggcgggcggccagctcagccccagcgccagcgccagcgccagcgcgggctgagctcgcgggaagaagggagactccaggcgcgacagcagccgcggctcctagccccagcgtcgcccaatgctcccgacccgcgggaaaagacgaagaggctctgtggtgcccaaggccctggaacggccgcagagagcaaccgctgccggctgctttgtccagcccgaggcccagcgaacgcgcagagagcgggcgctccgaggactcgccgagggagcgccgagggaacctgctcgccgcgtctccgcccgcccgccggccctcgggctttgtgccgcactgggctccggcgcagaagagtcagccggcactcgagcgccgaggggggcaccgcgcccgccaccagcccgagtggagtcagtcggcaaggcagccgcacgctggaggtagagggaagagcgagctagcgcgagccgggaaggaagccaccaggccaaggcggtggaacgcgcgctccgagggagctcagagccgagcgggaggactgtcagcttccacccagcccccgggctcttgcccccaactccactggagcgctgagctcggaacttgaaaactctctgctccccaggcttcccccgactctcatctcccttgccttgcggaggctggggctcttccctgttctccggccccctgcgcttggtgggtatttttccttgttttcctctgatccagtctcaccaggtgttgggatttcagcaagttttgaggtgcagagttggtttgcttttttgtttgttttactccgaatccccttatgtttttcttggtaaggccttgaaaataaatctgtatgaaagcattggccttccccctcgtctgatcacttcttctcccggctaattagtcggagtaatttgagagctttcgattctaagatcccaggaggaaaagtgtcttttcaaagttcataaagttgttgcctctttccttgtgcagattttctcagtctccctgcgccataatagccctgaattttagcaagtgtaattgggggaaatggagttgaatttcaagtggaaatgctttctttttcgagtgctaaaacctggctcttcattcatgagcgatttctagaaagtttaaaaacaaagtgaacgtggtttctttctttcttcctttttatttttcttatactctcccaagctccctaagccattctggacgtttaactcgaacttgggaaggttttagaaggggctgggagcagaaaatgaaatgaaaggcaaagagcttgagcctggcgagtttactgaagagaaataatagttgttgcggttgacattacattttttatagccagtgacctttgcaaaagcgtgaaggcagtttgattagttgttatcttatttggccctagagagtaaaactttgtcatcataattgctaattactcttttggctgggggcgggaggaccgagagctctcccctttacctcagttaaagagtttggggatggaatttgagaattaagtaattaaaaaaagaacagcatttgaaaactgaggcttgtgttggggacagagaggtgggggcagtgaccactctcttgtggtccaaggctggggcgactccaaaatgtctggagactccttcgttcaggatgtggttctatggccccagcgaggccgtacagagcctcgggctgagctggggggctgaggctgcagttgggggtctgacctctccggtgcacaggactgcttccgggtgtcgatgtgccccacttcccgggttgcttctgcacttagtgttcacgtttacttaagtaattagatagcttcttagcgagagggaagtgggaatggagcagaactggaatttgaaatactaccaccttcccagctgcttcgaaaactaatcaacgaggcctctttgtgctcagctactgaatttaaaaaaaaatggtatcaagaagttacaagccaggatgggagcattctgttgtgattgtgcacagcgtgggttacaaagtggagttctggaagttttacccctcctaggggaattccattccccatctccccacctactactcctttgcagcttcagggtcctgcatttgttggggtggggtattttgcattagagttggagattttgcctatccagggcatggctatgggtgccgggactgagagacaggaaggaagcattggagagccaacctagataagggtaactagtaaccctctgctgtggccagtatttacccaatgctgagaaaaagtcctcattttcggtttatttttatggatttaagctgtctaccaagtagttaaaaagtagaccaggaatggccttgtagagtaaaatgtgcttcttgaaattctttgcttgcaggcaggcagatcaataatcaccataggtaaaacagaaaaaataatgcatttaaaaaaaaacagagagaaatgatgctgtgactgttttgttattttacctctttttggggggcagacctcttgaatgggctctttattgtaactctctcttcccaattgagctccccacggtgccgttgtatctttttacagcccctaacaactcacaccagtaacacaattacctccagatatttacaacaagaaattacttttctattttctccactcacccaaaagactttttttttttttcctttgggaaaggtagggaggtgttcgtacgggagcagcctcggggacccctgcactgggtcagggcttatgaagctagaagcgtccctctgttccctttgtgagttggtgggttgttggtacatttggttggaagctgtgttgctggttagggagactcggttttgctccttgggttcgaggaaagctggagaatagaagccattgtttgccgtctgtcggctttgtcgaccacgctcaccccctcctgttcgtactttttaaagcagtgaggcgaggtagacagggtgtgtcacagtacagttaaaggggtgaagatctaaacgccaaaagagaagttaatcacaataagtgaggtttgggataaaaagttgggcttgcccctttcaaagtcccagaaagctgggaggtagatggagagggggccattgggaagtttttttggtgtagggagaggagtagaagataaagggtaagcagagtgttgggttctgggggtcttgtgaagttccttaaggaaggagggagtgtggccctgcagccctcccaaactgctccagcctatgctctccggcaccaggaagttccaaggttcccttcccctggtctccaaacttcaggtattcctctcccctcacaccccttcaacctcagctcttggcctctactccttactccactgttcctcctgtttcccccttccccttttcctggttctttatatttttgcaaagtgggatccgaacttgctagattttccaattctcccaagccagaccagagcagcctcttttaaaggatggagacttctgtggcagatgccgctgaaaatgtgggtgtaatgctgggacttagagtttgatgacagtttgactgagccctagatgcatgtgtttttcctgagagtgaggctcagagagcccatggacgtatgctgttgaaccacagcttgatatacctttttctccttctgttttgtcttagggggaagactttaactaggggcgcgcagatgtgtgaggccttttattgtgagagtggacagacatccgagatttcaggcaagttctgtggtggctgctttgggctcaaaacccacaaacagtcaaaacaaactatttcagtatgcttcttcactatagttcagatagaagaaaataaatcaaaattggggcatcgcttctactgattaaagggttaactgctaaagaatgtaggggaaacagattggggatattccagtactttgtttcaagccccaaagggtagattttgtatgcactgcagggcagagctgagtgaccctcagatcgccccaagaggttgagtggatcaattcctaaagaacggagattctcctgtcctagccccaggtccacctcggttgggagttcaggcctacctgatgcagctgcccgaggattaactcctattttcttgctaacagagccccatattcgagccccgtggaatcccgcggcccccagccagagccagcatgcagaacagtaagtgcctctggtctttctgggacttcgggctcggggtgcgcggacccgagggtcaggggaggacacagggactcgcgacgcccgcgctggcccggccgccgaccgactgaggcccggggacctgcggcggctgctccccgctccgcgcccggcagcccgggaggggagggcgtttgcttggctcttctcgatactggagaagcaggggctgggcccttaagaacagcccgcccgagttttcgaagctgcggtagagaaaccccatcccccccaaatcctgtaactcacaccccctcccgcccctgcccgggctctgaccccggagagaggggctgggctgatcagggcggggcgaagtcttctcctagttgagcgagaaggaggcccctttgggcttagccaagactgaaagtctccaccaacccggcggggttgggggcttctctccccaagtcactctcagggcagctcctcccctcctcaccccacctacgggcctagaagggatggggagaggagcccccaggcctgcagcagggtaggggtggtaaactcgctgttacagggcgcgggagagagcacggtttactgggtctggtaaggaggtgcccaggaattggaaaatccctgccctggcaactgcaattgcttgggtcctgatagtcccaggcccagagcgcttttgatacttatggcccttgtacctccctgctttcctctgcccagaccccgtggggtcccacccaccttcctgttcgtggtgggtgctggtacgcggcagggctagtctagagctccgacctgggagcctggaggcccagcgaaaccaggcccggtttgaggttacggttgaggcacacggcgtcggggctcaactgaactcaaagtgtggaaaggcccgggtcttccagcagcctgccctggccgaaccacacaggcttaaggagggtccccagcaccttatccatctgttttggaaacgccggtcgccccctggtgcttccggggctggtaagcgcgtagctgaggaaagggcacaaaggtggcgagctttgcgggagtagttgtgcagaacctgccggaccccagggcttggccggtaggctcgccttcggcggctgggctctccccttggagctcagactccccagccgcaggctgtctctcgggcgggccccagccagggcgcgcagccctgagcgtttgtcgctgcggcccggctggcaggccccgaggggcgcggggtcgcgggccggccggcagggctttgtgccgctcgttcccgggtgtgcgcgaggcgcggagcatccaaattgacaccatatgttttcctattagttgcttcgcggtcgagttctaggcgcataatcatcgccagtgggcgagagcgccagcagtccctagggaagggacacaatgattgaggcttaacctctgaaggggaatttggagctgcgctttctctctgccatttcgatgctgggagtggcgctctggccctggcgtctcctgggcaagcaccagccggcggtatctgcggaggtggctggcacgttgttattttttgaaatgagtgaggagggaggtctagatttaggcggccttacgcgcccgccttggcattagcagactgggaattgccgtggctatgcccgaagtttggaaagtctctctcggtctctttctgggacagcctttctttttccgggaagcttcctgtgcctagaggtggggctctgtagctggaggggtagatggaacttgcgaagcaaaggaaggcaataaaaggaagttaggagaaaccggaaacgtgggccaggccttgctctgttggagaagcggtgtccccgcaaagtccctgcttgcgctggtcccggccggagcccagatcccccaaacgcctgtcacttctcatcgagttgaggctccggcccccacccgcgccttggtgagggccccccctcagccccaagccttcggctaccctgaaaacgcggctcccctcgaaggggaaacaagtgcagttcaatctcgtctgagtgatctacaaataaggacggaaagggtcgttttatcacggtcccgtttgtcgtgacgatgcaatttcccggagcggagcactgtcacaaagtgacaaggctgccacaagcgccccgactgatcttttcaattagccttccatgcatgatccggagcgacttccgcctatttccagaaattaagctcaaacttgacgtgcagctagttttattttaaagacaaatgtcagagaggctcatcatattttcccccctcttctatatttggagcttatttattgctaagaagctcaggctcctggcgtcaatttatcagtaggctccaaggagaagagaggagaggagaggagagctgaacagggagccacgtcttttcctgggagggctgctctctaagtcggggctgcaggttggagatttttaaggaagtggaaattggcaattggctttgtgtgtctgtggtttttggggagggggactacaaagaggggctaactccctctccctattctctaaggttggaccacagggatgaggttgtgagatacaaagataaaggagggatggggaacactatgatgtggtatttttcttttctgttttttctttttgataatatctatccttggctaaggggagggcggagttcagcggcggaaataaagcgagcagtggctggtgcgaaccgactcccggctctaagccttacttgcggtggccggacttgtctgtggctgaagccgagcccgggctctgactctcacgtctgcactggaggtgcggaaacctggactggggttcaccagccacatactggctgctctggttgttctctcctcttccttcttctattctaaccaaacaaaacccaactcgatgcttgtgccaggccttggccagtttggacggtgatggaaacatttctggattttagcgtctaagggagcactcaagggctgtaaggtttgctatcactgtcccaacactgcagagaccttgaaggttcagtgtgggatctgtagaacccatggtttgcggtgacactcagaggggatctttgggagatttatagagccggttcttagcgctttgtgggttcagaggctggctgcagtgtttatgaagaggggcagtgggctggggacactgctggggttatggctgtagtgaggtccatgtgtacttgttccttggcatgtgtctgactctgtgttgctgctgcagtacagtgggcaggggcacggttgcttgggactgggctgcccgatgtctggcatggctggtggtcctgttgtcctttatttgatcgatagcagggaactgaccgccgaggttggcacaggttggcagggggatgaggatgcattgtggttgtctcctcctcctctccttcttcctcttccccttcctcctctcctttctgttcttgttctccctcatcttcctcttccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaattctgcaggtgatcctcccggcgccgccccactcgccgcccccgcggccctccactctcaacgccctctcttcatttcttactgtaaacgatgctaattatggacccccccaccctcacccaccccagtccccagtccccccacccactcccctgccttcccactttcccctctccttccaccatccttccctatctctttcaacctgggtcagttacataagataactcatctgcttcagaaaaatattgtgtgcggatttttttaaaaaaatctttctctttttatttggtaaagacattcattgtgggaacagtttatgaaccgtaataagctgagttatataaaccggcataatttcattctgctctccccagcccatgcttacctcagcttttgaggtatttgtttattcttcatgtttatgaataatatatattgattttaaaaggcaaatgctatttactcctccctaactcacatttactcaattgagtattttttaaagaagaagaagtaaaaaaatcagtttattttttacctttgttctttaaaacataacgccactttaagcaaggtcagcacaaaaataaatttatctacttcgttttgatgcatcttcaggcagtgtttaagaaaagttttttttttaaaaaaagcttttaaattcgttttttagttcaaattgtttgaaagtatcatcatatttgtagtttttagggctacaaatgtaattttaagaaaaaaagctctctacagtaagttctcataccattgaaggtatatttttgtgttatagacccatgcagatgcaaaagtccaagtgctggacaatcaaaacgtaagcttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtgtcctctccctgctccacatttgtctcctttgtacctgggggaacagagaggaatgccctgacttttctttgactgtctggaaaatgggagtcaagtgtggggagtcattcacttcatttgcatgctgcaaaacagagggcggaggcaccagggaaaggcacttgaatgaagaaggaaaatgagaaccagattgtaacttcgtcctaatccacctgccagaactttccttcaggtgtcacacatccatttccatcctaatattaaacaatataatgaaagaaagctttacaacaagtctaaatagtttttattttcgggcagtcttttaacaaagcaaagcaaccgtgtgagttaggtcaccagagacaccaagcaatggtgaaggaccccctccgcccaattctctatccaactaaatttccatgcccaaagtgatagctatcattttttccacggtgtatctgcaaatccacccactgtcccggggtggctgggagctttttaacgggttgagagttgctttttaaggttgtgggtgagctgagatgggtgactgtgtcttcaggagacactaccatttggtttgattttggtttgatttgcaggtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaaggtaaaacccaagcagccatccacgcagctctccatatgtgcatccctttgcctgtcccctactctcccaaccatttcctctcagggcttccatgcttggggaatgtcatgggtgagactgcatttgaaggcctgggacacatcgaccacattgtatgtaggtggtgtttgttgaaccattttgttggcctgggaatgtgagggttgtgtatgtcaggagcggtatgaaggtggctggtgggtgcgtgtgtgtgtttgtgggcagcactgtgtgcataagaacgagctgcgtggtgcactattcaaatttgacattagaatgcagggagagcccccttgtagaagtgtgacaagataacgcactgacagactgcgaggttaacataattgtatcctgttgctttttgctgtaattgacaaattatgtgactatgagtagggtgcacatgaaaaggtgagcagggagatgcagggcgagtcggggatggggcattggaagtggtggtctcccaactaaaaccaccccactatccttgcccctcccccgttcgcccctctgggtcccactttctcactctctgtgggtggcgactatgtggaagtggtgaggtgaagatactgtgagcaggacggcgggatgccgggagccgctctggtctgggaggagagatgggacctgaaacaccccaggttctgtgagaagggctggaggaagaagagcgggggatggggggggtggggcggaggggagggtcagttggctcccctccagcccccctccacaccccgaggtagcttggtcaagaataggaaacagtttactccgaagattaatcggtatttgttgtcctcgtgacaaggagataatatgcgggataatgggacgtggcgtctcactcccaggagcacaacggagccgaggggctcggggccaggggcggcgcgcgggactgcgaggaggctgccggcgcatccgtgagctctcggaccggctccggatgcccggcgcctccatggagtcgggcgagggaagggaaaatcggtaacagtatgcgaaatatctggtacaaaggatgcttctgtcactcgcaagaatttgttatgggaacaatcctgtcgctctgtaattgctcattagagaacgttttgtttctcattaaggcgacatgaataagcgtctagttgaaggagacagctgtagaaatgttccacaagagacctctggacacgattcggcaccaattgccaattagacatgtcagttttaagagcagaaaacaatataggacggacactgggaagatagggagcaaagcgctcgcttcttgtttcccagcgcggccgctcggccggcggaggcctcctgacgcgcggggcccgggctcccctgggcgaccccgcccgcacgggccccgaacccgccgcctccgcgagctcagagggcccccaggcccgctcccgcctctggtgagactagcgattgaccccaccgagtgtaggcaaccccatccctgcctgacttttgaaaccgtaggattcccacttgtagacactggacacacccaagtgacacccgaacttcgcactcacgagcgtccacccctccgcccccagcaatctgaggtcctggtgatccctcccctgacaagagtctggcccacttagtccgagaagtcttggggagggactcagggcacggtggcctaggcctgggagggctgagcccagagcctccactccgggctctccccggtgcgtgggctcccatgagcttggggcgcaggatacaccccccttccgcttcttggagttgggcagaagccgaggacagcagcttccaccagaggtggcgcccgattcgggcggattttcgtcgccggcagtctgagggcgggaagtgagagtcaaatcagctagggtccgcctgtgatggttggggccggaggtggagctagtccaggggcttttcactttaacgcgcctagttgctagaaaattctgggtcaactggcaatcaccacccccccacccgcaagtgaggtttttggggggtgattgtcacctcaggcacaggaccgtcgcccctagttgcgtggggaggacacgtgggccaaacgaagcacagagttgccggcgtgggggtagcgggcaccggtggtgagcttcgcttcacgttcccggggaatcctcagactttttggtgctaagagggtccccctccctccctagccccctttcccagcccaggaagcctttcttgggttttaaagagtccattactccaaaagcataaggcgggggttaggtctcagagggagacaaatatggtttccatctgatcaacgccatgcggcggtgaataaaatcgcgacgacgtgggctgacaacaacaagagacaactctatccagccccaattctccggcgatttggtggttttagggatcacggagacactttttcttatctcctcccctcaccccacccccaccccccataatacccaagccctctataggatttagtcagcctctctttcaacagatgctacaatgttttgatccgcgctccagagctgaaaaggtgccgcaaccgggttgctatcttttcttgcttgttttccgcctcactgattaagacactaagaaactaaggaatgattttatttcccagcaactctctctctgtctctctctctctctctctctctctctcacctccttccaggaaacaaatcctattcccatcgtcagatggtcctggggctgggataatgggaggcgctttcactcgctttctcacggattaggctggaaggtgaacggcacccactgaaggcccctgctttgcgcggctccgagggggcgccttttgaagaagatatcttaattgtccaccacttaggtttatcctgggggtgggggagtcgagatccaacttctagttttattttgttaaaagctttaagagtggaaggcaaatccactaaagtggggggaaatgtacccattttatgtaagagcagccgctaggtcaccgcctggctgcaaacagttgccacttctaaagtaatgaactgtctccgtgccgctctccccgcggggtagagaagggatcctgcagcgacaggtttctttttgctgtggaattccaatccccgcttcccatcttttttttttttttttttttttccagatttaaaattgagctctactgtccctgctgacttttctctcttaagtgtcagttctggaggcagcacagggcctggcggcgatcgcgtgctgcctgtgtaaacccgtgtgtatgtttgtgtgagacagaacatggataagaatgtgaatctccatgttttaaaattaagaaaatgtcaaagaggcaaatgagagcagagcatgctatcggcggggttcttcggaggcagattcgggcaactttgtttaattggcgagatcgaatgtgccagaaaagggaccgagatggggcccctaggaaggcatgggcatgagtggccatggggagatgggcattgtgttctcctcagtgtcccccaccccataccagatgtgcacagatttttgtctgttttccaaaagcaataaccctccggcctttctagttggccaaaaggagctatttccagtcttccttcttcaccaaacccgaaaataaagcgaggggtgggggtggtcgcttcatttcttcccttgaaaaacgctttgaaaagtccccggaaacttggggcagtaaattagcacagacgcttgtgcccgcacacgtgagcggagcgcgtctccctcagctaagtagccctcctcgacccccacctttctgatggagtgcaaagacccagagtccagatggggctcagttactaatattctctggccctcatcctccttttcctctctctcccactcttgttcggccctcgtgtctctttttcctctcagcattcttttctgtccttttttaaaaatacctttctagcctctatgttttttgagccttcttttcccctccatcgccctctttttccctccatcgccctctgtctttcccctaacccaggccccccaatccttcccccttgcttccacccccaccgctggtttccatcctgcctcccctccatctcctctatgtaggaacccagccctggtccccgtccactctccctgcctccccccatgctgggccctggcccccccatccaccctccatccccccagccaagcgccctaaatagcacggaggcgcccgctcttcggacagtgattaatgatagcagagcagaggggttaacacacttcactgaaaagtctgttgactgggcttcttgtaacacaatgtggcccgctgcacgcctcaagagaatccttttgttgtccgcgctcattgtagcctcaaaattctgcccacgaaagtttgccaacgctcctgccccaggagtttaatagtttcccttactcgcggggcattgtgcagcgctgaaaagcagcccctcgctattcaagtgttggtggtcatctcaatagatctccaagggcccatatggtggccagtgccgatgaatccgcctgtttaaatgggggagaaagttggggttttaaaacatttcaaagttcctgaaaagatcccactagatcctgtcacaattccctgaactctttgaaggcgcagcctattgtctcctggttataaataatattcctggccaagtcgattcccaccaaggcgctcctaggggcccctccaccccgcctctggccaagttttgaggatagggaggtgggtagcccatgctggtatcccttgggggtcatttcaggaccccagacccaggacccagcctgtagtggccctggaggcccagtcagagtttaggcaatcctgcttcccttcactgtggccttacaggcaaggtgcaagccgggagccagctagcccaagtgcacatcttgccctccaggcagcaagggaaaaccataaaactttccccctgtataatgatagaagttacattcaaagtggtggaaatgccctaattaaaaatgtaccacttaaatgatatgccaaagattcagctgcagcatagaatatttagctagttagtgaactctctactatttcttttttaaaattacacgttaaaaatttaaaagaaatcttacttttctctggtgcaacacattacaaagaatggacagtccttttatctaaatataaaattccattttcagcaattatagcctgttcttggtgatgatataattacagctgtgctcgtaataggtgtcaaggcgaagcgcactcatacaatagttgaataaaactgcagaacaatgcgagcacttctaaattcacaacctttaaatgaaattgactgtgcagaattcaaataaaaactagataaatattttttaaaaaagattacaagcttggtttggtttcttaatagcattttctacaaacctatcaacatctaattgattagataggaattactgattatagatcaactgaaatcttgaacatcactcttctattttcccaacacagccataggtaaagagattctgtagggagtggagtgaggcatttggggagttggggttacttataaaagatcattttaattggaaacttcagtgcttattttttcattcaagaaatgccacttagtgtgtgtattataaagtctcatcttgataaaaacaaagaaaatggtggtcaggtaactaacatcgcaaatgtatttttttaaaagaaggctgacagttaccttgggaatgttttggtgaggctgtcgggatataatgctcttggagtttaagactacaccaggccccttttggaggctccaagttaatccaaatttctcttaccatcctattctttttgttccagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaaggtgatagagtttttcaaagtagagaagcagtaaatcaaagtaaatgccacatcttcagtacaaagagctaaatttagccagggccctttgcatagaagaatgaaaagatttccttttttctgtctttttatttctctgggcatcttttcagtgtgtgtgtgtgtgtgtgtgtgtgtgtgtgtgtgtgtggtgtgtgtgtgtgtgtttcttcttttcatctaccagtaattcaaagactaaatgtctgacttataaggaaaaatgatgatttggctatttcaggccacagaaaggtcactgaatgccattccaaagaaaatttaacttggttctggtgggaaagttcttccaagtacagtcaacactagaagcattttaaagggaattggttggaggtaatgggagtggggaggtgggaaccagtttgatgcacagtttggtcaacatattttgtgtagttctggcacaatatggaaaatcaacttactctttcagagtttgagagaacccattatccagatgtgtttgcccgagaaagactagcagccaaaatagatctacctgaagcaagaatacaggtaccgagagactgtgcagtttcacactttgtgattcataccatttgtctttcctagagacagaggtgcttgtacagagtactatttatttataggactaatataataaaaaggttcagtctgctaaatgctctgctgccatgggcgtggggagggcagcagtggaggtgccaaggtggggctgggctcgacgtagacacagtgctaacctgtcccacctgatttccaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccgggtaatttgaaatactaatactacgaatcaatgtctttaaacctgtttgctccgggctctgactctcactctgactactgtcatttctcttgccctcagtttcctccttcacatctggctccatgttgggccgaacagacacagccctcacaaacacctacagcgctctgccgcctatgcccagcttcaccatggcaaataacctgcctatgcaagtaagtgcggctggtggtggcctgcataacccaggccccagagaagtgaggagtggctcagggcctgcggacctcattggctgtgtctgcacccttgagagcttttcgcactacagtgattggcttgaccagtcaagtcggagacagtcaatcccatcacttttaagtgattgactcattaattcatgccctaaaaaaatgagtaataaaaatctgtccagttttgtcaggttgatctgccttttattatactgttaccttgataatgttgggtggtggtggggcatgttttgggtaccagggagccttgcaccagaaagtggaaataatgctggcacattatcagatagcagattagtagtttaaaatttgggtttatattaatgtgtttgtatgctaaatatagaatctgtgcacgcatttggggcattactttgggtatatgtgataaactagtgagaaagaaaaaaggatcagaaatgggattcatatttacatggtgagatatacataatataatgagaatgctagttttctgtctgtatctacaataagaaaaggcatagcaggtatttgctggaaatttagtgtgtctttgctgtgaatggtgtgacgagtttgtggccctcctagctgcctgggaagcttgatgctattcacttggtatgacagcctgcctctcctcttagttctgtcccaaatatctattagcccctacatttagaggtcctgcactaggttcaccctttatgatgtaagttggataaggcagatggtttgtactagacctttgttgctggatggattcttgataggaaaaatgtctgtcttctggtaggcctttcccagtggttttcctagaactcctgtttgtgcaacaattagagatattagatggtacgatattggccagcatgagcctctgctggaaacagttctggggctacactgattgtttattctccattgaacattttttgctggatttcaaatccaaataacagcaaaataaatgtttcacagtcttcagactaatataggagcagctagataagcaacttcagaggaattattcacatgtttatttttattgcatctggatattgttggccatagtgcaattgatgtaaattaagggattaacagcccattagttggtgttgctataactgcgttggaattttccagaagtcaggttgcctagaggaactcattgcaggaattagaaacaaatgcaagctgaaattctggcagggccctcaaggcctgtttgcctctttgaacttgatgttagcattcatcatctgactttaataaggccacagagtgtctcgttcagtttcatgtattataacaacatccaggtttctgtgaagatagcaaaatgtgtatgtgagaaaataataagacgaacaagtagatgctgcaattatattagggctgtttccacatacagagcggtatggggaatcaatctatttcaaacactgacttttaaaaattacataatttgtataattcaaaaagtacatgcattcattaagcataaagaaaatcaaaatgatcaataactttactcttcagagaaaactactctttgaattttggagtgggtgagcccgattgtctatccatttattcattctcttgaccaaaatcatcattttacaaatggtgggtgtcttcctctggaccttctctgatatgcttccctctctgagcatatggattttggaaattaaacatttctccagtttgcagagaagagaaatgatagtatactgtactatcatctgacctgcttgttcccgacacacttcttttaattcatcccaagtttgctgccatggcatagtaccatgagagctcatgaggcgttttgttaggagaaaggtttacctcctcagtgctgccattccgaacagttcgagggtagcaacagttttctagttataagtcagtctgggcttttgggtctgttaggaagtcatggttaattctcaggatggaggtcgttatatttactaacacttctgatcactttaacttggggtcattacagatctgcttcttcaaagaatctttaatcccatcagtgaaaggttcccaaggtccctgaaccatactttactgagagctcctcccactgctctctgtcccaaagcttgagatatgggctctgggggtcatagggttcccaaataaatccagatttgcagggagaggggatgtgttttgatgaaggtcctcatgctataggttcttcaaagatgctagcagaggttagagacaaaaatcctattaatttatggatagtggcaaccatctagctggacagttgtcagaacctaaagtgctttagaggcttgatacataggcagctttcttctagctgtggccagtgaaaggactagctcgaggcccaatcttagatttatcatatggaattccagtacttcacgtgaaggcatctttaatgatcagacttgttggcagagttcctcgggaggagggagcctggggctgtggctgtgtgatgtgttcctcagtaaccacaggtttgcctctctcctcacagcccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggtgagccactgctttctgcaggctgcacagaggcgatctctcttcactagaagtttacccaaacagaatctcctggtcttatgggagggcgtgtttaactccttgctttccttgtccctgggggatggggattgaaaagggaaattcagttaagctaattagtaactttacaccatatagacaaaaactaaaattgtttttcctgaatttggtcacaaaagttgtgtatgaagacaaggcctgagactgcaagttttctgaggacagattattagacgaagctcagtagggggcccactgagctgtaggtgcgtgcttgttgaaatgcttcttgccctcatagctcctctagaccttttgctggaaataaaaagtgacacattggttttccagagacagctttattgtaaaagttccaaacatgcaaacaaacagaggatttttttttcttttcctttggattggggtggggggtacttgggatccaataggtatatatacatatattgtctagtttctgaaggtgctacttttatttgtaacaattgaagtgattttaatacagtaaaaaatgttagaaagtattagtttttttttttttttttttttttgtaaacctataaatttgtattccatgtctgtttctcaaagggaatatctacatggctatttctttcatccacttctaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagctgggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaatt

SEQ ID NO: 14261 - DNA, 25377 bp, Human; identical to SEQ ID NO: 14260

SEQ ID NO: 14262 - DNA, 37117 bp, Human
cctgagtagctgagactacaggcgtgtgccaccacgcccagctaatttttgtatttttagcagaggtggggttttaccatgttggccagactggtctcgaacttctggccacaagtgatccgcctgcctcggcctcccaaggtgctgggattacaggcgtgagcccccgcacccagcctcctatgtaacattataaatttattgtcattacttgtaagcctgccctttattttaaaatacaagatatgacaagatcagaaaccagtcttgtttctccatttctttctctagaaataattctttaggaattcaaatccatagtaacaaaaacaaaggaaaaaaaaacatgcttttttttatataatgaacaaaggttaagaaatgactccaggtctcttatttattttgttgatatttgtgttggttagttaagaagatgatttgctcgattatttcaacatttatttattcaacaaactgtggactttggagatgaacagctgaagctagaatcctgactatcccttaatagctgtgtaactttgggcaagttatttaacctccctatacctctgtttcctaatctgtaaaatgaagataatattagtatctaactcatagggttgttgggagggttaactaagcaaatatacaaaaagctgagaatagtccctggtatatagtaagtgctcaataaattatggatgggaggatcctgacccacatggagtttacagtcttggcagtatggatcgggcaggtagaaaaagacaccaaattacacagccaacagcatctttataattgtttttaatataggaaaagtatagggtgctaaagatcaatttgtggctttcttttccaatgaactgctaaagttccacttttatgcccaagattcttatcatacttttgtaagatcaagaacaacatgtgaagtttccactattatatatccacccattatatgtagttgtactggaaaaaattaaaagctgataacttttaatttgaagatgatggtatatactatgtatatatattaaggtgcttaaagataaatcctagcacctgaggaggtgtagaaatcattcaaactctttgattacaatgacaaactagtcagtaacttactaaatattgtactatatattactaagtattttactcttcaacatagctttttaaagacacaaagcttttcaaaattcctgcttacctgggggtaaaatttggggaagcagatttctccagtgtttaaagaagccaatttggcagtgtaccagagttgaatacatttttcccatcacaagggaatacatttttcccatctaagttaagttgtttttctctggtaaaggaggaaatcaacacccatctgtacggagataaacgtttcagagtgtttttatattaaataattagtatactagtctagtaagtgataatccacgaataagttaagaagagctaagaaagaaaaagaaaagcatccatccatcctttggttgcaaataatacttacattagcgtatggcaaaatttaattttgtacagagtaatttaacccaggattgctgactttttaagagctgagaaagcatagctatggagcgcaaggccccacccagcagggtctaagtattccgtctgcaaaactggcaggccaccaacggccgcgtcccagggcggcctgaaggatgctgataaccgggagccccgccctgggttcggctatcccgggcaccccgggccggcggggcgaggctctccaattgctgggccagagcgggacccttcctttccgcaccctcctgggtatctccggtcttcaggcctccttcggagagccctgctccgagcccattgggcttccaatcttggcctgcctagcgccgagcagccaatcagaaggcagtcctcccgagggggcgggacgagggggtggtgctgattggctgagcctgaagtcgccacggactcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttcccccggggcggcgcttggagggactgtaccgcggctcactgggcaggggggatccccttcggtgcagacggacttttacattcgccgaagcaggggaggggggtccgggtagtggggcgcgggactgcaggctttgttgtccgcgacaggctcgggtggttgcttcagaattttgcacttttgccaactgggacagaggtcgcagcttgaggacagattgagggctcatggggaaagaggcagagagctgcagctgcaaggaagtcagtgaggggagaagtggaaccaggctctaatggtgcccttcttgaaatactgtttacacgctttcatagttgtggggtcccagcagggcagggattgtgttttacaatcttgaggtctccagcaccagtcacagtgactggtacgtactatgcacattattaaacgactaaataaaagaacttttacattcattgtctcatttgcacttcaaaatgtcaagcctagcattttagagctggggggtgacattagggattgattaatgcgtttattctattctttgagcacctgtaggtgctaggcactgttcggggcaaggtgtacaaattccagtgcggcaagaacaacacccttgagaagctgagagtctagtctgggagacgagacacataaacagatgattacactccagcgtggtgagggctctaatagaggttatctgtagaatgtagagggagtgaccaggtgggccggacaaagcaggtgacatttgaacaggaatttttttaaatgagtaggattttaacttggtggtgggggaggcattcctggcctgtgcccacggctgcagagtctcagagggcatctatgaggaggttggattagatgagaccacatctggtctgagtctactgttggcagattggcccagggagtctaaaggtcttgccctgttccctggctgctggttaatggtagacagaggactgcagccctgttttccctattctgcctagtgctcttgctcaaaactcaggttcgtgaactggggtattaatgctaagtgctcatggattgctttaatggttccctgtttgggaaaaggctgccattctcctccaagggcctggaaaatctcccctcttggccctgttctttgttatataccattaggttggttcatgagctcttaaagtaaaccagagagaggtagagtcttagtaaaggatgtgccactacttagtggcagagacaaggttagaattcagcttcttggacccaagactctttccttacccagtgggtgcaaatcctggttcacactgaagttttcatgaatactcggtgaattgagaaaagtgtggacaaagtagtgagatttttacaaaacaaaatattttctttttctttttcttttcttttctttttttttttttgagacggagtcttgctctgttgcccaggctggagtgcagtggtatgatctccactcactgcaaactccgcctcccggattcaagcaattctcctgcctcagcctcccgagtagctgggattacaggtgtccaccaccacacccagctaatttttgtatttttagtagagatggggtttcaccatgttggccaggctggactggaactcctgacctcaggagatctgcccgccttggcctcccaaagtaccgagattacaggtgtaatattttcatttttaaaggactcccctttattctgagactagctgccttcttccttgtttgggagaatcatgaactgttgaagtccctgctgttgatttaccttacatagttgcccatgtgagaaatggctgactccaaaacacatctatagttgggaggctcttaattgaaatacagccatcccctttgtccatgacatctcagggcactgtgtacatcgtcctgattggcagtcacattgatgtcttactgttcctcagttttagctgctcttagtaaaaaccgcttacttcttttaggcacttctccctccacccagggccctccaaaaggaattatgcatatgccttatagcctatataattttcaaacactttttttaaatgaaaaatttcaaatattcagaaaagttgaaaaaattttgcagtgtatatctatatatctgccatctagattctacaaggaacattttgccctgtgtcttttattacgttactccatctgtctgtccatcctttaattcattcaagttgtttcatgtattagcagtttgttcttttcattgctgagtaagattccattatttgaatataccaccatttggatatcctgttgctggacacctgggctatttaattttttttctattgtaagtaaagctgctgtggctgggcatgaaggcttatgcctataaccctaccacttttggaggctgaggtgggaggatagtttgagctcaggagttgagaccagcctaagcaacatggtgaaaacccatctctacaacaaataaaagaagtagccagacatggtgacacatgcctgtagtcccagctactcgggaagttgagttgggaggattgcttgagcttggggtgtggaggctgcagtgagccatgattacatgactgcactctagcctgggtgacagagggagaccctgtcttaaaaattaaaaataaataaagctgctataaaaattcttacataagtctttttgtgcacaggtggttttatttctcttaggaaatacctaggagtagatttattgggtcataaggtaagtgaatgtgttatgagaaactgctgagcctttttccaaagtggttgtaccattttatacttcatcagcagtgtatgggagttccagttgctccacatcctaccaacttttggtgttgtcagtcttttacatttagttgttgggtgtgcagtggtatctcattatggttttaatttgctttgctctgatgactaatgatgcaaagcatctttttacatgcttattgaccattggtatatattcctttgaagtatatgttcaaattttctgtctttttaaaaattgaattgcttttaaattattaattcatagcccatattttaagttcaatcatgtggaatcatgtgtaggctaagtgttataataataaatctcaacatgtatcatggtataaacatattagaaatttatggccgggtgcagtgactcacacctataatccagcactttgggaggctgaggtgggcggatcacctgaggtcaggagttcaaaactagcctgaccaatatggagaaaccctgtctctactaaaaatacaaaattagctgggcgtggtggcacatgcctgtaatcccagctgcttgggaggctgaggcaggataatcacttgaaccctggaggcggaggttgcagtaagccgagatcctgccattgcactccagcctgggcaacaagagtgaaactccatctcaaaaagaaaaaaaaagaaatgtattcctttcctacatgaatggcccaaagtggtttgaggttgaaggaggtgggtgggtgctctgcttcccacagttattgagggcaccaggctgaaggaagctcccccttggtcaaacatggcttttatgggcgtcactgtccagcacagaaggctcaagagcgtggagaagggtatatgagtgtgggaaggtttagggtccagggtcactgccacttacattctgttggctagaactctgttacaggccacacctggggtagtctaccccctgtccaggaagctgactctactatattatccaaagcgtacatttcatatttggtgaaaatctgtccagccattttcttgtgatgcggcaatggacatgcaacataatttctttttaaagaatatgtcatttttactttctgacattaagatattctgttagaaaattatgacagtaacagatggtattaaaaaaaaatctccccttgcttggtaaatgcttttatctaagtgggcagctttgtgctaatatgatgtcttccacttcccaattagttgtgatgctttactgatctaggagagctttacggtttgggactactataggcgaacactctgttgcctcctctctcaagaatcagagtgtcctattttggaaacacagtcaaccatgtgaaagcaatttattgggcgtatcttctgtggtcagatttggtttgctgacaggtgaattgggagttttgtaaactttaataagtgagcattgagtcagatgtgttcatgagtatgacctcgatccacttaaaaattcttatttctttttctctcttggcaggagggaggtggttgtgcaggtattcccagccactttgaagggaacttaaatgggaactttattgctcactgcttagaatgccatgggctcttcttttgagatacttacctttaacccatttcctttttttttttttaagtgcagcttgctgccagtgctcttttcttgggggtaaatgggaaatgttaataagtagcctctgatccctttaaaatgggagaatttgaacatttcaaaccttacctttttatacagttctcttattacctgggagagaggttaagtcttagactatccatttctgtcagtgagttgcctatgcattatagcctgtgagggtctatatttttttagggtaatcctggtaataactgcattgatgttacactgctaacatttgggatggagaaggggtgactgagtgacttaacccttggtccacatgtgctttcatttctcctgaaatatacctaggtatggaatcgctaagtcattatgtgcagtgggagagactatgggagatgggacagaaatttttaaggtttcatttcttttttttagcttttgcatggtgggtaggtctatgcaaacctacccccaaagtctgaggaagctgagaggccaaagaaagaggctgacaaatcaagtttctcagaaagaaatgtttagtagggacttaggaccagaaaccatgtctgtgtcttgcgtgttggcgagacaagatggtggatcccataccattacccctcagacccagggcttaataccatagggaagggcgattcagaagggaggtatggcatgactgaagtatgataatgtcaaggttgtttgacctcagggcaggatttatagtaaataggggctctttcacaaggaataatagataaactggaaatcttaaaactggagttaatcagaagtcagcatggtggatcagtatctaagacggaattgctttagcttccacagcagtcaatatctagaccacccttattattttcccacagaccaagaaatttgaaggtcaggacagtctttggtttcctgtacgtgggtgtatacgttgtaggcacttgaatctttgttgaataaatggagaatgttaggcagttatttgctagaaaacgctaggcacattctttatcacagaatgaaaagacgtcattatgactcctctgggactgatgggcaatttgcattaaccaatcttttaattaaaagtggaagaatatgtttaggttcttgaaacttctgtgagtgaagggaactactaagtggaaagtgtaatatgttgataaaatatttcaccagatgaagccaaccttactcctcccaggaaaacttcttcatttatgtattagctctggccaaaagaagcctataaaggcagcaaagtcaaaatagaattttactttaagtccctacttctaataattgtgctagtttttagccaagctaatttctgtggcagttttcataacaagtgtgtctaaaggtgtttgatcagaatttataaattaaaatatttctctcattttttggaggggcgatgcagggagagggatagactgttgctgcttcctcctgcttgttagaaaggctcttggccatatcatattggtccgtggtttagtttatttgcatgctgaatccacacacatttgttttatgtttgttagtatattgagcagtgtattagggatcaggtatatagatgtaaaaggagtacacagtctagagaggaaaaatagtgacaggctgggcgcggtggctcacgcctataatcccagcactttgggaggccaagatgggcggatttcttgaggtcaggagtttgagatcatcagcctggccaacatgatggaaccctgtctttactaaaaatacaaaaattagctgggtgtggtggtggtcgcctgtaatcccaactacttgggaggctgagacgggagaattgcttgaacccgggaggaggtggaggttacagtgagctgagaccatgccactgcactccagcctgggcaatagagcgagactccatctcaaaaaaaaaaaaaaaaaaaaaaaaaaagaaaaacagtgacataaacaggcaattacaatattttgttatatggggcacaagaagatgcccttggccctgcttcatgagtggtgtggggcagggtagagagagcagttcaggagaggtacgtatggatgtcatgggagctagcagccaggaagatgtaaacatgttaacaaggacctctccagagagaggtcttaaaattgtccagccatagagaagcttttctctctttaaaaatattctggctctaaagttattcattgagttaaaaacaataattgcaagttggaggaaatctctttgcctgtccttacgtgttacatgtaacaagtaaacctgtgccacaacactgacatctctgcaaagttacttaagttttctgagtttgtagtatcgcccattaaatgggattaataatattgatctctggattattgacaggcttaagtgagataacttgcgtggtccattttctagccccaccctctcatttcatctagtaaatcttcattgcattaattattttcatcttaaatacaccgcatcctgctcctcaccttctaatattaatactctgtctttcagtttagatcagttcctcttatccaatgttgcgctaaacatcccctgaagttgggggatcttttcctttctagtttttgctccctggcttcccttttctgttgctgactgttgaagctttcctgccccactggctttgaaggtaaattgtatatacatgagcttgtggggaaagctgttatataaatgaggacaattgatctaactgttagagtggggaaatggaagagattctgaagcctccatttgtaacttaaaaactcaggtttcatttcttaacaggattgatgttaaggaggggattccttcattgggcaggagggaggactgccataattccagcattcccactcttaatagtcagtgtcatcaggaaagaccacctcaagctttagtactttattcatttatccaactctgcacctgctgcctttgggtgtggtatttattcttgaccatatcaccctgacccggtaaccagaagggaacatgtgatgtgctctcatctctgccttaggggcagctccctccccacgttaagaatgctggcatgtaaataacactctcatctgtttagcgttccttttactgagcttcttggtatcttttctcatacttgtaccttttatgggatgtcccccccttttttttttttgagacggagtttcgctgctgttgcccaggctggagtgcaatggcacgatctcagctcaccgcaacctccgcctgctgggttcaagcgattctcctgcctcagcctcccgagtagctgggactacagtcacccctccactgcacctggtactaattttgtatttttagtagagacagggtttctccatgttggtcaggctggtctcgaactcctgatctcaggtgatccacctgctgcagcctcccgaagtgttgggattacaggtgtgagccaccgcgcccagcctggatgtccctttattttttaaaggcttccttaaataccttgtttgtatgttgaaaagagcatttaaagagtgaacagatttggtttgctctggctctctaattattttaactttgttatcacccaatagttctaggttagtggttttcaatcctagcttgaacaggagtcatttaaaaatagcccaggcctcacccagggcacttctatcagacatctctaggggggatggcccaggcatcaggaggctttaaaaagctcctcaggtgattttagtgcattgccaaggttgaaaaccaaggctttaggtttaaactaaaggtgaaattgctctttttctggttcattttctactttagaaagtagaaattttttttctggttcattttctactttaaattaaaaataaacctacagagggtaacacgtattagcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctttgctccttctgctgcgaggtcatgttctcacagccagtgaagtgacagcatatatgtgttgaatgtgtggcttgcattttacatttagctcttttaattcatgtgttaaccttaggaggtacttattattctattttgcagatgaaaatggagactcataaataagtaacttaccagcagctacatagctggtaattggtagaactggaagttggacccaggctctagtgctggcactcatagtttctccctgctgccatgttggcctcttcctacttggatgaagatataactctagtggcaagggcatttactagtgtgtgagagggtcttgtttattagttttgcaaattgcacggtctcctttattcaatatcttttttcaaacagctcacagatcttttgtggttttgtaagtgcctactccccaccgtattgccttctagagaagaggcaggaatttattttaatgtacaggacagacatgcatggggagtaaaactacagactccactctaggtgtgtggaaatactaaaaatagtgcttttctctgtgtgtgaagttggtctgttgagttttgtcatagacagcgttgagttcctctcccaggtggaggtggcgtagctttgcgtcacttacgtgtctctcctgatttccagtgacccggggaagacactgcagaggcagttgtctgtggtcaaaagtattctctgaccatggaactagatgaagctatgagcttccaggatcatgtggggctagaagaatgccgctctaaccctagaggagggacagctgagtgtcttctgatgtaactgaaattggagaatcaggtggattaaaattaattatttattacagtaaaataacctatcccatttcagagacatttgctatctttaaaacattaatactataatccaccttaccagtaacagtttacttttagtgacagtgaaagccattgactttttttttttaattgaaaagagatgttgcaaatagctggtgtacatttcttgagatgcactaaacaaggtagcgcacttgaagatcgtggcagtaataaagcgtttgtaagttctgagtaaagtattgaccagcacagcttccctggagaccgtcttctcattgctggattggacatttcactgttaagcttgtaggacgcttttgggcacctctctgactgggagctttgcagaacccagtggctttctctggagcaggtgctgagcacattttcaggctccaaaatcatctttctgctcttcagagcaagtttcttagcagattagtgttgagatttgtcaagggtttctggggcatcactaaaagtttcaggcaatggcccatcctgtcagattttagtactttggacacaggaaattaaaaaagagggcagatggtataaacattgcaaagctatgtacccgtgacagtgtaaatgaaaggtttgattgtgctaactctcctgcactttctttctgtgttcctgtagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggtaagtgctgtgtttatttgctgtaaaaagattgtttcacagcacctgggtcaagtgttatttcccaaaggattggaagacctttaacacaagtgtcaaatctccatttgtgggagaaaggaaaaacatccagcagtagggaaattagtaaataaatgatggttatttcctcaggttaaacattatatataaaatagtttcttttaaaaatagcagtcttccatttctcccatcattgaaggaataaaaatacaataagtcctcacttaacatcaataggttcttggaaactttgactttaaacgacatgtaatgaaaccaattttatgataggctaattgacgtaagcaagagttaagttcctatggcatatttctgattgataaaacatcatcaaacttctaaatagagactcaaaatacctcttatattaaacattgaaataaatgtgagccatacatacctttaagaaagattagtaaaataagatagttatttactagcttattccagttcaaggtggtgggaggccagagcctgtcctggcaggttggggtacaaggcaagagccagccctggacaggatgctgtccattgcagggtggactcacactgggaccattcagacatgccagttcacctaacacgcacatctttgggatgtggggggaagctggagtaccaggagaaaacctatctagacatggggagaacatgcagactccacacagatggtggcctcagctaggaatagatttttttctcatcaacgttataatgaaacaacgttgaacaaaacaatgttgtttgaggacctgctgtacagaaatacagacatagacacatgcactgcaattgcaactaagtttaaatgatgtacttactgggtaattactggaatgagctgcaaaatttggggtagttatgttagggtggtgggtttgtgatgatttttcctttccttttttccaacaatttctgtaaaactttctttatcgctgttatatcagacacaaaagatgggggtggtatttgaaagaaagtgaaaaactcagttggaaaaagagctccacagaaaggaagtttttctcttagcttgctgacttggacttccagttaggacttctgcatttcttcatctcttcttcctggataaggtttctccccatcttctccagtggtttgtgtgtatttttccatcttgacttgtttagtttattgcttgctttgtatcatcgttgctaagtgttgaaaagattctttctcttatgttttcatctcctcttctctctgttcttcactttctctcataggtcctacctgtacttcaggcccctctgagaccctgtgtccttgggccaaccttgacgacttctagcctcactcacctccttctcttggctccagctatgtggcattcgacttagcactgaatgatagaatagggctttgcatttcaccctctttattttgtgtttgggcatttccccttcctccaacatactggaagctcccagaaggctggtgctaaccatcattttctcttgtcacccaggtgcctgttgaggacctgaatgtctgagtaatggtctcatggtaaggatttctgtgtctttctcgttaggggcctttggctactttgaggtcacacatgacattaccaaatactccaaggcaaaggtatttgagcatattggaaagaagactcccatcgcagttcggttctccactgttggtaagttggtttattggcgtgattggtatggcttaactcaacttcaccttttggggatgtttataacttaaagaaaaagttattagaaaataggaagcaagcacttctccaaattatgtcaaggttttacagtagaagacatatttggagacacataggaagttacttgtatttctgtttgttgaggtcttaggaaatcacacttacacagaggctacctctgcaattctgtgacatttggaaagagctttcctaaaagtggttgcctctaacagaagaatagagtggaaatcttatttaataactatgcctacagctgacctttattgagaattaattctgtgccaactgtggttaggtgctttacagatataatctctgatttgtagatctactttgcagagtgggattctttttatttttgagaggctaagtgatgtttctcacgttacagagatagtattagatctatcatactatatttcaacatacctagtgcttcactagttccgtttctgtgtcagtctctgcattttaaaaatactgtggaatgtaaaaataaatgaaattaagaactaagaaccaatattttaactcattttcttaatgttaacctcatcattttgacaactcacttattctgtttgtcactactttaagcctcataattattttcttcccttattttaattaaaagttcaattacctgtttgaacaaagttatcttattatggtaaatgaatgacattgtcagctgttattacatgtgttctcttattgctctcaattaattattttgtttgatttgtggactgaattagctggtgggtagaaataataacccgggcacttaaatacctaatttagttcttggaagtggattagaaaggatggatccaggtgcttctttatgtctccaggcttcttggatgcaaagtgctgtggcttatgcttcctgtttccatttgaatattgtagctggagaatcgggttcagctgacacagttcgggaccctcgtgggtttgcagtgaaattttacacagaagatggtaactgggatctcgttggaaataacacccccattttcttcatcagggatcccatattggtaggtaatagagtattttgcactcaacaaatgtttgttgacttaaattgatttcaaataggttggcatttgaggagaagccgtgggaaaggcagaaagaaaagaatgcgagttgtctggactacttttttcaacacatttttctgtatttaataagataaagtaagaacagttaccattggtcttagatttgtcattttaagacagattgacttaatgggaagtgagtttagttttccttgcagagcatcgaagattagtaaaaagagggactttactttggaaacaagcagagggtgtctctacatgctctgagtcagcaggagggggtgtgtgtgcgtgcgcgcatgcgggagggtgggtatattttttccgtgaagaaatactataaatcccagcactttgggaggccaaggcaggcagatcactggagtccatgagttcgagaccagcctgggcaacatggcaaaaccatatctctgcaaaaaaatacaaaaattagccaagtgtggtggctcatgcctatagtcccagctacttgggaggctgaggtgggagatttgcttgagcccaggaggtcaaagctgcagtgagctgtgatcatgccattgcaatcagcctgggtgacagagtgagaccctgtcttaaaaaaaaaaaaaaagaaaagactatagttttgagtatatttgaaatactttagggtatcttagatgctagttgtctatgctgagtaaatttcatattatggtttggcagtttaaaattctaggattgtatttagaattataatccataaacctagtaataggcatatataatgaaagacaccataattcctgtaaacttagtttttggatttttttctctcttttttctatttagtttccatcttttatccacagccaaaagagaaatcctcagacacatctgaaggatccggacatggtctgggacttctggagcctacgtcctgagtctctgcatcaggtatgaacccttttttgccattgtattatatcacctgggatgcagtgtttaattatgcctcttcataaagtgtctctccagttttggctattttattggaatcagcttcctcagatttcttgatcgtgaagagttttgtagtaactggctttactaatcatcccccattcatcggccttaaatgatgatgatgatgatgatagatagctagcaacattgtcagttgatatttagcagtagtaaggatgaaagtctgtagtgtaaggtaaagctctgtattaaggaagtggggggaaagtagtaccaaacaaatttgctatgcaaataaattttgaataacaaattaggccagttttcaggttgttttggctttccttcatagaattttgagtcatagtattagtgatttgcatatcattttgatttaaaatttttctgtttgttattttctacaagtgaaataataatggtaacccttcccatgggaaattggctagtatgttttatgtcattaagggactttctggaaactaaggaatatcttaaaaatcaaggatgttttgatttaaatgaaaacattttaggctttatatttctgttctttaggtttctttcttgttcagtgatcgggggattccagatggacatcgccacatgaatggatatggatcacatactttcaagctggttaatgcaaatggggaggcagtttattgcaaattccattataaggtatgtgttacctttggggcagagggtacaaggctcctaccgcatacctccttatttttcctgaaggattgagcaaagattaaggcttctcccacttttccctcacctccatccccaaagttgggaagtattgatctcattgatcagtactgattttgttggctaccatctgaggaccttggagcgtatcccaatctcattatcacttccaacatccaatagtgtctttccaatatcatttcttttaactttttaagtcatccatctatttacttagcatttattgaggttttattatgaacaaggcatataagtaaaatcaattacaaatgtcagaaaacaaaattatactgtttttaaaaatttgcattcatatagccagatcaaatcagttacatctggggagggttttgagaatgttttaatcaactgaaatattataaagggccctcttttggtataagcatggcatttgttacaatgagcaatattgccagtgaaccctggcatgttagtgatattcccagagaactcccaagggctagtcagaaacaagcctgagaacctctgtttccaaatactgctgctaagataagcagaaagaagtgggctcgtgaccagtactggataatctctctcttagtgacatccaaaagccctattttcttctatcctgctttcttctttatctgaacaatttaatgtaggtatatcaaacaggaaaactatcacctctttttatattcataacttggatctataatatttgacaaggaaaaattttatgaaacagttgacccattggcttgtaattgccaaaagggtcaatgtagtattacttagaataagactaagtggttgtatctaggacagccagtctagttggtagccttggagttatgccagcctgaactcaaatttctactctcctagataattgtggccttgggcatagtattaaaagttctttgagctccagttcttttcactgtgaagttggcataatattaccagctatacaagtcctggaaagattggattgcttgtgggtcttttatcctagggccctaaggtagcctgagatctacatggattcatcagtctggattattctgacctaagattattcttttctaaacctaaaggattcagttaaaatcagaaaggtattgcagtgttattgtactacttaatatattagctctttgggcgatctgtacatggtgaccttcattgttttaatcctgaaggtggctttacttcttgttcagtagtaagagttcaaaccttttcactgatgagacagttgggatttctgtggtagaaatagaccagcgttcagagttgatttttgctaaggaaatctttctgcggcacttggcttgttgggaggtctttgagaataagatcacatggtcagtccatcaaagaacagtatgatatgataacaggagcacttatgaagtgacacagcttctctgggttttaatgtcttgcttggaaagtcagaatattaattttgcctgctcatagtcagagaactagttccaggtggctgtactgaagttcttttcaactctatgagctatgattctatgatttattaaaaaaaaaaaaaaaaggaataggacaggggtgaagggatactggccgagcacagtctcagtaattgatttgagctgtcatgaaatggaattaaaacattacttcatgataaaaggcaagtagtcctttaattttattaatcttttgcctacttttaagtatattttgatttttctgatttggaaagtaacatgagtgtaaaaattcaaataatagaatacataaagggaaagataggactgattttaaatatgaaatgtgtagatgggattcccttgacatttaaaagtattgggataatcaagtagaatttcttgttgataaattcattagtatcagatttgaacaatagaagtattgttgtaaagaaagttcattctttgggcagtgttactcataatccttcaatgaattactgatgaaattttgataactttgacaataagtttccattggagcttctttctttcattttgtagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtgagtcagtaaacaactatattgttttcttttttaagtctcttcttacctaattagaaaaaaaatctagtcaaacaattataataatggggaagtcatatacaaaatacagagggtaccacttcagagtgtcctaagctgtgaatgagtgcttaccagcatcttacttccacgttcctgtttgtcatttcattgagtatgtgtatgtggcttcatatattgttattaacagggaacagattatgaaaagctgatgtactttttcctggggaaactgtcagtatttaccacttactattgtgaaagatttaactaaggcactcatcttaaattcttatgttttattggatttaaaaattattttcattggcttgattgtatttgaaatctggtatttttgtgggtagctttgatttccttcagttgattgcctggtaattgtgaatatgacatcattttcaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcaggtgagcctggtggattgagatgttctgaggcaggtgtccatgtgagcatgcacacacaaaatatgcagcttggcatgatctttatgtgaggaattaacaagaacattacttaaactttaatctgggtgcttggttaccttgtgggattcactgaggtgaactattcttcaatgagcattccttgagtaaaccaagtataaacaaaagtccatggtaagatccctacatatgtgaagacaagaatacttactctcttaattaaaaaaaaaagacataatagaaataccttaagtattgatagagtgaagcatggtttgttctgtctgtagctgaagtatggttaattaattataataccttggtaagcctaactttattttcttgttcttttttttttttttttttttttttttgtgacagagtcttgctctgtcgcccaggctggagtgcagtggcatgatctcggctcactgcaacctccgcctcccaggttcaagcgatcctcctgcctcagcctcttgattagctacaggcgcccgccaccatgcccagctaatttttgtatttttagtagagacggggtttcaccctgttggccaggctggtctcaaactcctgacctcaagtgatctgcctgcctccgcctcccaaagtgctggattataggcgtgagccaccgtggctggcctcattttctgtttcatggtgatgcttgaatttttccatttgtaaaaagagatctagggatgatctttatgaactacatgtatgctgccagtgataaaagcagtggattaaccattcaccttgctaatgttaagccatcagtatgttttacatcactttttaatatctctttcaagagtaccaagagtgaaaaattgtactttggatcagaatcagtaagaaaataattggcttaataattactgtataaatcaatcttttgtggttttagactgtgaccttgaaacaaaggttaaagattgtaccctaaatcagaccacagcgactgaaggttacttcttatgtaagtatctgattccagttcaggtttcagtctgcatggaggacaagctaagattccgtttttaaaaaataacttttttgcttatgacattggggaacatctgaggcttttatagaaagtaagtttttcattagtttttagtccaattcaactgttacaaattgagtacctgtctgttgtgtatggtggactgtcttgggtgccataatgtaaggcagaatgccatggtgatccagaaagcaaaattttgtctgataggaggtcagccacgaagtttcatgaacgaggtagcatttgagattgttttgaagaatagataggattttgatttttagtaggtaaaatgcggcaggagaaggacatgagtataggcacaaaggtgggacatgttaggtgtgttgaaactataaacagtcactctctcctgaatgagaagaatagagtttgggtaggttcattgagtatatgtcagaggggaccttaaatgcttgagtaggagtgaaaagctttcttcagttttgagaagtgtggtctgggatatattgagtagaatcactcctcttggtgataaatagaaaaagcgacaactagggattgggaatagcaaaaggaaagtcaggcagttctcagaggaaaagcagaagtttgcattgaaaccagggagtagaggaagccaaaacaaggtaatcctgggccctaaaactccctacctggtggctgaactgtgagaggatgaggctaatgggatttgccaaggcatgaaattgtcatgggcagagcagaggctgcataaccctggttacccagggagggaacggattgaggaatacaaggttacctaaactcttttcacaagaatccaagtcaccatgggtctctggaaccacagtgggaccgtgaggcagtcagcagcactgagtcatataatttgaagaacaatgaagatttgaatggagaactaggcccccgggaaaaggactgcaaagcaaatacgtattctctacattcctaagaaagcaaatgtctaaggcagctattcaaacagtggggaagagagttctgaaaaaggatgacaagtagaaagtaatataatttctgttagtattaattttagttctggcaaatatatctattttaaattcagtgtactctttataggttgttttttttttaaatgagttttagaaactgttcgaaagagctttcataagtttgtcgagttattgtttctagcctagctttcccccatccttcttaggtcatttagctatcagttccaataccatggagcctgtgaggagccatacagttggggaaggactgttgtactcatttagccatttggtgaccattaaggaatgatttgagattttttgagtaggtgagtagggaatatgtagattgtcttgttggacaggaagtggaaagccagttaggggggctttggggttattcctgctgagagctcatgagtattgtagcctaggcagtggcggttgatatattaatgggcagtgtttacaggtgccttttaacaaggtcatgttattaagttttataactttatccaaagtggtgagccacaccatggtgaaatggacaaataatataatacaagtcatagagagactgtcctgtcccctgagtacctgaggacacaggtgcagcctttcttgctctcattctctgcattttgccaagagttggagaagttgggccggttgcttgggtgggaaaggctttcccactcacgcaggtccagcaagggagttcaggcacagggccttggggaaggcctagattcaagctggtgtcagggtatggcctcactgtgcccatttcccaacctttgttggtctccacccataggtggggtaaggttgcctgataaacacagggtgacacaaaatcagaattaggtgatagaggctacatccaggagctgcccatggcaggattgtatctcctatcctgttgatggagtcaagagcacaactttttgagccaaaggagacaaccagcttccaacctatagctgagttttggtcatggccgcatggctagtcatctaaatatgaccttaggctatttgaaatgatgataagagggagtcattcagccaaaagcaaaatattgacagaacactgggactggattaagtctgttggtatcagtgatttggaacaaagttattgcttaagttgccctattcaatttggtttttattttgcctcatagaattagggatataaaaatacttttaaggttcaaggccaatgataaattcaatggaagaaaaattgctcatagaaaaggagtatgaataatgagaatagttcaataattagatattaagattaatgcagaatttatcataaagcttttgtttgagcattaactgaaagaaatttcaagatgcttgccatctttgccttgattaacatggaacataatttaatcttagattgattacctttggcattgtagggctttcattttgaaccacagattttttgttattgttgtttatatctagaaagtctcagagctcaaagtgtttctgagataattcagaaggcagcatgggagtgggcggtactttttttttttttttttttttttttctgatcttgctttgttgcccaggctggattgcagtgacacgattgcagctcactgctgcctcaatcccctgggccaagcagtcctcccacttcagcctgttggagtagctgggactacaggcacatgccaccatgctcggctaatgttttaatttttttttttgtagagacaggtctcgctgtgttgcccaggctggtctcaaactcctgggcccaagcgatcctctcaccttggccttccagagtgctgggattataataggcatgggccactgtgcccagttggaagtgcttatttgaagaatttcccatgctgttggttttgtagaaatgtgttgctttttgtaaagagcaaatgattggttccttccctggagtgggggaatgaggaggaatagaattaattcaatatttcagttagttaacgttctagcacatttattttataatgcaatacttccttgggaataggaagtaatactgtataagacaagacactaacttgttatgcagaaggaaaaaaaaaagatattattaccaaaaacagatgtgaagatttatggttggccagagggcctgggaaattcagaactgttcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtaggcctaaagacgttgggctccccctgcgtgggcagagggcacgtggagcagatgggcgggaggccaggccagtggctctcaagctggccccgcaggacctcctgcttggtaaaggtgctccccaggtgctgctaactgggcgcttttttgcccagcagtgaagatttaggctgcctgaggactctccatgctttttatctattttatatattttattgagcatttccacctcagatgttacttgtatccagtagttaaaagcagggagaaagatctttcacactggctagagtacagtaacatccagcttgggagttaggttttgaagacacttcaccaaaatggacaattccttaactcactgtgaaatcaccaagacttagacccttggaagtgcgaaagccaagagttggagtcttctgtttctctttgcagttctgctgtggccctggaggagcaggtctagctagaatttggaggggagctagaattagcagggaaggctggggagaagagagtaggggaggcagagcaagtcaaaggattcccctcccttcattttttcctaagtgaataaagttaggtgaatcaacttaccactttttgttttttggaactcatttatcaaacttaggatctttttcttttaactactttttttttggtgtcgtatacaaacagcctctggttctaattactttttctaataagtcaagcagaatgcttgattaaagttttttccttttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggaaaaagaagaaaaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgagattacaggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctataatagtatggtgttcttccttcccctacacacacacttggtgtcttgatgaatgtcatacataggcacctcttgattatccactgtggataatctattacggcagtgagctggctaaaattccaaccccagattggtttgctcaaaccacttaatatgtttctgggccactcctgtttaggcagtgtgtgctcgggtaatgaaagcttctgctaatgtcagccaaagcatagttgagaaaataaatatgctaaaacgaaaaaaaagccttataatttatttcaaaagtcatagaaaatattttgattgtatttgtcactgtttcttataagtccagataagtaagtgctgatatacaattaccacattttaaaaaattctttgtttattggtctgtggagggtatgaaagtgaagctacaatggaacaaagtcatcattgtcagtaaaggagagataccctgagaatcctaaaaacactttacggaatagcaaagtagagttctgtaatggaaatactgtatatgctgggctggaggagacaaaaaacccagagttccaaccccatatctaccactggctaccgtgtgaccttgcagcagtcaggtcccatcacagagctccatgcttgtgtctgtagattcaaggagcagaaccagaactttcagatttccctcaagaattttgtgatgcagtgtttgaattgagcccaagtccaaatgacacaatttttcaagtcaattttgaaatgtgtctttgagcctcatccctatatggtggccaaatcaagcctgtataaacttctacatgtgctgtacccctcagaagacttgatagatgagaccctttgaagtgtcaaaagggactttgagattcattcataaagtgcggcagcctgtgcaagcatttagcagatggcagcgttccctaagaatcttcatactacctgtagctaaatgcgggaaattaaaaataatatgtgtgcgttgtgtttatatctgtgtatgtgtacgtgtgtatttgattaccacttgaatttatttctcatcacagtgattatttgcagacttacttgacttttcttattcctaagtgcatctgggtggttttgttttgaaggtggtgctccaaattactaccccaacagctttggtgctccggaacaacagccttctgccctggagcacagcatccaatattctggagaagtgcggagattcaacactgccaatgatgataacgttactcaggtaatgacttctctttatctgctatggaagtcacctgctaattctccttgtcaatgcctgcataatccccctccctgcaaatgccccaactgtctgatgtatcttaaattgaattcaaggaagactcatctgtaatagtaaattgggccccttactgggtggagttgaagggttatattactctggtcttttgcctcaaagcatgcagactccgtctcagtttcttcaaactttattgaagggatatggggagggggcattggggaaacagttatctcatgggaatttaagaaatgagcatgtacagcttacgtggagacaaatctaagaatctgggcaggacagtccaggttcaaggactagaactagagatccaaaatagctccaggagcctcggccacaagagtgtgggcgtttccactgcagggctcgtccttcacgtggcttattctccatctgtctgcttctgcttgccaatgctaattgattatttttaccacagcttcctgttttctcctatctgcgtcagagcttctgttttatcatggttgtggctcttccacaacaatggaaaactctcctttatggcgtctttctccattattactttttttttttggaccaccttttactccttctctcaacatgtctatctctagattctagagagatggaatcctattgacttggctaatcttttcaccccaggttgcaccattggccttggtcaggctctagttaaccgccccagggcaaatgctcatcctctttccagttgcctatggctgccctaagagctgtttcagcacatgctatgaaggaggcccttggacttggaagggctgtaggtgggcagctgcctccttaatgtgtccagtgcaacttataccacacacaataaaataataaagttaaaggtatagttgttctagagctctgtttgagcagttagtgttaaacttagtatttaaattagattagaacctatttctagtttctcagtttgtgaatgtgggttccaagtaaaaaatacttatacatgaattaattcgctgtgaggatatctttgcttgaaaagcatttacgtatatacatatatacgtatatataaaaaagaaattacattattgtgggatataaaccatttttagatgagcttaaaacatttcctgcataccttttatgtaactgcattatttttggtgatgcagatgacaccaagtatattacagtacattccctgcctctcaaagaattttgcctatgtgaggtcaatacaggtattaaaccagctcatacaacccctgcaaaaattaatgaggctattgcttacacatgaaaatttattatgtgctcattcttattgagagaatttcttatcactatataggatatagtgtggtttttaagtaatcacaatactattgttatagattcatagcataattctgtgatgatgtatcacatgggaaatacataagaaggtccagatttattctcttaaaaatgattcacttgggcttgcatctgtctatggcagactagcttgtatcttacttaccgtttcatggagaacattgaaaaggtaggtaaaatacataaagcacttgtttgaaggctttggagagctaacaaagcaacaaggatttaagggaccaagatcaaagatggaaaagaagtgcaggaaaaaaaagtgcagtgaagtaagcttgacatttggtttcctttcctcttaaggtatttgttaatttgtaagcactggtccagaagctgagtggtgtttacagcagtctcatgagtctgaagggacaaaaattggaattcaaggtctgctaagaagcagagcctctagttatactcaaggctttcagttgaaatccttaaagggccatgcctaggaataagggcaaacatgaaataaacttgctttcacaatacaggaaacataactttgcctctgctcagtctcagattggattaaggtgatctctttctacgccatctgtcagaagcaaacaaaattttctttggtggaaaatagaaactcaaatgattctagacctttttatatggaaatgttcagcattcaacaataaatgaccaggcacctaacacattaagaccttatgactgaaaatcaagagggagaaaaaaccccctacaaactgacagtagaaacaaacctaatggaggcttaaataatggaactgtcagatacaggttttaaaatgactgattaataggtttgagaaaatagatgggctgggcgcggtggctcacgcctgtaatcccagcactttgggaggctgaggtgggcggatcacgaggtcaggagatcaagaccatcctggctaacacggtgaaaccccgtctctactaaaaatacaaaaaaaaaattagccgggcgtggtggcgggcgcctgtagtcccagctactcaggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcacgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagctcctatttttcattttaatttatggatatttattttagaggtcaacccaataatctagcaaaatatcactattaatatgtcttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtattaagaatgtggtgaggttttaaattgtagatctatttataagagatttatagcagttactataaaggatattattagaaagcaggtatgagctattaacaaatgaattttacttattttgcttaaaacaaaaagtgaaggacacaacccaaatttaaaatttaaaattattcttaacttctaaagttttttttatcattgatttcctaagtgttgtagtaggtgaattttgttggtgataaactggtgattcaattctctgcacttgctcttttctctgagcaggtgcgggcattctatgtgaacgtgctgaatgaggaacagaggaaacgtctgtgtgagaacattgccggccacctgaaggatgcacaaattttcatccagaagaaagcggtgagtctttgtaagctgaagggtgtcctctgctggctaaggaagacagtgcagctgtgtgggagaaccctaaaaagaaagtgccatttctgttttacttgacttaagagaacttaaaaaaaaaaaaataaactagtaatccccaaccaacttctgattattttctttccatgttttatctggtctggcatatccatcgtccttagctgtttgtccagtgtgtactaatttagttgtgttcagactgaattttgtcctattctgtttaattcagctgcagccaagttctgtgcaagatagtaaatgtgcaatatcaaaatgtgagtcctgctgcaattctacttaaactttggatgataataaatatatcagccggtgtgatggcatgcacctgtagtcctagctacttaggaggttgagatgggaggatcgcttgagcccaggaatacagggccagcctggacaacatagggagaccctgtctctaaaatcagtcaatcagtcaatcagtctgtctttcttttttgcatttttatggtttaaaacctgcctaaaggcttaatgtcataatacctcgatcctccttcagatgcagactagaaatttgcatgatttctggaataagaactgcaatgcttccaaaaggcaggctagactttcatgctaaggtgctggggtatttctgatggccgctcatcgagctgagtgaagccctctcacttctggtttcctggcctgtcccagagctaagctttttgcaaatctagaaatccccctttttccttggcccctagttgctgcttctcagttcctaggggcagctgggctagcagctgtctgggctgtgtcccagagcctgggttccagtatcagcagagagcttgacaggcgctctgtgtggtaggcagggcaggatttatctccttttactggagagaatggatacgacagcttgtaaatagcagaactgggctggaacccttggcattctcctttcacatatgctgaaactgtaaggcttttatgggttcccaatgccctgcctcctcttgctgtccactggggaattcctgcctgaagtgtgtggagttgtgctgcatgtaccagtgttcttgtatccttcacattaactttaggctgtgtctgggcccgtttctcaatgtaaatcactgtaatttgttaagcgcttactctgaggtcagctcttttcatgcagtaaatgcacctcacttctcagcatttttctcacagcatcctgtgaggtaggttgtgtgggttttttttttttaagatggagtcttgttctgtcacccaggctggactgcagtggcatgatctcggctcactgcaacctctgcctcctgggttcaagagattttcctgcctcagcctccccagtagcttggactacaggcatgccccaccatgcccgactaatttttgtgtttttagtagagatggggttttgccatgttaaccaggctggtcttgaactactgacctcaggtgatccacccatcttggcctcccaaagtgctgggatttcgggcgtgagccactgcgcctggcctaggttgtatgggtttttttccccgacaataagcaattctgtaattctttgacagtaactgtgtgtcctataactcaattcaattctaacagtagctcctggagctagagtcagaacccaaagatttaggggtcatttcccactttagataacaaatgaggtaccctggctatgcacacttctgcagattctgactgcaaatcaaaccctttcctcaggtttgataatttgctggaaagactcatagaactcaggaaaatgatttacttatgattaccaatttattataaagaatacaactcaggaatagacaaatggaagaggggcatgggggaaggcctcggagcttctgtgcctccctgagtggaccacccttctagctcctggatgtgtgcactaatccagacactccctgaccttgccagttgtgggtttttctggaggttttatgacataggcatgattgatgaaattattggctatgggtgattgaatacaatctccagcccctctcccatccctggaggtttgggggtggggctagaagttctaaccttctgatcgcgtgcttgttcttcctggtgtgagcctccatcaggaatctatgtaggcccccatgaatcatcttagtagtatataaaagacagtacattcgaagggttttagatctgtgtcaggaatgggggacaaagaccaaatagtatttttaaaattatactgattaggtgtcattttcttgcgcatttcggcagagggacataagctcagtaagttaagtgacctatccgaggttgctcagccagtatatgtcagagtgttcactggacctgcatcttaactctgaggctggcattgttaaacacctgtagtactgcctcctgctgaaacgtctttcctcccctatggaataaacactgggaaaccacagtccctggggagtgatatagtagggagttagagtaatgcttgcatttattttcctttggccttaggtcaagaacttcactgaggtccaccctgactacgggagccacatccaggctcttctggacaagtacaatgctgagaagcctaaggtaagctgggagcagcctggccatgcagaggctgtgtgtgctgggttggagtaggcatgacttagttaccacttagcattacagtctgcaggggccattacctgccactgttagatttcttaggcagctgtgcagaaattcatttgagagataaagaattcactggcaaaacacatactcttcattttagcgctgggcaatttaagacagttaaagtgaatgaattctgaattattattttcatttgcatacatattaaaactgagtaaatatcacgttgctgcccatgaggtgattaacctgctcatcttgttcttttaaaacagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaacagagatggtattttctttctttcgactccatatgtaactgtaaactgctaccagactcttaatttgaacatcatcattttcagatgtttacccttaaaaatggaaatgccagtatctcgaggactccatgttatttgtttaaatctatagcctttggacagccttctgagacactgataaaatagcaaatgccccaactttgaaaattacttaaatctcttgtccatttgctcacttacctgtgattgactttttaaaacaagggctcagaaccactggtcactttcctcttccttctttttaaagcccatatttgcctatcatggttgaaaatcacatggaagactttaaagatgagttctgaatactaaatgaaaatttgttttccttgaaaatctttattccgttcatattcaaaaccagtttgtgccgggtgtggtggctcatatgcctgtaaacccagcactttgggaagccaaggcaggaggatcacttgaactcaggagtttgagaccagccggggcaacatggcgaagccctgtctgtacaaaaaatacaaaaattagccgagtatggtaacgcatgcctgtagtcccagttactagggaggctgaggcgggaggatctcttgagcccaggaggttgaggctgcagtgagtcgtgattgcaccactgcactccagtctgggcaacagagtgagaccttgtctgaaaacaacaacaataacaactaaaaacaaaaaaccaaaccagtttatactttcaggagttcctgagttacgggcttcaggaaacagaccactagcagacagatacaaactcattcttggtcttttagctcaaatttctttactcctctgtcaaaccctcctgcctaattccccccgtatttgagtatgctttgagactgttatatttgtagacatagaaaatagatatatcgggctgggtgcagtggctcacgcctgtaaacccagcactttgggaggccaaggcgggtggaacacctgaggtcaggagtttgagatcagcctggccaacgtggtgaaaccccatttctactaaaaatacaaaaattagctgggtgtggtggcatgtgcgtgtaatcccagctactcgtgaggctgaggtgggagaatcgcttgaacccaggaggtggaggttgcagtgagccaagattgcgccactgcactttttattgggaaaggtgagaacttctggagatggttggtggtgatggttgcacaacagtgtgaatgtatttaatgctactgaactgtacacctaaaaatggctaaatggtaagttttgtgtatattttaccccacaaaaaaatccaatggtccattcttagtccttgtcttacatgacctctcagcggtgtttgacacagttggtcgttcacactgccttcttcattgtttatttattttagagacggcatatcattatgttgcccagggtggcctctgcctcctgagtaactgggactacaggcacacatcaccatgcccagctttcctcctcgtccctttctcctcctcctcatttttcttcctcctcctcctctctcttcttcttgtccttgccctcatcctcctcctttttttttcttccttcttccttttttcttctctctcttttttaaaataagagctttattgagatataattcacataccgtaaaaaccacccatttaaagtgtacgagtaaattttttttgtatattcacagaattgcgcaaccatcaccacaatcaattttggagcattttcatcaccccaaagggaaacctgtacctatcagcagccactctccatttctttcttaacctagtccccagccctaggccatcatgaatctaagatttgcctactctgcatgtttcatttaaatggaataatatagtatgtggtcttttgtgactggcttctttcacttagcataatattttcaagattcttacatattgtagcatctatgagtgcttcatttttttaa

SEQ ID NO: 14263 - DNA, 37795 bp, Human
cgccctggaggacaacgcaaggttaacttccctcccacctcctcttgtaggcacacagggtgccccttagccagcgaaatctccgcgcccgagatcctctcacaatttcaggctggtgaattgtagtaggagacatggtttagtttgatgtggttaagtcagtcatcatggcatcttcgtaccctcagccccaaaccgctctcctactcatcaccctcactttcatttctttggattatctttcatcggcttaccaccagccttcacagcctcacccaaggctgaagcagggctagcagggtggtgcgtttccttccctggttgagctggtgactgctgtgggtaagcaggtccaatgtgaactcaattttacattgagaaagagaaagcaagagtgagtgggctgctaagactgttgcttcatggtttcccctaagccccagaaatagaaaggcagacttccgactggcagagcccgtatgctaaccaccagaccacactgccagataagaaaaatgttcgattgtgtcatacttccctcattggctccagtgtctgaaaatggccctgaatttcagagagtcttaccatgacccagggatttagagaggatcgaagagggaggacaaaggaatcaggcaccttctctctctcttttctggggtaaatttattttcaaccacaaaagtaaaggaaagaaaaagtcacaacagatgagttatgagctaactttctgatttgcacatgtaagagaaagaaatgaactggatatcattagacattgagaaagggagtctgcaagctagcaatgtatcttcggcctttttgatttacacgtgtttatttatgagtacctactgtgtgccaggcatgatgcttggtgctgccaattcaaagagaaataagacacctccttgcaaagtgagaaggcagaactagattcagattcacctagatttcaactcttgtgctcaggccaccaccaccaccatggaaacaattttgcttgactctcccggcgcagccgcggcaggcgtgtgtgttgtcagacactgcaggaagagtgatggcctgggtgttgacaggctcctaattggaaggtaggaggtgccaccagagatcagctataaaagatatctttggactggggtgggctgctaatgcttggaagagacttgtgggtgaggcccggtgagctgtcacctcggaattgggccttgcccagcagacagacatgcatgcgggggaggtagctgacagacaggggcgcatggggaagcagccattccagagaactgcaacagcagattgcaaaccaggacttcaggactcagagggggacaaggaaaggagagcctatagtggccccaaagcccagggtcagaggcagggccaggagagcagctgacaagagctttatggtaaggacaaaagagaagacagccggagtctccttttattcagctcataaagacccaacttctgtgcacttataactgttcagaccctgaggggttcaaaaaaagaaccgtgttaggagaattcaatatttaattaagagatgatcagatccgtgcaccgaaattattgctgggtaagacaatactgtgtgtgttacatagcattggaacttaggaaagctctttccttgtgttgtttaatttaatccactcaacaaccctgcaaagtgggtaccattgtccctgttttttatgaatgagggggtgaggtgctgagaagctgtgtacgttatttgagtttgtctggctagtcagtggctgagccaagttccaatccaggtcatgtgagcctctgaactttctgataaaacctgcagacccccttaactgggataatatagtcatgcattaagcaagaaggagaagtaaatacaggctgatggtgtaggggagaaattcaaagggagaaggcctaggagggagagggagctatgtgtgaacagaaccaaagatggcctctgggaattggaaggtctcttggaattcgtccaaactgaggatcacaagtctccacattctgagtaggaggatgagggtctgagttaggatttgggtcctgcagggcttgctaaggaatcccctgatggcctaggattccacgcagagcacatctggtgtgagagagctcgctgcaagggtgaaggctccgccctatcagatagacaaccaggccaccaagaggcccagccctccaaaccctggatttgcaacatcctcaaagaacagcaacgggccttgagcagaattgagaaggaaatacccccacctgccctcagccgttaagtgggctttgctattcacaagggcctctgggtgtcctggcagagaggggagatggcacaggcaccaggtgctagggtgccagggcctcccgagaaggaacaggtgcaaagcaggcaattagcccagaaggtatccgtggggcaggcagcctagatctgatgggggaagccaccaggattacatcatctgctggtgagtaggcttcattaattctctgatgaatggacgattgcaagggaacttttttcatcttcaaggagccagaagaagtggtgattaaattggtcttttaaaataaaaagactccaaaggggtacaagtcttcaagcttcccctgtggtgttccgggcactctggcttctctttcggagggaggaagagcatctattcataggctgtgacttggagaggccccacggtgagtcaggcgcttgctgtgtgagccgctggttgctaatgtcttcgggaactgctaatttacccatctaatttgttcctgtacactggccacaaagggagaccactcaattattctgatccaaaagagaggcttgtgtttaccatgatctccccagcaactgtgtgagtgtgtgtgctgtgtgtgtgtgtgtgtgtgtgtgtgtgtgtgtgtgtgtttgcctaacaaccttaggcaatgacgaagaggtggggctgctgcccttgttagcattttcaaacacattccagttctgagttgagggcaaagattgtaatggggtgcttcagagaagccttggctcccaaggaggttataacttcaaagggtgtttttgaaaaaccaaggcggatgaggaaagtggctacaagttccttccatcacagaggatcaatgaaggggaacaaagatttgggagcatctactttgtgccaggtactgtgcttgggttttacacgtcttctcttgttgactttgcataactcccctttgaagcagatattactccaggttcttgccgtaatgtttcagcttaaagaaaaccaacccatacttctttaggttgccctgaaaaggtgaatcttctgtgaagccttttctgtctttatctgttaaaattaattaagctcttgtttgtgctcccagaaaatcactttagaccttagaaagatggcagcctcagttttctcatttgtaatataggggtacccatagggtcattgtgagaaataatagaaataaatcatggaagtgcttggatagtagctggtacttagccctcatcagtcatcattgtcattgttgttaagagtaataataataataatatcacttattataattactcacctctaggtttttaaaaaacttacaggccgggcacattggctaacgcctgtaatcttagcactttgggaggccaaggcaggcagatcgcctgaggtcagcagttcaagaccagcttgggcaacatggtgaaaccctgtctctactaaaaatatgaaaattagccacgcgtggtggctcatgcctgtaatcccagctactcgggaggctgagagaggagaattgcttgaacccgggaggcggaggttgcagtgagccaagatggcactattgcactccagcctgggtgacgagaaactccatctcataaaaacaaaaacaaaaacaaaaaaacttacataaatttatggggaacaagtacaattttgtgacaagcgtaaattgcatagtcgtgaagtcagggcttctaaggtatctatcaccagattgatatctattggtatctatcaccagattgatatctattgatatctatcaccagattgatatcaccacattgtacctattaattaatttctcatcatcctccccccacccttctgagtctccagtgtatattattccataccctaatgccatgtgttcacattatttagctcccacttatgagtgaacaatgtgatatttgtctttcagtgtctgacttttttaacttaagataacagcttccagttctacccatgtggctgcgagagacatgatttcattcttttttatggctgaataatattccattgcatatatatacaccacagttttaaatccaatcatccattgatggacacttaggttgattccacatctttgctattgtgactagtgctacgataaacatacaagtgcaggtatctaattatttcttttcctttggatggatacccagtagtgggattgctggattgaatggtagttctaattttagttctctgacaaatctccatactgttcttcctagagattgtactaatttacattcccaccaacagcgtataagagtttccttttctccacatcgccactaggttgtaagttccttgaatgtagggatcatgtctcttttcttcattgttttataacaagagcctaggagtgtttggcacatggcaagtacttgttttctagctgacagatgaatgaacaaatgagtgaaggatgcttcctcctcactgctgtgagcttctgagaatggacccttgtctgacctgcttctgtatctctagtgtgactgctttgtctggcacaacagaactgctcagcgattctgttgaacggatgctgctgcctggcccgtatctggcctggagagtctggctgcgagctcatctgtgctctggtctggctaaggttagctgcagccctaggaactcagagagtgtgtcctggacatttcacccctagttggtgagctcctcaagggtagggacggtgtcttgtttatttttaaattcttagtgcccagtacagtgcctggtacacaggagatgctcaaatggctacccctagcctctgaggtcccactgcactcaaagaagagcagagctccaaatgaccttgtcatctttcccctattacccaaacctgttcaatttccccatttctgtttattaaagatccattttctcagttacaaagatccaagactcctcgagggtattctaccctaacggaaataggacaggctttgtagtcagacttgaaccctggctttggcgactactagctgtcctgcctggagaagttgcgtacccttcctgagcctcagttttccctttcattgaatcaggatgataatacacacttcattcatccactcagcaagtgtttactgggcgcctcatacacagcaggaactgttctaggcactgcggatacgtagacgtcaacaaaacaaacattgctcttgcctgaaaggggcttacaaacttgagagggggagacagacaccaatcaaataagcaagtacacatatagtatgccagatggcaatatgtgctagggagaaaaataacacagagtgagggaaaatggaatgcgctggcccgggttattagtgtcttactcaggtgatgaaggaagacctttctaataagaagaactcacatctggggaagaatgttcccggaagaaggagaagagcaaaggccctaaagcaagagtttgaagaatgacaaggggtcctgtgtggatgaagcagagggagggaaggaggaagggagtgtaagagaaggggacacagagatggctagagccagatatgcagggccttataggactttggctttttactctgggcaagaaggaaaccttgggagagcttcaagcagaggagcgaaatgatctgatgcaggttatgaaaggatccccctggcagtggcacagagtatggcccctgacctgtgtggatggggcagaagcataaggctggccatttgcatcccacaaatgacctcagtgtgagggatgagcgagatcatatacgaatgcgcttgcgtgagtatgcatagagcaagtgctcaagccatggcagcttctatcaatggccctgcagctgcctggctatagctccctggtctcctgcagacaagtcttggccagtcacgtgagtgcctctgtcattgcccactcagtcattccccctgcccccacctcctttcttcaacccttcactggtggttaagctcctagcacagcagcctcacctccagcctctccccaccccaacccaacccaaatgcaactccactcacatccttcccctgttcaagagtcttccatggactagtggctcattaaatccacattcttggctaggtgcagtggctcacacctgtaatcccatcactttgggaggccaaggcgggcagatggcttgagcccaggagtttgagatcagcctgagcaacatggcaaaaccccatctctacaaaaagccaacaaacaaacaaacaaaaaacaaaacaaaagaacaaaacaaaaattagccaagcgtggtggcacacacagctgcttgggaggttgaggtgggaggatcacctgaactcagaaggtcaaggctgcagtgaaccacagtatcaccactgcactccagcctgagcaacagagcaagaccctgtctcaaaaaaaaaaaaaaaaaatccacattcctggagacttgcagctaaggccttccacaataagatgctgcatttacgtttcccacccataatcaactgctatcccaaacatattgaatatctgtggagaagtatgggtgggtgcaatatgtcactcctagcagaatcactgaggaaactgaccacactcatgatggaaaattgacggtaatgagtccttccctcaggttccccaaccccacaatatgccctaaccatggtggacatgtattcctgtctgtcactggctcacttctcccaccaggctaccgcaaactccacaatgatgtatattctcttaaagctacaaaatggcttgtggtttccaaatcagttttccttactgctcttatctcccttgatacttgcccctatgggcccctcatccataataaaatgccctcattttacacttactagttctgacaagagtcccaggttccaagtcatggattcccatatgggattgctcctctgatccttcattcctatatcttttttcaatctatccacaattcacaaagcatcggtgtcagaccaatggcaaataataagtgggacctgctggctatggatggaagagcgaagtccctgacaacatgtttctaccagcctggaaatgaggctctcccatcccctaacacatctaccagttgtgatggatttaaaggctggctaatgttaagcttgttccacaggggatagaatattggcccctggactgacacctaccaccatgtggatcttggagcaagacaaaggagccccccaacattcgtgttctgaaataacaatgcctgaggctgtctattccccaccacggatgccaaagcacagacagccactcacagctgtgggatacagatgcccctgtcattataaaaggccagccctaaatgctattacagagtctaaaaactgaaaatgttattgtgaaacctttaggttttttatagctggctatgcctgatatagctggtggcctgggacacagtttccctactcagcgctgggacacctcggcaatactgcacccacagtgtcatccctatctgtttggaatgtacaattcttctacaacaccatgggccaggaatatcacatcatcctgagcagccatcaggacaaacaaaaaggaatgtggtcctgtatgtttagtcccacctcccctacaaactacttttatcatagaaatgatgcccaattgtcagcccagcgcatgtggtgtcctccagcaccccttctaaatgtgccctcaagcaccccttcttctttgtgcatctttgtgacacccttccagatgtcagcctatatctccatgacccaaatctgacttaagagttgtggccgggcatggtggctcatgcctgtaatcccagcactttgggaggccaaggcaggtggatcacctgaagtcaggagtttgagacgagcctggccaacatggtgaaaccccgtctctactaaaaatacaaaaaaattagccaagcttggtggtgggcacctgcaatcccagctacttgggaggctgaggcaggagaattgcttgaacctgggaggcagaggctgcaatgagccaagattgtgccattgcactccagcctaggtgacaagagcgaaactctggctcaaaaaaaaaaaaggtgtaccagcccagggagacaatggccacattgcaggtgatgaccacagcccagccaaccactgcatcctggaggctgcccaccagttacccacatcatctaccaagggacccccttgctggagcacaaacagcttcccttgggggatccctcaatcagcatttgtcacatacctgaaaagggtggccaccacccaggccaccaaagttataactctctcctctcacttcctccccattgggcacaataaacctcattgccattgtggctggaacttcccttcctgggcctcccaaagcaattctactgcctaaggctatctccgggctaacttgtatgtacacagagataaagccacatcccagtggctggacctcatgcaatgttgggcctcctatctgcccccatgagcaggccactcccttatttgcaccacaaaaccaccaacaccaaacacttctggtctaggctcctaggtcttgccctgtcctatgttggctcagatgttatccagtctggtccccggctcatgagtccagatcatacatctatccaaatgtataaatacatgcctatgcttgtatcttcctaggcccacacagcacaactagtgtcatggcccaccccagatattaaaggaacacaagagattggaagccccagagggaacctgcttcacctgttccactcctagataacttcttcctgacgtcccaaatacctaaactcacctgcacactgctaagtctgacaacccccttcacatttttctgactgttctgcaatttaaccctgctggtcacagtccccagtcagaggtgatgggcagtcttcctacccattgtcctgggtataagcatgacttggggccagaagagtgggactaaggtcttacaatatgatcacaccaggaaaactagcagatacttcagagaaagatctgaggtcctatcagcccacgtaacacaaaaaacagcagcactggaagctttcactgaagggcaaaaacccctaactgccagggtggcagataagagactagctccagatgatatgccagcttcccagaaggagtatatgctctcagagggcatagtgtatcctgctggacgtggataaatattgcaaggcaaagtaatccaaatagcccaatggatgtaccaccaaacagaaaccaaattctacatgtggtactctgaactccctaggacttggatgtcccctatagcctggggtgaccttgttttaggagccctcctgcccacaagtagacttacatactgcactggctatgtaaaattggtacagcctatatacaagtatattagctctttggatggtgaaccaaatgttagggagtgaattttgaagaaattgagttgagtgcaaaaagttgctcccagcaaaatgtcatttgtccaaatagttaacacccactggggcagaaaccatcagggcaccccacccctcaccacccactcagccccactcacctctgcagcacctagtaatcatatgcaagaaaactcacccttactctttttgattgaccacccccagcctgacccccaatggagcagatcactcaaaattaatcttcccccactacctcctctcggcattattcaacaggtgggcccctgtcctatatctacgtaggtccccagcaccaggctctttctcctccccagaagtcagggagtcctcttctcagtggggccctcaaccagtggcttccctcgctgcctatgcctgcataagtaatacacctttgaattgcctgtgatcaccgggtcaggtgtggtgcgttttggcatccaaggcttttaaatgggagagaacagcagatctggttcctttcactggaatattgttatggtccaattctgcaaccagctgacttcattactacctgtgaactgcacctccagctcctccaactgaccccatacccagacccttacttgggctgtttcctaccagacacacctgctctgttaagaaaaccattattgaaatcaccggctgttaattcctactcagtccttagtagctctgtgagctggagcaagttctgtaggctttctgtgactcagtttcatcacccataaaattatgattacaatacttacttcattagagtgttgcaagggcctaaaaaacactctatgtatagctcaaagtacaagcctgacaacaaaggaagtttccagataatcgctcatcaaggggcaactcgattttctgcttcctccagaaagccttccatgctgatgtccatccactctgatctctccctaatccaatctgattgcagttttgatcagcacctcactgttgaccatggatttcttctccattacaaatgtgttcattttgacttccaagtaagagataaaggtcttggaaagaagtgattgcattttacctggctctcctactgactttctgtgtcatcttcctcttaattttggggagactgagtttctttctctgggatggcaaatacatggcctatgtgccaacactttcccatcctgaaacctcaggacacacaccagtgttctcatcttctctccagaacctgggtccagactcacaattcttcttaacacaatactttggacagtgtctactaacttatctaataaatatgttttgagtacttcgtaggtaccatcccccttggtcagtttctagaagttaaaacgttggacatcttgtatctgcacttatggaactcatcccttagtggagaagaaagacaatatgcaaatacacaaataagaaaatatcaagtagtgacaaatataatgatgaaaattaaataacggtgtgttagtgcctggggaggaggctattttttagatcaggtatccagggaaaggccttctgaggtttctcccttgatctgggagattgggtgtgggcctaagaatatgtattcctaacatgcaaacgtaggaaatttgggaaacactggcatagtgaatgaggtgagggcatagtcagaagacctaggtctaaattccgtctcctacatttatgcagctgtatgaccctgggaaagttattgaaatttctctctcactttcctcctctgtaaaattggaataatattactgatctcaggaggttttttatcaggattgaataagatcaagtatttaaaatgcctggcacataataagtgctcaataaaaggtaggcattgtttgcaacaattaggtctatctatttataactgtaatcttttgtttgaatcactcaagagacaaatccaataaatgccgctaggtaatacggtgtctgcgtgttggcttttgcctcatgaagctcttcctcttgaaaaataaattttcaaaagacattcctgtgagcaagaatgcccgagtctaaggaacaagggtcatccagttctctagtttaggcatgtttgagatttgaaagggctttggcctaatttcctctcctatcaaatgggcaccaggctacctgccctttttcactcatgggggatttctgagactcagagggataagagatttgcaaagcgtgagacacaaacagttgcagatacagacagaacacttgctttctcagaccggcaggtgcatacaatggcaaggccacctgatacaccagtcctgttcatttggaaaagggacaactccttcacattcacaagctgggctggtaagtgaagaataagaagaaaaaaaaaagaagtcggcaggaagcagcctcttcaaccagcaaagaaaccgttagaatccatccctgcgccctgatgccaaagttccgcctgccccacccgtcacgctatcaaggacacccgcctgctatcagaaagccctgggggtctttttccctagtttatcaaggacctgtggaaacatttctctaactgaagataagaattttttttctctctctttctcctttctacttctagctgtctaaaccagagggttcctctcattttctttcagtaacaactgctctgaaaagaagatatttttcaacctgaacttgcagtagctagtggagaggcaggtaaggtgggtttcattaattcatttgttcattcattcattccttccattattgtatgcttcctgcatgccagaaactgggctaagaaggctcttggatttaatcctgggcagaatgagcttgaggtctttggggaagccagactgcacttaacaattacaaaatgcggaattgtaaattgtgatctgaacttggagtgagagcatacatatttgagctgagagacagtgtgtataataattttttagatttggctcttgccctccaagtggacgttttcagggttaaaaagatgcctcagagcctagatgacttgctaccattccgtgccagccccgtctcccaacccaagtcacaattgcttgacccttgtgaaggcgaggatggaaatgacttgttggagtgatagagaggctagcataaacctgccaagacctccttcaagatttggttcattttgcaaaagttgccagataaaagatatttccagatggagggccacgcaggaaatacaaatggaatatttgttaatagctcttcctttgcgagatatgacccaaggcggccttctgcaatgtgatgggaagcactgtagcttgaaagcgtgagaggagtcagcaggcccacggcagtctcgaagtctttggaaaggggctctggcctgagcaggcattaaagatgctctgctcatcagagacgcccccttttccaccaccaccatcccaaatggagatgggacctgctatactctaagtattggattctcagacaggaggccagatatctagaagaatattgagctccttaatgctgtggctttgcataataacaacctgcactctttttttctgtccttggagtcaaatgggcttctgcaaagaagtttatccagaagtcagggatgagcactattcgaaaagtcctaagtgggcagggattgccactgattgcactgaagaatgtgttggagctcatgagactggcttccccataacatttggttgtcgaatggttccacagatgaacctgagaagaccgtgagctccctggaacaatatgtaaaattttgcatgtaggaacagagctacacctagggaatggtctttaacttttgtcagatttgtttggggcgtgtgggggttaaatacgtacatcgtaaaatttaacatttaaccactcccaagggtacagttcagtggcattaagcacataaatattgttgggtgaccatcaccactatatagctctagaactttttaatgttttccaactgaaatgttttgtccattaaacaataactatcccctccccctagctcctggcaaccaccattcgactttctgtctctatgtatttgtttaagtacttcacaaaagtagaatcatatatagtctttgtcctctcaggactggcttatatcactcaatgtcttcaaatttctttcatgttgtagcttatgtcagaatttcctttctctttaaggtggaatcatatgtgtttgcatgtatatatatgatatgtatatatatgatatatatgatatatatcatgtgtatgtatgatatatatatcatgtgtatatatgatatatatatcatgtgtatatatgatatatatatcatgtgtatatatgatatatatatcatgtgtatatatgatatatatatcatgtgtatatatgatatatatatatcatgtgtatatatgatatatatatatcatgtgtatatatcatgtatatatatgtacacataaaatagtatgcgtatatcactttaaaaaatccatctgttgatagacacttggttgcttccactttctggctattgtgaatagtactgctgtgaacatgggtgtacaaatatttgtttgagttgctgttttcaattcttttgggtttatgtccagaatggaattgctagatcatatggtaattctgtttttaattttttgaggaaccggcataccgttttcaataatgcctgcaccattttacattcccaccagcaatacacaagtactccaaaccctccagatcctcaccagtacttgttaacacttgtgcattagccatcctaatgggtatgcagtagtatctcattgtagttttgatttgcatctctaataattagtgatgtagaacatcttttcatgtgcttattggccatttgtatgtcttttttggagaaatggagattcaagttctttgcccattttgaaactggattgtttaaatccagacagagcttgtcttgctctgtcgcccaggttggaagcgtgatcttggctctgtcgcccaggcagtggcacgatctcagctcactgcaacctctgtctcccttcctgggctcaagtgattctcctgcctcaggctcctgagtaactgcgattacaggcacacaccatcacgcccggctattttttttttttttttttttaagtagagacaggagtttcactatgttggccaggctggtctcgaactcctgaccgcaggtgatccacccacctcagcctcccaaagtgctgggattacaggtgtgagccacagtgcccggcctatatgttctagatcttaatctcttatcagatatatgatttgtaaatatattattccattctgtgggttgccctttcactctgttgatggtgtcttttgatgcaccaaagttttaaattttgatgtagtccaatttatctatttctaattttgttgcctgtgcctttagagtcatatccaagaaatcttgctaaatccaatgtcatgaagctgttcccctgtgttttctttaagaatgttatagttaccaggtttttaaaaggtttgtgacaatgcatgggctatcttcaataatgattctggagtggccttcctcaccaaagcaaagacactcagggctttgtaaatatcagtgtgaatctaggaactgggcaattgataacatggatgtgatatttgaaggcttcaattcaaaaggaatgattaagtatctccatatctatatcagtaccctgggagctagtgaagatgaaaaccatggtctctcttctccaaggacttaaggcaagatgttgcaggcacacacgtgaaattattgcattgcaaggcagaatctaatgaggcacctagctaggcactaggaccaagggctataagaactcagaaagggatcaccaccatgagcttcaggggacagagaaaccttcagggtaaagatgtagcttgatctgggtccacattggacaagatttggagaagcagagaagactggagaggaatttgtactaactgcaataatcattgccatttactgagcacctactatgttccaagcactgtgctctgcccactgcatacattatctcaatgactactcctaaccctacatttatcattgtctgtattttatcattcaaagcactgaagctcagagattttcctaagatgacccagatagtaagttgtaaagcagagacttgaagccaggtttatttatctcaaagcctctactcttaatcactctactattctagtaccaaagctttagaacagggagaaagcagacatccccgatagagagaaaagagtaacacagtgcacagaaatggcacaagcaggatatttaagatcagagaggagaacaggctggatgggaaggttcagggtccaggactgtgggatgtaaagttggatcaatggagtgagcaggattacagggtgcctttaatggaagcatgggaaatttggtctcgacctgctagaatgacagaatcacacatagaatttcagctctaaccttccagtctgcctcttttctctataaaatgagaaaattgaggtctcaagaggttaagcaacttgtggatggtcatggacgatagggaactattgcaaattcttgagcatggtgttgacagggaagaaaacagtattccagatcagttagtgtggcagtaaaacacatgaggggtgactgaagggaagcagcaaaaactggcagaaaaaacaagcagctctttctctgttttttttttgccaaaggatacctccctcaacaatgggcattcctagggagcatcattaacaagattccagctctactccttcctgctgaggtttgtcgcttaagaatctggagacaggtagggtgcagtggcttacacctgtaatcctagcactttgggaggccaaggcgtgtagatcacctgaggtcaggagttcaacaccagcctgaccaatatggtgaaaccctgactctactacaaatacaaaaattagccaggcgtggtagtgtgcacctatagtcccagctactcaggaggctgagacaggagaatcacttgaaaccgggaggcagaggttgcagtgagctgagatcacgccaccgcactccagcctgggtaacagagtgagacactgtctcaaaaaaaaaaaaaaaaaaaaaaagaatctggagacagcttgtaggggcaagtgctatcagaaaggtcagaatcaccttcccctgccaggctcagtgccctttgatggcccagatgccagaaaacacagctgccccagcagcgacctgtcctcatcctccccacttcctccaatagaaagcctgtctagggtgcaatggcttagatcagagacacgtgactctgaagagccaatggccaggaatggcttctggcaccttctttatgttgccttcctgaatgtgagcctgggccaggcctctgtgaacctaactcacctgtcccatggaggccaccataccaggagaggtaagacaagacactccgttccccaggcaagaatgttgaccccaccttacttgaactaagcccttgtagggcagaactccacttatccatctatgtccagccaagaaagccctgccctggttgactattgtcctctgaggttctctttgcttagttaattctaataatagctgccatccattgagcacttattctatgttgatcactgggctcagcatttggcatgcatgatttcattttattcctacaaccccataatgaagatattgttatccctgttttgcacatgatgaaactgaggttcagggctgttaaataatttgcctaaaaccatgtacttaaaggagccaagactcaaacacaagcctttctctctccaaagcctttgcttttactcatatgattgactgcattctacactttagtccttgtagagggtagaggttctgcagtggagagtcaggcttcaaagagtggccttgttaattccagacaccacctgtttctctgttcctgggagccaagagcctgatctctttcccaaaccaaactcttggttccaaatataaatggtatctggaccattattcttctcccagtaatgatgctcaagaaaaacaaaggaccttgaagttccttctacactttcacccagagggcatcatgcaggcatgctttggccaaggggaatggtgctgccatttgtacagtcattcttttaatgaatatttattgagggccagccacacgttaggcacgttctaggtgctgaagacacaactgggaacaggtcagaaagagtttccaccctcacagagtttacattctagctgggaggaaaggccaaaacaaaacacacaccaaaaccctgcacatacatctgtagtaaagagcaaatagtgatgatgctaggaagaaaaacaaagaaggataacggggatggagagtgaggagaagaaggattttataaagccctctgaggatgaaatatttgaacagagacctgaatgaagtacatgggagccatggggtgatccagggggaaagcattgcaagcagagaaaagggcaagtgcaaaagccttccagtaggagtcagcttggtttgttttaagaaccagaaagaaggccagtgtggttcaggcagacagagtgaaggggcatgctggagaaaaggacaggggggcagcagaggccagataatagggccttccaggccacagtgaatttggatctcaaatatactgtgccggggtcccaggcactgtggtgtgtcactcaggtgtggcacctctgcatagctacagagaggagacaggctgcctaaacaaagagcacaaagacagctcagtgagtcagctcacctggctctgactcccaccttgaacttgaagcagcaaataaagcccagggtttggtacccaaaggagaaggtgggggaaggtttgacaatggcctgaggtggaagaaggagctgttgaccctgtatgtctcatttgctttgtccatcaaagggtctgaattatcaatgggtgctcaaactttttttttttttttttttttgagaaggagttttgctcttatcgcccaggcttgagtgcaatggcacggtctcagttcactgcaacctctgcctcccaggttcaagcaattctcctgcctcagcctcccgggtagctgggattacaggcgtcagccacctcgcttggctagtttttgtatttttagtagagatagggtttcatcacgttggccaggctggtctcgaactcctgacatcaggtgatccacccacctcagcctccgaaagtgtcaggattataggcgtgagccacctcgcccggccgcccaaacattttaaagttagaatctctttttataagcaaaattttccatagaaggtgactgtgtgccactttcctctccaagcacctgatctgcttcatttcacagaatccttagaacagctccacgagtaggtactctgaatactcccgctttacagatgtggaagctcaaatgcagagaggttgggcaacatgcccaaggtcaatgaatgcagaactgctgcagtgggagcaggggtgggtgacacccactagggaggtgctttcaaactcctactgctccaaggagcaagctagaaaatcccacttctcaggccccttccactaggacacactatgagcttaacactgctaagaactcactgaggaatggtgacatttgggggcggctccttcagtgctttgtttggcttcttttttaaattataaatggtggtttgaaagttgttggaggggaaaatcagatgaaatcagggatgtggctgaagcagtcagtgtagcagtgtagcagagaagcagagaagctgtcagcagcctacccaggccccgaaatgggcacagccctgcatttctggcctgaggcttgccgaggtcttaggtgaacttcagctctttctacagcaccccagtctcagcactctttggtggatgtcctgattggctgggagattgttgcttcctgatacagtggtgattacttctgaaagatggggtaataccaacagctatcgtttctgaccatttactgtgcagcatcactgtgcaaagtatttttatacatatcctattgactcctctcaaaactcctgtgaggcaagcaggcaccccagtggcctcatcctagttctggccctggtgacattatgattgcctccatcctccatttgataggtacagaaactgaggttcagagaagtgaagtaaattcccccagatcacgcagctagcaaacagctgagcttctatgctcatcctaaggctcggttgaaatggattttttaaaagatgtattttgggctctttactatatagaaaaccgaatctgtttatcactaaggttactaataggccttacatctgtgaaaacttatctgtcagctggccctgaaatgttctgaaatgagtctgagcacaggatgcctgtgacaaccgaatagtttaaaaaaattctccatgggagccgaaaccctattaagacaggtctttatttttgttcctgaatgccacatttagaaacaaaatgtcatatttttgtatatgaatgtcacaagtgacaaagcatatgttgcaacttggcttctaatggttgaaaaaaaaagagaggtaaattatcataatgttgggatcttctcaattatatttgcattttcatttctatcagaagtccattttagcaaaggaatgtaaccttagtcacttgaaactgctgttcccttagaaaacaattgtaaatgtaataagcaaaaaggatagaaaatgcccacaggggaaaaaaatgatccatctggggtcagagccatcgtgtagattgattcattcttcttctagcattcttattcaggaaggaaaacttgaacattttctagattttaggatatttaagatttgcaaggaattgggggaaagggaaaaggaatgaaatttcagtcccactggcagggatcaaatagagattttctcaacttttaaaagaaccgttttacatgtcccaatcacctcatagttcctgagtctctcttctgcataaggcatgtactagttgttaagggaggatacaataaggtcatgattgctttaaaattattcataataaaaacacattttgagacttgattctaaatgttaaacttaaatttgagcaatttaattgcccgttgaataggaatgaaatcccaccggtaggcagttatttcttacaaccactgtgtgtgaaattgaaatcttaagataccatttcaaatattcaccttctctaaggaagttctccccaaagagttgtgaaagataagaaactgacccaaagtcatatgcagtaatctctttttctttacacactcaggtcaaagtagaagcatattattaaaaagaaacgttatgccctgaatttggctgttctgaggttacctcttggaacccaaggatatatttaatttaaaaactgacttgagccccatgcaaaactgtgacaaggaaagtaataatttatcagattaaataaaaacaagcagatgtggccaggcgcggtggctcatgcctgcaatcccagcactgtgggaggctgaggcagatggaccgcctgaggtcaggagtttcagaccagcctggccaacatggtgaaaccccgtctctactaaaaatacaaaaaattagctaggcgtggtggcgagcgcctgtaatcccagctactcgggaggctgaggcagggaaaatcgcttgaacccaggaggcagaggttgcagtgagctgagatcgcaccattgcactccagcctgggtatcagagcgagactccatctcaaaaaacaaacaaacaaacaaataacacccaagcagatgcaaacaggtcatttagtcaccacgataatgaacgttaaaatggaaaacacttacatgttttatttaggagaagaagggggtgaggtgaaggaatcctgtttcctgcttttaaaaaacaggaaatagtttccaaatttgggtgggcaattcttattttaaacccccatttcacctttaaatttaatttcaagctcttttaaaattatcttaatgatgccctttactataacatagcagctgccatttatgagtgcttactatataccagttgcttttcatgcaagcaacttcatatctgttattacccccatgccattacaaatctatgtgccacccttttgtgcactaactcatataatccccacaataacttaggcaataggttctgtcgtctccattttacagatgaggatactgggagtttatttgtttgtttgtttatttattttgagacggagtctcactctgtcacccaggctggagtgcaatggcgcgatctctgctcactgcaacctctgcctcctgggttcaagtgattctcctgcctcagcctcccgagtagctggggttacaggcatgtgccaccacacctggctaatttttgtatttttagtagagatggggtttcaccatgttgggcaggctggtcatgaactcctgacctcaagtgatccacccgcctcggcctctcaaagtgctgggatcgcctcggcctctcaaagtgctgggattacaggtgtgggccaccgagcccggccaggatactgggagtttaaattcctgctgtgagcccaggttgacacagctggtcaaggatgggttagaatccaggtagtctgactccagagctactaccgcatactgcctcctcagattaaataattttcctaggacatgctaactgataagtaagagtctaaatcaaacccaggcagttgggttccaaaattccagcgtttaaccaccacattgactggttataagtaggtaaactgttcatcacaacctatatatttattttcatttctgttagaaatgaaagtagtgtggtaggttacatatttatcacatagtttaggcttgcctaaattctaagtattttcttttttaaattaaaaacaagggtctatcggaaaaaaaaaacccaactttttttttttttttttttttttgagacagggtctcactctgttccccagactggggggcaatggtgcgatcatggctcactgcagcctcaacctcctgggctcaagcaatcctcccacctccgcctcccgagtagctaggatttcaggcaagcaccaccacgcccagctaattatttttattttttattttttgtagaaacagggtctcactgtgttgctcaggctagcctgggtctcccaaagtgctgggatcacaagcatgagccaccgagcacagccgaaaaagtctttttgtatactgaagtctccactaggacaaaaatttgctcttaaggcttcctttgggacacacacacacacacacacacacacacacacacacacagcttttgattatacccattagggacccaagccttgggacacagggaccagaaaatgacaagagcatgcaggcagtagtaaactctggttatacttaaaatgggaacagaaatgtatgcctatgatccagactgatcatataaaaccatggatcctgaaagtacgttccctctttacaagccttaatgactggcatcacgcacaaataggcctttcagcttctgaacgcagatattttcaaggaactctgaggcccaggagagcctaagtttttctccacggaagggcaaactactagcctcccccgcttcccctctgcgttcctgcctctttctagaaggaggctgagagggggaagcctgaacccccaaatcaagtccgccttctttctctgtgcctgacccagggcaaaataatctctctgatcctgttcttgaccattgaaaaagcactttctctggtcgggatactactggcactttacatggggggcagtttaaccgcaggagtccgctttctgaaaggtgcagagggaggggattccgccaccagccgactgagaggagccccggccccgcgtggtccctcccagccaccctccctctgggattagctgccctggctctgctctaggcgtccccagcccgtgcagtcccggctggcgcaccaccatcgcctctgcagagcgcggccgcagcccggagcccgcagcccggagcccgcagcctggggcccgcagcccgtagcccgcagcccgcagagccgcgctgtccggggcatcccagtgcacggcgtccgtggacctgggacctcgaacctgggacgggcggaaaatccactgggaacacttgcatttctgtaggtgcttatttcacattcttgtcttttcttgcttgctcgagctgttcgtgggttactttctgccttagttaaaccaaaagggaaaggcggaagaggggaagccctgaagaatgatttagtggttgcccagcctcctttccaaggagaggtgttcgctgagcggctctccccgtccccgacactggcccctttaagaagccaagtcagtcctgatgctgctgtttgtattgctaatccccaggagccccgtttaaaaaaaaaaaaaaaaaaaggaagaaaaaaggggaggtggggggaccgggcagctgtctctttaaatgtgatttccttctattgtatttgaatcgtgatcaggaaaaaggaaatgaaaccagagacagagggaagctgagcgaaaatagaccttcccgagagaggaggaagcccggagagagacgcacggtcccctccccgcccctaggccgccgccccctctctgccctcggcggcgagcagcgcgccgcgacccgggccgaaggtgcgaggggctccgggcggccgggcgggcgcacaccatccccgcgggcggcgcggagccggcgacagcgcgcgagagggaccgggcggtggcggcggcgggaccgggatggaaggttaagtcctgagcagcagcagcagctgcagccgcctggagccaggctgcgcgccccggcccccgcctcggccgcggcgcgcccgcagcccggtgattcgctctctctctttggcgtttgaagggagcgcggtgactgtccttgagcgcggaggggcgagctcgccggcggagcgccggagcaagcggaggcgcaggagcggcggcgacggcggcggcggcggcggcgcccgagcacccgagggggtccgagccccggcagccggccagccccgcgccacaaagggagcgcccccgccgcccggcaccccgcctccctccccaatgtcctcggccatcgaaaggaagagcctggacccttcagagtaagtgcggcccccctgcccctgccacccccggtgtccacggcctcgcgtcccggagcgtcggggggacccgggcggcccgcgagggggctccaggtgcgcgctcgcggcgtgcccttggccccctgtgccgagcgctgggctcctccttcctcccgggtgattccgggggctctgggagagggactgggcggcgggcggcagggacaggggtcggcccggcgcctctgcgggccactccaggctactgggacgctccccaaagccaccacgggccagaaagtttgcacgggagcaggcacgaggagagcctggaggcgcgcaggtgcagtccggagagcgttctgggcttgactctgctcccttcttccctctccttctcggtcctttctctttgtccatttggtcttggaaaggggaacattccaagtggcggcctccggggtccccaacggccgccttcccggtccgcaggtggagccgctgccagccttgcggataacgggcgggtgaggggtccgaccgtccacctcggagctggctctgggcctccagggatttctagagcagcgaaatccggagtaaatctgagtaggtgtacccctcctcggggtccaccgatggggacatgtgaacctcgaaagttaatgcaccattttgtgtataggtgaattattctggggagtagagtctcgtagtttttagcagagtcttaaaagggtttggggtcagggaaccagagctctaatgagcattggccgcatctgttttctgagccgcgtactggtttggaatgtttttctatccctcacccattcttcagcgttaacatggggagtaaggggtgtttaagatatcattttcctgtcaacgcaaatgcccttttaagagtcattagctgtctggttttgagaatttttattcctttgaagtccccctctaatcctttgaagggatttgttacacaagaccaaaggagctggttaatgacttgtccatttgtgcttttaagagacatttgttttgttttttcttttcctgctttaaaagaattgtgctttcctgcttgaaataccgcacacacacacatacacccttcaatttcggctttctatggtgtttatttacctgggttttaccctcagttaccagcataaaagctcaacatattctcataaaacacaggaagtaccaccatccaatgagaatataaacatcactattcagtcttgaaggttaagacaccagttctgtaatgagctaggtttgttataacaaaaacccccacttccttcaacaaattctcaggagaaaaataacattcctttttaaaagtatgtttatgcaaacaatgggtttaaagggtggtttgatcacttttttaaaataaacttaaaactgagctctgagtttcagagactgggcaagatcatagtaacacaataagggagtgaattggatgaattggtgcctcatgcctttttgatcagcagaatttagtcactaatcctttcaatagaagattaatctgaaggtttcatttccctgaaggaagtttgcttctttcaaagtttgtgctttttcactgaggttagaaactgaaacatcctaacttcctaatacaacagatatctactgctggaggctcaccagctccttccttcacttcactatttgcccaacgaagacagattctgatcaaagagggacaagccagttgagaaattgctgcagcacattctccccatgcccttagaaattgttatgattgtcccagaaatccaggcttaaatgatactcaggtgtaatattcaagataagggtctgggagaatataaaatattaatttgagggtgaatcaatctaattcagtcattgtcttggattgtccactaagtataatgtgatattatcattaattaagtatagaaagacagagccaatatcttatactttacttctccatctcatctcaggccatcaccgtaactcttttactttacattcctcctgttgtccagtatcctactagatgcttcattgtgtacttcctcaaatccagcttgggtcattacaatcagcatctccaaattacagatggagacttgcctagctatatgcaaatgaaacatttggacagaaagccagccagaattcatgaacacagattcccttgctgtgctactggtggcccccactgcctcccctgtgagtaacaagagcagttcatttgaattccaggcagttttgcaccagctaagggcaaattctcttctttcacagtcctttggcagcatcaacatcgggacatccaatgtgcgtccaggttccatgagtggttttgaaagcccagagtaagaccatgggctgtggaaagagaagagatgcaactctgagttgatacacatgaaaaagctagggtattagttattagaaggggaaatggcagtccttatatacaatctgtagaaacaaaggaaagaaagcaaggcttcagtgaatgaaacctcgtctctacttaaaataaaaaaaattagctgggcctggtggtggacacctgtaatcccagctattcgggaggctgaagcgggagaatcacttgaacccaggaggtggaggttgcagtgagccgagattgtgccattgcactccagcctgggcaataagagtgaaactgtgtctcaaaacaaacaaacaaaaaactatagttttgaatttttttgagctagggtctcactgtgttgtctagtctagagtgcagtgctcactgcagcctcaacttcctgggctcagatgatcctcccacctcagcctcctgggtagctgggactactggctcatgccaccaagcctgggcaattttttatatgttttgtagaaacaggattttgccacgttgcccaggctggcctcaaactcctgggctcaagtgatcctcctgccttggcctcccaaagtgctgggattacaagcgtgagccactgtacctggccattttttttccccagataaactaacttgagcttcccattttcttgttccaaagatgatagtctcatgaagtgctgttacactgtgtctagaaagtgtgggcatggctttagcactcctaaatattcataaggaacacttcatacttcacatgacgggatcacctgaagttgtcagagtgttatagacattgagccacctagcctcctgtccccaagtataatggctgctgggctttatgggcacagaccaattaggacacaaggtcgcctggtaagttagtaccagttagaaataggagacatggatttatacctgcagggtacccaggaggaaactccctttgggaattttacagatggaagaaggtctgttttttgaaacataatagatttttaagaaatagatttgtgtttaagtaaggttccagagaacacttgctaattattataaatcaacacgtattaagtgtttgctgtgtcccatgtgggggacactagaataattccttccactcctttattttcttttagcaaagttatttatttttaaatgtaaaaatgtattcagattccagtgaagcaaagtgaacaggagatgctatgcatggcgtattaacgaaagaacacgtgtcacagcctattaacaattgctggattgagatgtcagtgtctgtttaattgccttccactctctttgaaataatcattgcccccacttcattttcttcctcaaatcaactttatccaaatcaattttactcttataaaaatgttcaggtaaggaaagaaaggcctatttgatgtccttcgtgtaacaatggccttacgatatgggattttcctccaagtattccttcagtaggaagaatggaaaatggaatttctgtaaaaaagtaaaattaggagaattcctattatgtcctgatggaattttgattttggaaagagaaagcaacctaaaataatttttggtctcattcttctttcttcctcacctctgcttttgtgcagttggttagggctggagggaggatggcactggggatttgcagattcttagcactctgggtcatctgctgccctggcagtgagcgactcttttagtccagagtgcgtcctttgaggttaggcagtgcccttgggtgtccaggttatgggaggaggaaaatgagggagatctgtgaagatagagtcagcggggagagtgggaaaaagcagaaggagaccagaggtgcccaggtagtgctgggcatgggcaggggcacagtgccacctgcaattgcctttgatgcctcttggtgccctgtgtttacttcttagacatctagggagtaaggtctggctctttcccatcttaacccaaggttggttgggactctgcagtctggccaagggatgtgttgtcctgtcccttctcccttaggtcactgaaaggcagtcaggtgagatgccctgtctggcccaaaacgatctcggaccctcggtgctggtctcactctggtgaggctgtccctgatgcttggccttctctccagggaaccagtggatgaggtgctgcagatccccccatccctgctgacatgcggcggctgccagcagaacattggggaccgctacttcctgaaggccatcgaccagtactggcacgaggactgcctgagctgcgacctctgtggctgccggctgggtgaggtggggcggcgcctctactacaaactgggccggaagctctgccggagagactatctcaggtaccctccccggcactccactgggccctcggaagggaggctgggtggtccatggacatctgcagtcggtgtgtgttgccccttaccctgctccaggctcggacaccacctatagaaagaggtcagactgcagaggctgagtctcagctcctgtgctgagaagcagagggcatttcttcctgtttgagaagcatgttctcagggttacgttcctatgtggtaaaatactaatatctttaaaggcaagagaattgtatacccaaaattcagaaaagtgcttcccttggggagcgggagaagctaggggatgggattgaggaggagtacacacggaggatcagagggactgggagtgtttctaagtttggaggtgggctctgaggacctcatttgaatgcttcagaacatatatgtatgttataaattttttttgtatgactccagtattatatgatgagaaatttaaaaatagaaagcatatggagctccaagcattgactcatagcaggaaggcagtcttcgaagagcagaaaggcaaaggccctgtaggcagttggaggtttgagtcccaataccattgcttcccagcttggtggccttgggcaagttatttaaccttcctaagcctcgatttccttatctgtaaaatggggatgataatagcacctacctctaaggatgtggggaggatttgatggaataatgcagataaactacttggcttggtatggatcaaatagatgttagctgctcttacataatcattattttccaatctaatgagcaaagggatggaagaatggaagagtaaaataggaactcgacaacaccaagtaagacaggagctgaggacatctcccatgctctgggccatcctattggccatccgaattttccagcactgtgtgaaagcctttgcctagaatgtactagtgtttctagtttccgatgagctgctgtggaggtaactgtctctgtgccctctactgtcagatctgctcaactgtgtagctgtcagtatttctccgttttcctggagcagagggtctgtgaagcatgcttccctgatacaccaggaccatccaacccatggaagcttgttgagacctcagcgcccttggctgctgggccagcttttcctcccaaacctgccctcagagcattttacattatagaaacaaaacaaaaccaaaaaaactgcaggcagtttcacagtgaaggaagctttacctaaagactgttagaagaagctttttgtccttgaattcccagataaagttcttgcagtccttgcagatatggtggttccgagaaaataagtaggattttgcaatgatcatgcttataattttggtcagttttctttttttttaagtcacagaaaatagaacttggataaatacagacctggttttgctcactcccagtttgccaagtcagtgagaaggcagacgggtaaatgattcccatcggacccttgactccatccctgtcaaatcatttgaatcttattaactgaagtgcagatagagtaaggtcagaagagccccagcttctccctatctctaccgttttatataacattcaggaataaaaccagtgctgcctgggcttgttaatcctttccattttcaaaaaggagaggaaaaaaaaaacagtctgggagaacccaatgttaattaacttgtgtcttggtgacatgaaataattcttctccctgccacattcctaggcaacatgttaattaactctgcattagtgcaggcatttccagccattctttaatatttatattattgttattaaaatgggcagcagagagcttaagatgggacatctcttgacagaggagaaaaattgtcttttgcgtcagggatggtcctttagccaaggtcttgtttactggcattcttagtatatctggcaggatcttttaacaaggcaagttggaggagtaactgaacgggccctctaatgtgtttgagttcttcttcacccctaggataacttgtccccgtgaggatttccaatggctgagttgcctgttacagttcttttccgacatttagcttcaaatattcatgagacccccatgcagaacctcaactctgctgctgtgttgtattgttgggaacccaagagcagctgttcatgtctgtgctgagccagatctccttggatcccttttcactaattcttgtgtgctgggagtggtggggtggcggtgatggcagtggttttgcttttaacagccagcacctgaatctgttagagccagaagtatgcctgccccaactagacccccaacggaccttaaccagtgacagacatggtgggagtaccaagccccgcagccttgcctggagccaggcataacttatattccagggtccctcccctctgagggactttgcctgaggatacaacttggcttggcttcctccccttccctccagcctcccctgctgccttccaggtttttcctgagaatgcctcattcataaatcactggcacatcaatccttgcctcaggggctgcttctgggatatccagcctaagataccaattcttggtgccagaggttaatgctcaagttaggtgtcaagtcccggcttattttttactaatattagaatctccgaatcccagagctggaaggggctacagagaccttctttttcagttcccttgctttacggcttaagtcacagaagcctgtacaggggactccatttgctcaggtcacctggcaagttagaggtcatgctgggacctgaacttgtctcccacatattcgtcctttgtccttcccttcatagctgcctgatgtgggttgtaatttaccccctgacttccctttaataagctccctccttccttaaggatcgcacaccccaggcagttggattcattccatgcacactgttttctcagtcgttcatccttgctcaggcccaaacttaacttacagagcagtcaggaaaccagaactgtctttccactctgtgacctccaatgtggcggttacctgcagctccaccatctgctacgttgggataaaatgttctccccccagtaatgagtttgctcccaggcggtgctttgaaaacactcagagatcttcaaatggaaagcaggattcagaggcaaattagctggccctggcccgaacaatgagctctccactcacagaccacctcttgtcaattccattaatctcgcccaaatattgcaaaatgtgtcaactgcccttaggtcccctacaacctctcagaatgtacccactgattctctgatatcctgaaatcaaccagaacttccaataagagcaagcattcacctaaaactgtcctaaaggttttatgtagaaaccacctgctaacatgctatgttttcagccacgagtgaaaattacttcctgcagcaagactggcgcagctgggaatacacccaagatgtgttaaaacataaccagcgttggcttagcccttgaccatgggtgccctgacatgcttcgtttggttgttttaacagctgagtgaggtggagcctatgatggctgccatttcactgaggctcagagaatcagaggtctctccagggtcactcagggctggtccgggacattgaagctgggtcttctctgcttccggtacttgtgttactgcacttttgctgttgcttctcaaatgtcagcctgcaaccagtcccccggaagtgttcgttaacgcacagactgctgggccttctccccagggtgtctcagttgggtagggaaggaggagggctgagaatttgtttttttgtttgtttgtttagtttttgcttttcttttgagtcaaggtatggctctgtggcccaggctggagtgcagtggcatgatctcggctcactgcaacctccacctcccgggctaaagccatcctcccacctcagcctcccaagtattaatagctgagactagaggcatgcaccaccacacccggctaatttttgtattttttgtaaagacacagtttcaccatgttgcccagggtggtctcgaacttgtgagctcaagtgatttgcctgcctcagcctcccaaagtgttgggattacaggtgtgagccactgcgcccagcctgagaatttgtatttctgtcaggttcccaggcagtgctgatgtcgctggtcccaggaccaacactttgagaaccactgcactgagccctgccatgttctgtctcccaccttgacactgaatactgcctgaaataagtgactgatcaactgaggcttgggagagtcttgatttaaatgtcagaaaagaagtttcccttttgattcatgccagtgggcagcgagggccatgaattaagatcctcccttcatggtggagagatgctgttggtcctccatatctcagaggcacgattagctgcaccgcgtgttttctgtggaactccctgtctcccagcagctggggccccagcgaataatcagggggagatgtgctttgcagcttatggaggtattcaaggccagctctccccatgggtagaatcagtggctgttgacatgatagagtttgggagcctcagaagaatgcccgttttattgcattcctggtcagtaccctctcaaaggggcccctagggtctctctccagctgctcttctgaaatgagggttcccctgggaggggacaggtaatacttgcctaactccttatgatagatcacatcagctgagagccttgcccacagaggaggagccagggggcagcctaggggaatgatgagcggttgctgcagacaaggagagggctcagaaaagggaggagttatgccagatccaaatgccagtttcatctgagttccctctgcctgctggtgaagactgcactagccggccctccttctggagccgaccttccctggcttcctgacatcctgaaagttcggcctcctttctagggctcatccccgagccctgtcttccaggattgtccctttcactgtcttcttagcttttctttcttttgccccaggctttttgggcaagacggtctctgcgcatcctgtgacaagcggattcgtgcctatgagatgacaatgcgggtgaaagacaaagtgtatcacctggaatgtttcaaatgcgccgcctgtcagaagcatttctgtgtaggtgacagatacctcctcatcaactctgacatagtgtgcgaacaggacatctacgagtggactaagatcaatgggatgatataggcccgtgtccccgggcatctttggggaggtgttcactgaagacgccgtctccatggcatcttcgtcttcactcttaggcactttgggggtttgagggtggggtaagggatttcttaggggatggtagacctttattgggtatcaagacatagcatccaagtggcataattcaggggctgacacttcaaggtgacagaaggaccagcccttgagggagaacttatggccacagcccatccatagtaactgacatgattagcagaagaaaggaacatttaggggcaagcaggcgctgtgctatcatgatggaatttcatatctacagatagagagttgttgtgtacagacttgttgtgactttgacgcttgcgaactagagatgtgcaattgatttcttttcttcctggctttttaactcccctgtttcaatcactgtcctccacacaagggaaggacagaaaggagagtggccattctttttttcttggcccccttcccaaggccttaagctttggacccaaggaaaactgcatggagacgcatttcggttgagaatggaaaccacaacttttaaccaaacaattatttaaagcaatgctgatgaatcactgtttttagacaccttcattttgaggggaggagttccacagattgtttctatacaaatataaatcttaaaaagttgttcaactattttattatcctagattatatcaaagtatttgtcgtgtgtagaaaaaaaaaacagctctgcaggcttaataaaaatgacagactgaaatacagtgttgtttatttgattacgacttataatttgggatggcggggaaatgctctgctttttcttttctaaaggagaagcaaataagcaatttactcttaggtcaaataaaaacttctgtgtattgcaagggtttgtatgaggcaggcacatttctatattactggcaattatgtaacaggtcatcatgtagctcagaggaatgtagaataattaaattgttattgtacaatatgcatttcacttcagcattgtatggagtgagtggaaggcaagatcattgcctttgggaaacttgtaacctagaaaggacacaaatacataaagcagattccctttgggagagaaggtaattacctagtttgaaatgtggcaaagatgctgagcttgacacttcgattttccaagacgggtgtctcagggtgttttatgacaagtggttaagaggacctttactttgcggatttaaagcaggcaccttggtttgtgtgtttgccttcccccgagtcaggccgcccccatgaactgatgcagagcgccaccttctggccatcaccttaaagcgcgctagcccaggagggtcccgacgtaggacaaacctagatgaagaagaatatgcttttcaatgatttccttagagtactcggaaatgcaagaagtctaaatgtgttcagttattaagacacaagaaacatgcagctaaggctgcatgttaactataagattcctttaaatcttcctaaggtttgtgatctttgttatttttaatttttttaaatccctggacagagagacaaatgattttttttcttctagaggagaaataatgaagtgatggctctcttggtctgtaaaatgctacaagtagttgggaaatttgactgcttaaggtggcctatttaaaacaaatccagttacattgcattccagctcaggtgatggaaaggcattaccagcgaggggatgtttgttctaagtcagtggttctcaaactctctggggaccagcagaatcaacatcacctggtaacttattataataaagaaacagattcatgggccccaccccagataccctaaatcagaaaatctggggatggggttcagcaatttgtgggttgtttgtttgtttctttgttttgagacaagatctctctctgtcccccaggctggagtgcagtgttatgatcctggctcgctgcagccttgacttcttgggctcaagcaatcctcccacctcagcctctgtagtagctgagactacaggctcacaccaccacgcccagctaatttttatctttttggtagagattgggtttccccatgttgctcaggctggtcttgaactcctggactcaagtaatccacctgcattggcctcccaaagtgttgggttatagacatgagccaccgtgccccacctgtgttttaatatgccttaaagatgattctgacgcatgctcaagtttgagaatggctattctaaaatatctcccagttaggaagatcaagcattctaagttattaatatttgatgcaaaggttaatcactgaaactcttccacatgtagatactgtctacccttggttcctaaactgaaaactttcacatacattcatcactcatttgttctgcacatcatcttcaaaatcaatcacaatttaattcaccattttaaaccatatttacagtaataatagtaatggtaatagattttatctatgcaattatcttataagcagtattaagtaaaaatacaaatgatcattgctttggaaatctaaactttattcttaatccccattgtagcacaacacacattaagattcaagaaatcagccaatatttttgtcatgctcaacaaagcaataattaaccttttccatttgtcaatggcaccatcttgcagaattgtggatgcgcaggcagtctttgtagcacgtcaccccaggggcccaaatatctaacccacaactgacttaagaggaaagacatgtaaa

SEQ ID NO: 14264 - DNA, 162465 bp, Human
agatttattttttaaattttattaatgtgttttcccctctttttcttgttatttttctcatctgtctgttcatacttggatattttgtccaataaactatcttctaaggactctgaaaatgcactgaatatttttggagggtttactgggtgccagacgccactttaggagttttacatatcctctccatttcatttagttctcttagcacagagaagtgggagaagatagtcccattttacaggtgggatgaagagagagatggaggaatttgccccaggttactcagctagaaggtggtgaagaactcaagccttcggatatcagcgcctggcatttaactaccaatcggtcctgctgggactccggctcctctggcaccatccccgggacctactcagagagtttgcacgtggccggtcgcgttccatcgtctaacaaggtccagcacagcgcaaatccgaagatcgtctaccccggggaaaaagagagtctgtttaattctcctgtggccctccaagtgagttcttttgggttccattgcctagacgaggaaagtgaggctttgcctgctctgcgctcacagggtcggcaagtagtgggaccctaggttcctgcagtattccagagataatcaaagctgcacaggtctcgtcatttttatgcaaaggcgtccggaaggctcgaactctcccttgcacaagcccatctgtctctgtgcgccgcccccgggacacggaagcaggcggcgagcagcgccgagtgggtggagaaccgtcccccgccactcacccctcggccaactctccgcgccttctcagccggcacccacgaggccgacctctctcggcctaaaaaaaaaaaaaaaaaatcccggcctcccctgcaccccgcccgccgcccccagggagctgcattaatattaatctcgctgaataattgaaggccagagatttattcgagcttcggcgggggagggagcgcagctgggccgcgtttaggctgcaccacccgcgtgtttcagccgctcgactccgctggacctgggacccccagacgtgggaggatggggtgggtgtgcctgcctgtgagtttgggggtgagtgtgagctgaagcgggtgctccggggagtgaggagggagcgccaggggctgctccagggaggcggagacggaggggcatcccgggtctccgcgcggtcgcctgcgcttcaccccgcacggggtgacctggggccacgcgggcttcaggggaaacaatagctactccttagatcctgggctcctgccaccggctgcccaagccttcccggacgagcggcggggcctcttttcttatttggctaatttatggcgagaggctggggggagggatggcagaggagggaccgcgactggcagatgggggcggggggcggcggttaaaggagttgcccgaggcggcggcgcgggtgatgtcagctctcgacgaaaatagagagggatcgcctgcaaatccccagctccggcggggctaaaccttgcaatccctccctggccggcgccgagccagagcgcagcggcctccaccgcctccccaggcgcgcacacacccgcacacgcgcacgcacgctcaccgtcctctgccaccactctctgctcccgccactcgccgcgcccgcgagccccgcagcaaagcacaggtggcagcggctgcaggggcgcatcgccggcgtgcgccctcctgcagccctgggcgcatcgctctctcggggaagccaccctcggagcccccggagctccccgccaagcgccatccccgcgggcggaggggagcgcgggtcgcgcgccgtggagagccgggacgcggattagcgcccgcaggagcctcctgcgcccgttgaggcgctaaagggcttaccccggaggcgggtggaagggcgggcagaggctcctcttaaataccgctcccggccgcacttcgcgctcaccccggcgtccgctttctccctcgcccacagctgccggatagtgctgaagaggagggggcgttccccagaccatggcatctacggaagggtgaggggatttttatctgtacccgcgggaaagcggggtcacgcgcggggtggtggcgcccctatccgggatgcggatagagaggcggcggcggcgggcctcggaggtggtggcggagccgtagcttggctggggatgggatggtggggaggggattgattttctttcctggagattgctgcttaatcctttgaaaatgcgagaggtggagggttgttttattttgataaaaagggtaaggtgcgctgggggcctgagagtgtgaggaagaaatcctcttgaggttacttttgggatttcaaaacaataggggattgggcatagtgtgagcagacaccggggtagcagcgcctggagcgcggcgccccaggcccgaggcgggcttgcaggtggtgccggctcggaaggaatgagccaagacagggccctggggcggggcaaggaccagcgcgcgcggccttgaacgccaggtttgcagagtcgccatggagatgctgggcccgctccgatcggtccttgtccctggaaggcggaatctccctggctagctctaaggaagggtggaagagatttgggtgcttcccgggaggcgggaaaacgtgtggtttgggacaagggcaggagtcgccagactccagcgggcagggatagcattggcttccctattcagcccgaggatctggagtcgtgtcctgcctcccaagattccagctggcatggggaaagctccctcgcagtgataactaaagacaattgtctttagcaagagacagaaggggctgcagggggcaaaaggattctttgaatactcacacatcaaaggaaaggtccacagagtccttggaccagtatctcccagaaaactttttgggcttcgtagaacctgagtggcaatgaaaagactgggcagctcagccctttggttaattcccaaaattgcagttactcacttgcaagcgatcacaaaatccatgttatgtgaaaagcaaatatcaggggcttctctgggctcaagtggtggtgttggcattttccagtttctcctaagaaattttaccaactccgcaggcttgttttaggggaatggatctctaaacaggctgaagagctggtatccaaagccagatctctagactgcaatctccaatagaaggaaaatatttctagaactgtctctctgtccaggagaaggaattcattcattttctgtcccccagagtccttccaaaggcatctggcatcttgtcattgcatgaaattttgtctctccctttgccctattttgcagtttagacttttttgattattatttctccaaaaagatgtttcaggaagacacctgtgtacaaggagggtggtaccttgtgctaaaacagatctctagaaatagatactaggagcccatatggatcaagatcagtgtcttaccatgtttagttaaaaaggcttttatattagaaaagatatgaaagaatttctggttgccttcatggaccttctagacttatccttgcttgtaaaggctagggtggaaaacatctgtgaaaaagatggatgatattagtcttccaaatcctgcatccagctcactccctattttgatggccagatagagaaggagaggttacaacaacaaccccaaactaagtaagtttatttcacctttgtcctaaatgaaagctgtcaaatgatgtgacattcaatgtagagccaaagtgattttcggcattttagaaagattcccatccaattaatcccatctttctgcactgtttatggttaagaaaagattcatcagaggaacttatatttaagagaagaaagaattgaaaaaagttgaacggctgggaaacaaatataggatctatgacccattattatttaacagcagtaactgatgagcaggtgacattctcagaagccctggtctttcctttcttcttctcttcttttcttgcaggagcatttactgagcacttgttgagtggaactcacatgtgaggaactccgagttggggggatacagaaatagtctgggatttgccttttagaagtctagctccatccagtcaaggatttttattagtaaattgttcacgtggactcatgagatctcttgcaacttctaacatctttggttaatgtgccttgtaaagaaaaatttactaagactcctcaggctgtctcctttgttagcttttgccctctaacaatattgaaattgtttccttgaaacatacattactgagaaggaagcaaaaatagcaatatagttatatgctttcaatttatatattttcagttcaactttgtttgatccagaatgtttggggaataggataatatgggaaactgaccattctggttcacatttatttggtgatgtaattatcagccgcagaacatgttaattaccaatttctaaagaattattagaagcaataatgacatcttatgtttgtttaacacttcactttcaaagctcattcgtgtacctcatcacatttgattcttccagtaactctgtgaagtaggcagtccaacaaaaatagactttaaggataaaattatatatagggaataccatcttttcagaaagattccaagacttggcaaagctttggggttatcatctgaaaatgatgtgtgctgggcatggctggtgcagattactggctttctctcaaacttttggcatacctatcctgcaaattgccttttaggatattctctttgtaacctgtgcattgatctttgcctgtacagagcatatgccaccacagtctggttttttgagggctttgattatttggaattgagattattagcatccagtttctataaaaatcaatagtggactctttggtagttcccaggctctgagaggtattttcctgcaaagcaaggtctaatttaatagttgagcattcttttttctgagtcccctgtcatggctagaattacggagatggcttttaggtccctgacccaaattggaaagagattataagtagttggtggcagccaggctagtgtccattactgactgggtcacagtggagtgtccagatgctgaagaggcaggcattttagaaatatcttcttggaggtggggggtggctaggtcactctgtatgtcagagacccacggcaatctgtcttctgatcagctcccaggagccaagggtcaggggaaagccagccatgagggcttgggcttcagtttgacttaaagagcaagggaaacagaaaactgctgacagtggaaaaaccctggcaagggagaccccttgaatttattatttcaagcaaataaaagcaaaccataaccattgtcctcttgcttctccccttgggaatgaatttgaggtcagcaggaggaagaccctacagcgtggacttattggaaagtgagtgaaggatgtggggcttatggtctagaggggtttgcaggttgcatgcctcaggcttggctggaattttcatttctcattttcaataatatagaaatcagcctccttggggaaaatagatattagtagagctatgagaaaaccatttcatgtttactaagacagtcgcttgtgagtaattgaaagcttaattctcaggaaataatttctaaatccagatgaaacttgtgaggcagaaactccatgttattaaaaaccaaaagacaaatctgttcatcagtatcaatggccacttcttttcctcttccatgcaacacaattaggtgttttgtgtctcctttggctttggctttaaaggatgtgtcagacaaggaaaagtccttaagtgatgatgcttcagctgcaaaaaacgagcaatatatttaacagctaagtgtgagatttctgggtcagtgtgccataaatcctacagttccagaattgcaaagctttttcatgatttgaagctcaacacagagtgatttcaatgtaaatcctcccctccctgccctcctccatggctgtgtcacacaatgccctgatgtctggtttccccccttttaaaggcaaactgaattgtttctcatattgaatttttctcccattggactggcttgcctcttggcatgagctgaaactattcttcatttcagtcgcctgctacaattattttaatctactaaaacactgatagtattaaatcttctaggaatagtaggcagaagcattattctgaagataaaattttagttttgcttgcatttaaagaacttgtcttcgcagtctgaagaaacatctaacaaacaccagacactgccttgcttgcagcttttgatttcatgcccttaacagcttgttgggggccaggcaggatgcttcatagaaagggttttagaatccagattatggcaaatctctttatttaccacgatcatgagcttgctctctcctccctctgcccgcccctcaccccgcaactctccaagtgccaactccttggaacgaattaattaaaggaatgtttaaaaatatctctttgctccatcttcaagtgctccatcattgactggaggcagatgggccacatatttgtcggtagaatagaaaaggactagcatctcattataaatctgtctggttggctttaaatgatgtcagaaaagacaatgggcccgcagtattaaaggagaatgaaaggaagatctttaaaattttaaaaagaagacccattttcttagtgctctggtttttcttttaaaaagtattgtttctcaatggtgttgatatttatttatttttcattcatgtatttaatgtctcacttagataaacagatatgaccactgttggctgaactgctgtttggtgtttttggcaatctcgacagttgctttagaatatggactcactgagcaagaattgtcctttgaaaatggaatgaagggaatgaactcgatttgatggctagacttgatctgtgtcaatcctggtctctaggatagatgatggcaatgttaaagaccttgaatgatgtttggggtcaaggagggagatgctgtccccatgcccccctctattttagaggcttcacttaaatcactgagagtactttcttctcttacgtttggtcaggagggccatctgtcacttgctgtttgtaatctggcacaggactttctgtcatgtggttctgccatcccaagttcccagccactgtgctgtcaggatcacagagctggtgacgaagttggaagtgaatctgagacctgtctgcctcccgctttgcctttttcccagcactggacatgaggtactgggtgcctgtggactgtatgtggcccatgggtatattcttataggctcacagaggattttgaacatgttttaattgttcacctatacttacttttaccttaaaaaaaatcctgattctggcttctcttaaaaattgggagatctgatgacaaagaaccttcccttttatcttggtaccatttattgagtgattatatcccagttggctttaaacagtttaatgtgtatcaatttatttaatccccacaacaatatgatgcagcaggagtgactcttagcctcattttacaggtatagaaactgaggcacagaaagagtaggtgaattgcccaagattttacagccagtgagtggcaaagctaggctttcaaaccaagcatcctggctctgggatccatgcctgtagttactaggccatacctcttagtccagcagggcaggggttaactggggctgaggaatggccatctcctgagatagggcatatgcctttcaggttgggcacagtctgttctgagactacttttctcatgttacctgcctgaccccttacctttccaaggaagttattgagagattgaaagcgtgcgtaccattctcttggtatacaccattgcctagtggttttggatttgaagaattattcaaaatctcatttctatgtaaaaaaaaagatctttcaagctacctttccccccaccccccaaagcacttcttgttattttctttaactttggtctgggttgtacataatggagaggtcttttgtaattattggtttggtagtcaggaagccaatagcgttgtctggtctagaggcagtgctttgaaagagcccagggcatgaccacatgggtcccaacctttgggatattgaattgagccttgggtatgtgctttgtagtggcaaatgtagctgagcttatagcaggccctggaatttatgttttcttttgcagccttcaggtgtggctgtttagggttgcgacttaacttacgctctttactgaaacagcgactggtcttgtccctctaggagtggggctgatatttatttcatagcagatgcaaacagtgatgagctaaggatgccttttgaattgaggaagaaatctttcagaggcgtatttctgtgttttaaagagtgggacagtttgctcatcacccaacagatggcagtaaatgtcagcactttgtccacactggtggtctgactccctttggaagcccttcaatccttagggaatcccaattcccatggcatttcattctcttttgattataaaagctttctccaccaagtatagaatttggtaagagtgaggcaattgacatatatctacagtgttccatatcaccataaacaaatataaataggatcagccaagcttatgtggctatatatatatgacttcatttcatccttgaaaatcccctagggaatattatctcattttagagatgaaaaaactggaacttagagaagttttgattttatgctgttactgagtttttaggttttttttgtcatctaattgtactgtgttttgtattatccatattttgcaattaatccacatttccttaaaatttcatggatccttcctttgctttttatttttgttttgttttttttttttgctccagtaagtgtcttcaataatttcattcaaagaaagcaagataacctagtgtctctgaagaaaaaataatgtaagaatcttaaattcttaaagaatcttaaagaatttaagaggcaatgccttaagaaggacagcaactattacagaaagaagttattctttgagtggagatgtgccattcaaaagaaaatgtcaccataaaaaagtgagaataagtttagttaattgaaaatgattgtcaaacctatttgtagatgtcaaacaagataatttcaaatggaagaagtagtagtacatgaagggagataggtaaaagaaaacagagaaaagaagaaaatcattcttctctcttagatatcatggaaagctaactgctgcagattgtgtttaatctcaatctttacttaaaaggacagttgggctgggcatagtggtgtgcacctgtagtcctagctattcgggaggctgaggcgagaggatctcttgagcgtgggagttgggggctgcagtgagctagctataacaatgcctgtgaataaccactacacttcaacctgggcaacatagcaagatcctgtctctaaaaaaattaattaagaaagaacagttggaatctgatagatttcttaggaaagtggatggacatcaacatgaacaaaacccaattaaacaaacttgttcaagagtgaaatggatggttatcaaccaacaacacacatctcagacattctaaagtggctgatggtacctggggaattggttcagctatcattttttctatttatatgcaacatatggtctagaaaaggtgtgaagaataaatattgggctaatttctaagaatagattagagagtaatggaattatagactgaatctattttcccaggatttttctggaactcaatcccatcaatcagcagatatttataaaatcatcatagaatcttagcatttgaaggattattgatttttaggtcataattaattgctaacatttcaaatgtagaactcattatctattagtctgagagcattgaactttagattcttttcacaggtattgatacactggggttgaggtgtcattggttggtcccaggaagcagattctgagatggagacttgtgtgcatggaatttattgggaggagctttcagcgtaaatccttatgaaggaatgagggaagccagggtaggcagagggagaggttgaaacagtcgcaccaaagcctgcccacccacaaggagctctggaacagggatggcccttcagaatgatcctgaattgaggaaagagatttggcctttctactcctgcattaaccagccattgaatggggctgtgctggaacgggacatggccctcggtacagggcaaggcttggggttggggggaatatagttaagagctgtcacttatcaacatgcccagcagctgggcaaatgaatcattcagtcctgaatgtggggggaaagggatctgggtagcatgtcacagcatccaccactgtttccaaattcaaatgttagaaagataataaaataatgagtctggttgcttgtgatcagaatatccaggcgtccacaaagctatcatctgtaataaaatgctataccttgctggtcaagtgatacaaaatttcaggtagtcaggaggaataacattaagtgatctattgttcagcatggtgactatagttgacagcaattgactgtgtacttgaaaattgggagaacagtagattttaagtattctcaccaccaaaaaatgataagtatgtaaaataatggatacattaattagcttgatttattttattccacagtgtatgtgtatatcaaagcatcatgttgtataccacaaatacatactattttttttgttagaaataaataaggaactaaataaagctctatcttaaaaaataaaaacctcaaatattacaaaatggcatacagtaaaaaagtaaaagactatctccggccccaatcctgttctccagaaatagtcatttttttttgtctgccctttaagacagggaaagtggattctgatgggcaggctggggagaattcaaggtcatcatcttccttaggtttatttatttgtttatttatttatttgtttttgagacagagccttgctctgtcacttaggctggagtgcagtggcatgatctcggctcactgcagcttccacctcctgggttccagtgattctcctgcctcagcctcttgagtagctgggtttacaggtacgcaccacgatgcctggctaatttttgtatttttagtagagataggatttcaccatattggccaggctggtcttgaactcctgacctcaggtaatccatccgcctaggcctcccaaagtgctgagattataggcgtgaaccaccatgcctagccatcttcctcagctttagctgtgtctcacatagtcaccaagtacataagagagaagcccttctcttcattccagtccttccaagggtgccatgtccaatggaaagatggttatctgaaagtcctgctatagagagagaaattagttacattaatctaatttctatctagagtggtgagtataatggaaggggtcagaaggaataataaataaatatattgggaacaagagtatagctattattgacattttcagtgttgacagcagccattttcacactcctgcaagtgttatttcccatggagtccttacctggggaaaagtgaacaatgaattaggtaaatcctttctggaatatccactgcattgttctgttgattcaagaagtcaggtagtctgtcaacttcaagccaaaggtacgtatatgttgacatttctctgttctattccactggcaaatattaagatatgttcagaggtgaaagaacacttttgtacacacaacccaaggtcttgcaaattatatcttcgtgagtgttttcccttattttcttgcatcagttgactctgctttctgagaccaagacattgattatcattgtgtttgtgtttttatcagcacaacaaattaattccagtgactcaattgtagagcaacagaaggtagagcaagccaaccaaatctcattggaaattgccttgcttttctttccttacctgtttttaatagttacaaatctgttatttaccatggcagatcgatattatgcatatttccagtttatgggtaaagatgtcactgattacattcaatctacatttaggaaatacatttttgcacatagaatgtaacagccaaataaaagagtgtgaatgattcactattcactgtcagataaattatttttaacaaaaacttttacccttttgtcctctggaccagtggctccttccccatcacacaaaaacatggctttattaacaataaaagcaaaacccttaaatatacccggcatacctgaaactgggaataaaaagaggtttaattggacttacagttccacatggctgaggaggcctccgattcatggcgagaggtgaaaggcatttcttacatggcggcagcaagagaaaaatgatgaagaagcaaaagtggaaacccctgataaacccatcagatcttgtgagacttattcactaccacgagaataccatgggaaagactggccccatgattcaattacctccctctgggtccctcccacagcacatgggaattctgggagatacaattcaagttgagatttgggtggggacacagccaaaccatatcaagggggatgaggcactgagactagttagaagatggcagcaatagtttaggtgggagattatgacctgaattaaggtatagaaatgagcataggttaccagattccaaggatatttagaaggacttggtgaccaagtgcaagtaggtgtgagcaggtggaagggcttaaagccatctctcagccttctagattaagcaaatgggggcgaggtaagtgcagaaaaaggaattcaggagagaaattaaatttgaagaagacagtgaatttggttcagcatactggcttagcatttgtggcgagtggaatatcagtagagatgttcactgggcagttagagtcatgacaggccggggcctttatggagtgctatttgtattacagatgtaagggagctcacccgcacacagcatgaagctagagaaaagaactgggctaagagaagcatcctgggaagctctagtatctgaagatgggcagagggaggtgattcacggggtgcggggtgcagggtgctgagaagtaaggaagggagtcaagagtgagcaggtgacttgaagtggccgacagtgctgcatgctatggagaggtcaaatcgtggaaggactgaaaagtactcattggattagtcaatttcaaggccatcattggcctttgccagagctgggtcagcaaagtgatggcagctgttgccatgttggtgtgggttgagaatgggtggagagaaaatgaatgcaaattatttttttccataaatggtagtcaagaggtagatggtactaggaaagcagataaggcaagagcaggattatatgttgggttgttttagttttaggccaggtgtgctataagcctgttcatctgctaagggaagggcttgattaatgaagaggaggtcttgaattatccgtggaagatactgatgaaggaaagagttagaacctgaggctaattcattgctcactttgggggttcctgcaggaagagcagggtgcctctgtgagactgatcccacagtataggggagcactactcagaagggacagggaggaaatggctgcctgcctagatggtcaagtccacatgatcaaccctggtcatctgtagagtgacagatggggcagccagcttgtccttacttctatagcctcattagtcagcaagctagagttggatgtattttagtagtgcttgctgttttttttttttttaagatttaccttttaagtcctttctaagtctccctagttggaattcttctctttcttcccttaacccttcatcatttatgctcttgcatagtttgtgaaaattttattggacccagttttaatcccaatctcctcttgggctctgcattccctttaaatcacttcctggatatttgcatagcacatgtatcctgataactcccaaatgtatgtttctatttcaggccttttttctaggttctagattcatatatcctacaacctaactgatgtctccatttgtgcaatgcatagatgtctggaaattatcatagtacaatggaactcttgatttttttttccctacaaactcatctgtacccactcccaagtttccccatctcagtaaattctatctgtttagagattcaaagccagaaatgttggtattaaccctgccttttttttcttccttcagcctcaacctacaagcttactaatttctacctcagttcctcagatatcccacggtcttgcccacatttgcattctcttttccagaaccactttctaccctaccaccattccacagatgactggcaccctctgatcctggagcatgctttggtcctcagcttgaataatatttcccagagaggccttctcttcccattccacctaaaataggtctctctttcctagtcctacctcattccccttgtttgcttccttcactgcatcaattacaacttttacatattttatttatctgtctgtttgtatctacaaagtaagcactttgaagactagttcatcatcatgtcctcctagatcctaatgcagtgcactcagtaagcatttgttggctgaattctcatccttgtcagcctggagaaggagggaaggcttctcagaagaggtgatgtttgagttgtgcctcttccagggagtctgtccttattacactttgttcagacctctctcatagcaactcatcataacagagtgtgctaagtgttttcttgtctgtctgttcactatcctggtatctctctgaggatcagggttacattaatttctttgtgcctcatcttattatcattatcacgatgaatgttagtataattgaattgtctacctcgcaaaagagatatgcaagggcatagagacgacagaagggaacaggtgtgggaggcaacagatccaaggttgagaaaacatttccttttgcttgttgggtcatggtcatcttggtaaggttctggtggtcaattgaacatccccattcctgcctaccagtcaataattaccctttgctaggggttaatagggttcaaggaggttacaagaataatcagttgggaagcagctcatcttgtgaagccaaaaatgtatttgtcacagtcattcatgtccccatgcagctgtctgggaaaattacaaactcctgtatctgcagttcttttaaaatgcaatgaaatttcatcagaaaagaatctttgagcccatcctctgtctttcccaggatgcctgcctcctctcagaatcatgtctgtctattcctttccattgttctttgtaaaggaaaacaaggagaagctagaatgaatttgatattcagatacaaagaaggaatttcttaagtcaaagcagatttttcaattacattagttaaaaaaaaaaaaaaaatccagggcttgaaaactgatttagaaaaagaaaagttaccagaagcagacaacgttgttgttaaattgatcttttaactattaaagagacacttagtatgtttaatcagtctcaatagagttcccttactctggttttgtatgggtctagaaataataccttgtagttggtatgtgtgttttccagcaacctaaataaaaatgttagctattcttatatttcctgaaatggagttcttttctggagttttctggtgactggacatgttgggagatatttattgcatcctggtgggataagagaagaaaaaccatggctggcatcttctttcttgactctgcgagtcctcacagtgcgagtcctgtgattggatgaaagatcagtttataaaatccccttcctgagccttatgggaaagtcttcagctgaagctatcctcatcatccttatggaaaatgctagaatcctcctagattcagagccagggcactcaaactgctgtttttgaagtgaaagtagagtcaaagccgagatgctgggttttctcgtctgctctgacagggaagccattgttagttgcgagaaccaagcatatacagatttcatttttactttatttgctttctctctccctctgaagactgtcaatggggttcaaggcaagtaaactctagatctcaacacaaaattcacacgtgattgtccagtggtcagacagaccgggaacaatttgcccagcagggagcactgtggagccacacctctgaaccatggtgattttcctgctgctttgaaggaagagcgagagggcaaattacctctttcccaggccccgcaccagctgttgtcttggtttccaagaagggaagcccaaccactttgtttacattccaagtgacctggagtaacaaccggggaccagctctctggaggccaaggctacacctgggacaactggctgaggttgaaagtgagttgacagcagttgccattcaccagcgggtcctgggtcctcgtcctcatccttgtctttgtcctcttggcttcccctgggagtcatcagcggggttcgaacaagatttgctggttccggagcttgggtatgttcagcctggttttttctgggttattgaaaaatgttttaaggtgaatggggcaaccctgggttagaagggaggccttaaaagcaggaagcctagacactcaagggattgaaaaaacatttggaaagggttggaaaggccccaaaatcaacaacacaagaatggaggcatgaaaacaggtatttcttttcaaaatgacttaccagccacccccaaagtctagcttttaacccaatgggaagcaagcaacaaaattaaaataggtgtgaaaacgttgtgtttttggtaaagggcacactgccttaggaggcgcccgtggaggagcagagactgatccacgtgtccatatgtttgcttagagaggactttccctctttgcctttgagctaagctgctgagccaagccagcaagatgaagatgttcccttgcttttagggaacaggaaaatcaggattctgtccagctgtggctctagtttctggttagggggcattaaattaatccttgagtttctcatgtcataagatcacaggatatttgttgaataaataaatgcatgcagccgaagagctcactggatgagttctttacctcaagaatttctggtttctccttcaagacaatcttagattatttgggcataaacataggaaccctgggaagcaggacctgctttatggatatgcgacttaggcagtccacggtttaatgctctgctcttatcatcttgaaatgtttaatttgaacaaggggtctcaagatttcattttgcccaaattacgtgcagacccacacattatgtagccagtcctacagggcagccacacatgtgcaggcttgcatgaaatcctcttaccagtgacagtgaacatggtaaagatgacagatgaccttgagacaatctgccttctggcagtgcactagaatattctcataaggagatactttcataaaacagcttctgagccagtgttgcacagcagttaagaagacgtgttttatactcagaaagacctaggcaaaaattcctgttccaccactcagtagctgtgtgactttggggaagttaattagcctctctgagactcagattctttatcttttaaataaggacaatatcacccacctgatagggttttggaatggatgaaagcaggatgtgtgtgaagcgttcggcatagtgcctgggacctggaagatacctataatgttgattgtcattgttcttcttggaatagcagtactgtgttacttttagtctgttgagcttagatggggttatccatcagtctcttgactttgcaaattaggctgctaacacttggtgcatacccaaaggtatgtttgctaattcttttccatagagccacaggtgataagattagaaagtaggccctgggcttctttgatcatttgagtgctgtatttgctctagcgaagggttgtttgaagatttttctcttatgtgcttttaatccataactgtttttacttccaacacttctaactccaaatgcgtggtgtctttcccgacaccaggcaggtgtcctgcaagtcagttcagttctgatgctatccacctgggctatggctatcctacagattgagggctcagtcccatgaggttgccttcacttcaggtgtcagtcacaagtcccaggttgtctctggtacttctgactgacaggctgtaatttctaatttcagggggtttccacaacaccctcctcaagttcaataattccctagagcagcttacagaacacaaggaaacattttactgatatttaccagtttattataaaggatacaactcagaaacagccaagtgaaagagatgcatagggcaaggtatcagggaagggctcggagctttcatgcctctctgggtgggccaccctcccagcacctggatgtgttcaccaacctgaagtttttcagaccccattgttcagggatttttatggagggtacattattaggtatgattgattaaatcattgaccattggtgattaacacaatctccagcccctctcccctccctggaatttggtgggtggcactgaaagttctaatccttagtctttctggtgagcagtccccatcctgaagctatctaggggcccccagccactggtcatctcattcgcacaccaaagtcacccaaaggttttagctatgtgccagcaacttgggacaaagaccaaatatttattttttattgtatcacaaccctctaatatcaaagtctccccaagcaacgagtgcctgactttccactcattcattcattcattcattcacaaactttctaaaaatataactgattgtttcaggtgatgttgggtgggggcacaggaagtaaaagatatttcaagcctaggacaggcagccactaggcaggagcatcatagagggcccgagccttggaagtagggggtggactggatgactgttgtttcctttaacactgagggtctacccccaccaatatggcgctttaaggtttccaacactttaaagcatctggaaggccaagatgagtttgagaaacatgtgacagaatgttacaatcagcaggtgagtaggtacgtggataaagggaatccatgtggtgtagaaaaaaaatgctcatctctgaaataaaacattaaaaaaatagtatgcagctaggacgtgtaaaccaaaaataaaattctaagctccccaagcaacggagtggacccctcctctcacccaagggcattctaaagcaaacctgaaacgctggtttaggccatgatgaggatgggtggttgaacatttctcattataccctccttcctttggaattcaggtacagctgactagcattaacattaaaagagaccttaagactgacaaaaaagactctttgtagcaataagatatcaacatgacggataacaggccctgaaagaaatcaaagtgttttaccctcaaatatattttcaacatattttgaaatgccctgcaaaagctgtctcttgtggggaaaatctcccttctgtagaaaatcctgttccttttccaggtctttttttctgatccaggagagaactaagagtctgacacatttttaagtctgataagaaacacttacagtccattctctctgaagcctgctacctggagacttaatctgcataataaggaccttggtccccacaaccccttatcttaacccagacactcccttctattgattccaggtctttaaataaactttttcaaccaattaccaatcagaaaatccttgaacctacctatcacatagaagccccgcccacccacctccttgcttccagttgtcctgccttttggaaccaaaccgatgtgcatcttacatgtattgattgatgttttatgtctccccaaaatgtataaagtgtgtaaacaaacaaagccatagcccaacccccttgggcacatgttctcaggatctcctggggttatgtcacgggccatagtcactcgtatttggctcagaataaatcttttcaaatattttacagagtttgacacttttcaccagtaaacactaaaagacttctatttgattatttttcaggagaatcaagtagttagacttaaaaaaaagttatccctctagaaattttcatgggattgatttttcatggatatacctataatatatgtggctggagtaaaccatattaaggcagcattctgtaaggatggagagtttatccataacgaatttattcatcatagatgaaatctatactaattagacacaagcatgatcttcaaaaactccacaatacttatctcactaaccaggaataaatgcctttaacattggtatattttatttcagatgcatgtacacatgtcaatacattttttatagtgggagcataacctacagatttttgcaacctacaatttttacttagcaatgtgttgtgaatgtatgttaataagtgaatctataaacttgtttaacggctgtatatagttttcattttttggaggtaccatgacttttacaaactatctcctattgttggatatttagcttgtttctaatttttcactattataaacgttttgcatgtacacctatgctgacctgtctcactatttcttagggtaggttgctagaagggaaatcactgggtcaaatggcacacatactcattattttgacacatgctgccaattagccagtgtctgaaggggcaggagattctccaatgcagttgtctttttgagtcccccttaccgctatgtctcttacttgcagttgtgatatcaaatggctctggggttgactttgaattcctcattacatggcaaaatcttcagccaggtttaggctaaacaaaaatctttcttctgtatttggtgagctttttgttcctaggttggctgtttatagctccctaatctttgacatcccacatcaccctatgttgaaattgtcattttaaaaatgtaaactgtagcacattctctaatttctttctgtaattgtgcagagttcacattgtatttctaagaactttgctttcttctactgagtactttctctaaaatggtggctcccgactttattcagggctggtttcttctttttggccctgcagatggaaagagctgaatatcccctctattttgagtaggaatagatgattgaatactccgcatacaaatggaaaacgcatcatctatctgcaggcatcatgattaccaggtttgattctcatgttcgtaactatcttgtctcaagacccaccattgcctcctccttctcctagctctacctcctgctgtggctctccagattttgtatttacattctatgatggttcttcatttatataacaaagtgtgatggagaacaggaaatcttttagagaaatcaatcagggaaaatcatacaaaatggcttcattatctgggtaagtcaagctcaagctgtttataattagagtacttaactatgcttgctttagtgtcccatgagccttaggaggcagttgcaggaggctaagtgttggtgaagaccaactcttgacttccttagggataaagagggactaaattgggaggacagcagggtaggggcaagaggaagaggaaagaagagtaggaagtccatgtgaaaggcaaccgtgggtaggcttgctttttccagactggtaggaacagattccaaaccaaacatttttattttgtgagtaactggcaggctgatgcaaataaactctctcaaatgaagtgtctcctagaatccctaatgacccagccataggcagcttatgcagggtttagtgtattatccttccttcccattcaggaagctgctgaaacaccctctgcttattctcatgtatttcacagcaccagagctgagtaaatggagtggaggctaagcctcctcacattgcccctctgacgcagttgggcagcggtacgactttctattcctggataaactgtggaccccaaatatgtatttgagtagcctttacttaacacaatatgctgttgctgtaggctttgtatcctatgaatggaccatttcctagtagtgcttcaagtttgggctgtgtttccttgatcaaactcaggccatatatatttttttctttccaacttttattttaggtccaaggggtacatgtccaggtttgttacatggataaattgcatgtcacaggggtttggtatacaggttatttcatcatgcagttaataagcatagtacctgatacgtagttttgtgatattcaccctcctcccaccctccaccctcaagtagaccccagtgtctgttgttctcttctttgtgtccatatgtcctcaatgtttagctctctcttatgagtgagaacatgtggtgtttggttttcagttcctgcctaaagttgcttaggataatggcctccagatgtatccatgttgctgcaagggacatgatttcattcctttttatggctgcatggtattctgtggtgtatatgtaccacattttctttatccacttcaccattgatgggcatctaggtcaattccatgtcagatcatattttttttctatccccttcaaaagtgagaggggccagtgcatgtgaagtttggaaatgagagccaagtaggtttacatgtctcgtgaggcacaatatgattctctacttgtcatcactgtggatggactcaggatgttccagtccccttgttatcctgaggaccacagtcaaagcatgttgagaaacccaggttttagccctgcctgtgctgctggctgctggaccagcaatccttctgtcatatctcacaatatgctttgtgagttttaaagactgggagaaagaagaaaatggagttcactcatgtctttgtttgggttggtgtcacacaattccataaactgggtggcttaaaaataacagaagtttatttctcatagttgtggagcctgggaagtctaagatcggggtgctggcagatttggtgtctagtgagtgcccacttcctcatagatggtgccctctcactgtgtcctgacctggtggaaggggtgaggggtctctcttggggctcttttataagggctctaattccattcatgagggctccacctgcctgacctaatcacctcccaaaaactcacctccaaataccatcaccatgggggtgaggatttcaacataagaagtttggagggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagcgtgatgcctccggctttgttcttttggcttaggattgacttggcgatgtgggctgttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctctctgtttgtgtgttgttggtgtataagaatgcttgtgatttttgcacattgattttgtatcctgagactttgctgaagttgcttatcagcttaaggagattttgggctgagacaatggggttttaccattcaggacataggcatgggcaaggacttcatgtccaaaacaccaaaagcaatggcaacaaaagaaaaaattgacaaatgggatctaattaaaataaagagcttctgcacagcaaaagaaactaccatcagagtgaacaggcaacctaaaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaatgatagactggattaagaaaatgtggcacatatacaacatggaatactatgcagccataaaaaatgatgagttcacgtcctttgtagggacatggatgaaattggaaatcatcattctcagtaatctatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataattaaaaaaaaaaaaaaaagaagtttggagggacacaaacattcagtccgtagcagcccacctagcgtctaagactgtggctcaggtatattcggagctttgcttcttcccacccagtatggaagctttaggagacttgcctgctgcctgctttacctgtgtttgtcacctccccatgggcctctccttccgggtgctggctatgctggggtcttggggtctcttaccttcccttgactttgtgctgctcccttggacagtctttagtggaggggtgatgtgggaagagctacacttccctttgctctcctgtcccttaattccccagagcttcacacatacaatgactttatcaaagattaaaaagagagggagagagagaaccttaaaaatagctattctcagaagttaagagaaaaaaaaaaaacactcctaaacttttgacaggaagtcacctgagagattagctctgtgttggtgcatggcttgaggtctgtcctcctcagagtaagtgctcctctttcagtcctccacggggcaaactcccactcctgtccacagtggatccccactgccctccctactcagggagagcccattgttgttcattggggggtgttcctgaagtctgagttaatcactatggatagcatggccaggagcaccagtggggaagacgctctcctcgggggtctctgggatcctttgagcattgacccacgcttagcacacagggcatacagatctccgaggacacttgccttccagacctaccaaggagagaaatgcttttctagaaggcaacatacctgcagctgtattctctgtctgccacagaagaacagttgtctttattgtgccttgacctttcctcatctttcagcttccatgtcgtgcccaacggcttaacagtacaacagaaatgggactcagcacccagtactgtgcctctccaagcctccaggccatttggcactggccactcccactgactaggtcagacctacaggtttgcttacctggggttccatcccatccttaactggtgggatggtggccttgcagctgactaggagaaactgaaggtggtacaatggagtgaattctctaggaaacagaaggggtcagcctacttggcctgttttggctgggtcatttggtcgtttttctaaaggccaaagttcatgctcttttgaccaaagttagggatttttttttcatcaggggagttaaatgagctatttgcacttccatatttttgaaaagcggcctttcactccagcaggctcaggctgccaaattggtgtgtccccccatctgtggacaccaacatcacagccacccagagcaatggggcagatcccggtggtgactgagcagcaggttgaggctttggagacccgttttgatgtgtctttgatccctccacacgtggctgaaggcacgtgggagacagagtgtggacctcaggcctttgctgcaacatcatgagaaaaccaggactcccctgctgcctgtagctggtgggtgggtaggaggagtttacttaaaaaaaaagttagaccctagggttggggctggggtttgttcaagggctggggcaaaaggaggtgatagaaaggagggagcttgaaaattgccaagggaggaaggaagggctcagttgaacagatcagtctttttcctttaggaggggactggagaatgctccatcatggttacagaagagcttcaagggccgtgggaccttctttagccattctcaccagcagaaagccacagggaagaagaggaaaagggtgaaagaagcccagagtgataaaagggagtctctattctctcccattctttaaaaccagagcattttgagcaaaccaccattaagacacttgctttattgatttttataaatttttatttggctattttggggatggggggagacaaaaatcactgaaggaaatgttcaaagctgggaggaaaagtggttggtgacttttttcccacatttgtaaaacatcctttcacattttgtctgaatgcctattgcccgttgccaaatcctaattcaattaaaggtttagcaatgaacaccagtttagaattgttttgccatctctgctcaggacaataggcagtggaaagaagtgaagaggggggtgtcagatgccacacactgggggatatgggtgctatgggtcacctgcagccatctagctttaaaatgaccggggaagagcctcctgcattcactgtggggagaagtcaggagctgggctggcctgtgtcttcaaagtggcagctttagaaatcaggagagtctcctgggaccagctcaagctgcaataaaatgcggtgccattcatgcattaaacagatccttacagagaggctgctgctctgctaggcgttaaggacagccctctggaagacagatacagccacatctggcagctgcatggaggccagcagcccgagaccctgggtgatgatgcatcttgggcttctgccacctgctagcaccacactctgacccaaaccttcacatgggacacctggcaccaagaaggaggatagagatgtttgaatctaggaccagatacttactggattaatgacttggcctctcagagcttcaggttcctcatagactcccaccataaagtaggtatgatagcacctatcttggacggttgtaacgatagtcatctgtcatttgaccagtgctggaacatataggtatataggtgcttggaaaaaggtggctattttgaaatattctatgatttaagccctggtgtgcttaatacccccctgaaacacctaaagttgagacttcaagatgtataaaaccttccaaatagattcatgccacatttatccaccctccctctccaagcatacacatgcactgctgaatcttccagaaggggaggtcctaagggtgccaagcctgaacagatactgggaggaggactcggggcattccctccagacagttttcccaagaccctccactgccattgggaaaaagagtgtgggaaccccgggagtcttaatttaggcagccaaagggtgggccttgggagctccagctctctcagatttctggtctggcaagatggagtatgaataagaaactcagtaagcatttaactgctgattgactctgggaattcccaatagtattcgcaatagagaaggcaggtccccttcccccaaatgtcagaagccggcttcctccgcctactcctggtgacttccaccgccctggacacatgggggcgctgcagccctacttttgctggatgccctccccgtccgagtcctgaaagaccctgattttcctctgtatctgggtgagttcacattctctgtgtcttcctatgtagaaatcagcgaaagctcagcaatgtacttagaaaataaaaccaaaaatgtgcaccttaaaccaggaaacaaaaacttacgcaagcaatgcatttttttaattgtacaaacacttaaaagtatgtgtaagcaaaaagaattccaaataccctgtgagaataatattcaaaacacacacacacacgtgcacaaacacatggaatgggacgataagggtgatttttatttatttatcaagataaggtatcattctgcaaactattttgttattagctttttcacttaaaaatagccctgcttgcaagcaggctctgtggtgcaatggatagcgcattggacttctagcctaaatcaagagattcaaaaatagccctgctaaatatttgcaatctttcctacgctcctttttcccccaaagtgactttggatatccagagttaccaaatctagtatttgaagtccttaggtttgagggttgaaagtgaaaggcaagctgttttaatgaaaattcctaactgaagagagcggagacttaagatgcttaaattttggtcacacctgagcggtatttgtttgcatggcagttagaaggcaggtaatttgtcctaaaactaaaacagcagttaacaacctttaaattccctgaggagatcccttcttccccaaccaaacctgttcccatttccttctagactggttgacggtcaggtgggctgattggttctccctgctacagtggtagaattcagcgctgtacctaggtaagaagggttttggagggtgtatgggaaggtacacacagggtagagatgatagcacaggctttgtggtcagactggcaatggttcaaatcccagctctgtgacttcttgcccaggtgggtggcctcaggcaaattacttaatcgcccagagcctcattggtaaaacagggtcataaaactctcacagaattgtgactggcagattataagcacccaatgctcttttaggggttcacaaagtttttctgcaaagagccagatagtgcatattgtaggctttgtgagccatacagtctgtatcataatgagtcaactctgccattgcatcacaaaagcagccacggacagtatgtaaataagcgagcaaggctgtgttccaataaaagtttatttacaaaaatagatggcaagctggatttgacctgtggaccatggttgactgaccctgctcgtgatcatccccatccaacagaaatatagcagaggccacagatagaatactagattttcttgtagccacactataaaaggaaagagaaacaggtgaaattagttttaagaatagattttatgcccgggcgtggtggctcacacctgtaagctcagcaccatcggaggccgaggcgggcagatcacttgaggtcaggagttccagaccagcctggccaacatggagaaaccctttctctactaaaaatacaaaaattagctgggtgtgggggctgatgcctgtactcccagctactttggagactgaggcaggagaatcgcttgaaccagggaggcggaagttgcagtgagccaagattgtgccattgcactccagcctgggtgataagagtgaaactccatctcaagaaaaaaaaaaaaaaaaagaatagattttacttacctcaatatatccaagttatgattgcttcaacatgtaactaatatgaaaaattccttaatgagatggtacattttattttttggtaatattttcaaactctgctggtattttaaacttatgacacatctcattttgcactggtcacatttcgagtggtcagtaaaacgtaacctcaatattgcttctcaaactgcaggccaaaaccaatttagtgggtcaagaaagcaacttacttaaaaaaaatcaaattttaaaaatgaaatggaggagaatagaaactatcagggtacactacatgtaggaaggacatgggtcgtttcttgtactttggtgtgtgaatgcctgtgtgtgcacgtgcctgtgtgtgggtgtgcgctgagacatcatgagaaaaagaagacatctatttcttactgtagattgcacacagacatgtttgaaactcattactgtacgtgctaaagtcaagtgggttttttgtttgtgtttttgtcttttagagcaggctaactggggtgtttagctagtgcttcacacaggctgtgctgttgaccgaataaacatccaaaaccagctaaaccagttgctaaatgtcatagtgaccatttaaaaatacaaatcaaagtttcaaactttaaactttattatctctattcttagctttaaagcatgctcattttacagatagcaaacagaaatccggaaaagtgaaatacttaagaccccaaaaccttggctgggcccagtgtctcatgcttgtaatccaacactctgggaggctgaggtgggaggatcacttgaacccaggagtttgagaccagcctgggcaatatagcaagacctggtgtctacaagaaaatttaagaacaaaaaagaggctgggcatggtagctcatgcctgtaatctcagcactttgggaggctgagatgggtggatcacctgagttcaggagttcaagaccagcctggacaacatggtgaactctgtctctactaaaaatacaaaaattagccagacatagtggctcgtgcctgtaatcccagctactccggaggctgaggcaggagaatcgcttgaacccgggaggcagaggttgcagtgagccacgatcatgccattgcactccagccagggtgacaagagtgaagctctgtctcaccaaaagaaaaataataataagaagaagaagaaggagaaggagaagaagaagaaaatactaatagttaaaaacaaaacaaaaaaaagaccaaaaacctgagaagtagttttggaacgagaatgaggaactctgtgaactcagccttgagctccttcctcacctgctgggctctctacctgggcatgtgaatgggaaactgggccaattcacccagtgatttaagcattgagtcatttttttgcttggaatatttgaatatatgaaataaaagttaaagaggtattgctttaaagcacttcattctcttattgattcttttattgactcttccacaaatattttttttccctcagtttttggtcatctacatatttaggtttttaaaaaattaaattagttttgtactcaggggtacatgtgcatgtttgttacgtgggtatattgcatactggtggggactggacttctagtgtacccgttacccaaatagtgaacatcgcatcaaataggtaattattcaaccctcactcccagccccttttggagtccccggtgtttattatttcatctctatgtccacgtgtacccagtgattagctaccacttataagtgacaacatgtgatatttggttttgtgcttctgaattagttcatttagggtaattccacctgctcatgctttctgagcatccgaaggtgtatcctgctgggaaacaaatgtgaaggaggcataggctctacatgctcacaatctggggtagggtgttatctttcaataaaaacatgtctgagtggggcatggtggctcatgcctgtaatcccagcactttgggaggccgaggcgggaggatcacttgagtccaagagtttaagaccagcctgggcaacatagggagactttgtctctataaaaaatacaaaaatttaaacaggcatgggaggcacacacctgtagtcccagctacttggagattggggcaggaggatggcttgagcctgggaggtcaaggttgcagtgagctgtgatcacaccactgtactccagtctgggcaacagagtgagaccctgtgtcaaaacaaaacaaaacaaaaacaaacatgtctgagattatttcgaatgctataaaaaagagtttgtttcatctggtatgtagtgccgtaaaagatgaaaatgtgaaactgatgaaactcacttttcctccctgctctttagcaatgggatgaaagacattttaaataaatctatgactcatcgggtctttctcttttcagtaaaaattatttaaggcctattttctggaaataaattctgggtaaaccctactcccctaatgggatcccatttcttcctttccccgagggttgatacgtagaatgaacacagtctttggattcaggcagacttgggtataaattctgcctctaccacttcaagactatgaggcttaggccatgttctctaagactcagcttccccatccataaaatgagtatgataacgctgacctcataaggttgtagtaacgattagttgcaagaatatatgttaattaagaaaaaagttcaagtgtgaaaaatgcttttatatatgaatttttggtatgaataagttttcatcacatagctaattgagtctagaaatgattttgtttgtttttgtttttttttgtcacttcctcctccttccagaaaggtgcagtgggaagctgagaaaggcattttggttcccttattttaaggtcctgatgcttaatggcttaccgactgcatttttaagatattgtttccctacccattcatatctctgtcttatacatgtatggtttctgtcagtaattcaacattcacaaaaaaatggcccagacattattttaaaaaagaacaaaaaacaaataggccttgcagttgttaccatggcaaccaaatactttcctgtcatttattcagaagtgaattattaatgagctttgtctgggacatagtcagaaaacacacccgttactctccaggggaaggtaatatggcttctgtagcaagcaaggtcacagtgtggaaaagtaggggatgttcttgcctcctcatccagtgtggggaagacccaaatgagccagccatttacatgggagcctcctcagtggccagagaccccacgtttctggcattttgggattgcataaaaagctgggcccctctctgagtcacttttctagaagcagcatcttgaactggcatttcttcccccacccaccccagaatgatttgacccatttcttcttaggtaattctctcccacacattaaggcagccatcttcagtgattgattgaccaggatcaagtacatataccaattctacaggagaatgggggtgaggggaggtgccagaagatgggaaagtcagaaggtctatttttgcagattactgggtgtggtggatacctgtaatcccagcactttgggaggctgaggcaagaggattgcttgattctagaagttcaagaccagcctgggcaacatagcaagactccatctctacaacaaataaaaaagggggaaaaaagatgtaaatttttgccccttgttcttttttaaaaatgaaaaagcactgcaggttagtcaccaagcttctcagacaaggtaattttaaggaatgtatttaagctttctaagtcccagtttccatgtttgtaaaatgggtttaatagtaggaccacattatttaggggtggttgtgaggataaatgcataggaactatatgaagaagttcctgacacacattaagccccttagtatgttagctattgcttttaaaatgatttatccctaaaccatatatcaatattgcttgaaggttgaatcacctgaaatttgttatgatttcaaaatacaaccttttaaactgatgggttttttgaattttcaaaaataaaaattgatgttcttttgatttctttcaaaagaagatgcttgaaatagccatctgagtagtaacatattgatgccttttcatcggcacctttcttcagttgattgttgatgtacactgacatccctgaatttcattacagcagtgactgagggtgtcaacgtctacaggtatctggaaaccatatttattttaaatgacatctttttttttctggcacaataaaagagtgaggaatgagagaagacaagataggcctaagaatttagatattccatggaaaaaacaaacctgagagtgtgaaagaaatatagcagggaacatggttaaggttcagagaaaagaaaactgtcattatttttattttattttattttatttattttatttttttgagatggagtcttgctctgtcgcccaggctggagtgcagtggcgccatctcggctcactgcaagctccgcctcccgggttcaccccattctcctgcctcagcctcctgagtagctgggactacaggcatccgccaccatgcccggctaattttttgtattttagtagagacggggtttcaccatgttagccaggatggtctagatctcctgacctcgtgatccacccgccttggcctcctaaagtgctgggattacaggcttgagccaccgcgccgggccaactgtcattatttttaaagcttcactgtgttccttgctcctgtgtcctttgtctaaattcttctaactttgatgagccaaattctacacatagtttcacccagagaacctgcaggctcaagaaaaaaatactattataataatatatgatgatataagattggttagaagatgctaaggagaatccaagcaatcagagaaaaataaaaccaagctccctgtctttgatatagcacatcttggggaaagatcaagtcagaaaagcagatggccggcctggctcattgtggaattggtattctgagataacttacaggtcccaaaccatgtcgctgtaaggtgttctgagaaagaacatttgactgctacccagacccctctgcaggttcttctgtttagggagaatgggaggcaaaacactacaaaacctgtaggctttagaaatagacagactagctgtgtgaccttggggaaattgcctaacttctctgagcctcagtttgctcacctggtaaaagggagataatatttccctttcagggttgtgatgaggatgaaatggaaaaaccatctgatatgtgcttgtcatagattatcaacagctgttacctctcttctatgtactgaaaaagccatctgttaccctaattcataaaaaggaggggagggcagggatggtttgagcttggacattttctggcctttctcaatgacaatttagaatgcagtgaggggaaagcttttatttttgaatatttctatttcactgtctcactgggtcactctggggcctctagaaattgtattctccagatatagtatgatgttgtcagcatatgcatacatttttatcacttctttagtttatctttgtataaaccacatatatctgggaaatttaaccaactgcctttctacaagtggtgtcatatttaggcagatggttactttttgggtacacaattgtgtagggaagccatcttgcactgagactctgagaccatgggcttcccagccttagcatcttacttactgtcacctctctaggctttagaggggttgattattgggtttctaaaatccttctaaatttcccaaattctatggttcaaagtctttgtgtaactgtccaatagaacaagcatataagtggccaaacttctgtgatgatactcctttcccctaaagccagtgaatcttctgaacattcagaaattgggatactggtgaatatgccacagtggaaatgcataggtaacttcaacaagcaaataatcttcaatgatgaatcaatatcttctaatccactgagcctaaagctgcaactgtttgagattcattaaggattcttaaatctaacatgtatttgtcattttgaattatggccatatgctttgcagatggcctctgagtgggtcttccttattcaagaaggagtagggtcacattcattatttgtacattacttttttaaagattcatgggattaaaggatgaaatcagaactcagacaatccaggagcaacctgcgtggatgagaatagtcatcttccatattccacatgggatctgtactttcagttaaaatatttatataattatggtatcattaaaaaagtcatttccagatctcactgacttcgttgatgaatcacccactcaccggtttaagttacatgtgacaagacagcttctattactattttgtttcttgttcttggattccatgagatatctatacttagcaatatgatactctcctcttttatttgcactagggtgaacgtatttctctttcaagcaaccaaaaaagtcctggctggaacagaggaggcgatggcaggccattgctaaactttgctgtgttgtggcagtacagtttctgtcccttttatcttgttaactgtcagtactccaaacaagcgagtagaacaattgccatccgttcagcatgaagaaccccatggaagggatctagagggagatgtcacaccatagatgtactgagtgagatggtatcatggtggccattcctcaaaatatcagcactgccctccagaatccacccagatgacattgatcaagcatctactgtaagccagacacttggagaggtgctgggaatacagagatgagaaagacagggtatttgctcttgggtggttcattccataatgatagcaacaacttatatagaacctgttctatgccaggcattgttttaaatgcttcatgtatgttagcttgtgtgatcttcagaacaaccccatgaggtgggaactattcttaccatccctgttttatagacagggaaactgaaacacagagaatctgggtaacttgccctagttacatagctagtgaggagcagaaccagaatccaaacctaagcagtcagctccagagttgggctccccactggcacattctgcttgtactctccttttctctgataatcccatgacatctttatctccttaagccatatagcattttcttaggcttatttctttcataataaccattataaaaataacaacaacaaaaaatactttcaaccaaaaaaggcagaaaaaaggcaacacaacataacaaaattaatttacccaggtcccattactgttgtcattttagtttatgtcctttaaatttgtgtcaaactaacatagtattttcaggcatgcttttttcttttaggattatgccagagtttccccactatattcttttttgacataacttttaatacactaccagtttgagtgttttccagtcatggctacactatacaattgacttaactgatcccttactcttggacatgcctaaaattcctctgtcataacactgttgtgaacatctttgcatatgtatttttttctatatgtctgataattttcttagatggtgtaggcttttaacttttggagcgtgcaggtaggaaaagcaggatcagttttcagattcagattcaaaagaaacatttaagcttttttcactcctagagagctggaaacaataataccttaaaggtctaaagcatgatctagatcattcacctaccctttaggaggacttttttttttttttgagactgagtctcgctctgttgcccaagctggagtgcagtggcgtgatcgcagctcactgcaacctctgcctcctgggttcaagtgattctcctgcctcagcctcccatgtagctggggctacaggcacctgccaccacgcccagctaatttttgtatttttagtagagacagggtttcaccatgttggccaggctgggcttgaactcctgagctcaagtgatccacccacctcggcctcccaaagtgctgggattataggcgtgagccaccgcacccagccttaggaggaatgttaaaacttatgctttgtccttttggaaatatcatgtatcttcttcctatgaaatggattcatgatgttccattataagttagctaaacaaagatttcactggtctagttgcccctgtggcccatcttgaagaatcactctatggaatgatgggcaatcaaacacaagaggatcaggaagaaacaaaataggtttaacagaatctctgtaatagtgaaaatatcgacaggttgacaaggaccacagggaaagcacagtatgaaacaaatggtaagtaaaggtccaacaagtggtgggtgattcagtgaagagacagcaatgcagagtggttaccacgggccttgtaggaacatggagctgagtttgatttcatttcttagtttctgtgtcatcttgcacaagttgttccatttttctaagcctcagtatcttcatctgtaaaatgggcatgttatcatacctgcttcataaggttgttgtgggaatctaaccaatcatgtaagtacagatatagttactgtttgttggctttgtgcagggtactgtatttttacaatttcatcatcattttcttcattgtcacttcactcagtggaaggggactatgtgataagagatcagtactcattgttgcagaacatgaaatcatcatagttgtgtgtttctgggaaagacaataaattaaaaggtgcaatatgacacttacaagaaatacgtactcccctttgttttcctgaagtacaaagtaggatcaggttggaatttcccgcctgtcttctgaggcaaacaagagcagtttgggggcctcgctgagggggctggtgtcctctgaaccagcagggtaggcatgagtggacaggctgtggcttgtacttcagtgtccctctgatgtttttaaaaattgacagctattgaagatttttcgggctgttcttggtgggactcaaactcaaagagaaagaaggggtgatctttatgggtaaggtaactgggatgtctagggattcagcaggctttggatacagcagacagagggctgaaaggctatctagactttgctactctccccatcttttggttgggttttcttctgggttgttgtcctttcaggcaatgatgggtttggcagctcaagacttacagcatcctcagagaaaatgatttcagcaatggaaagtgcctcttttctgatacttctaggaagaggcccagagaagagtctcattggctgggcttcagccacacccattcttgggctgaccactgtaggaaaggattgctctgattgcccagtctggatcaccgtgtgatgacaatcacacgatgggatgacatggaaaaggtggctgcccaaaaagctgcccgaatgatgaaaataagagaaaagaaacaaagggatgaaaggaggaaaatatatgtggctactgcaaactcttaaaaaaatctcataattgagtaacttatacctgagctctgtaatacttcactccaacttagtttgtcaaggagttttcttttcttttccttctcttttcttctacctccatccccactacgtgtaattttgtcagatgttgtcttctattgcctgaaactttagcagtcgctgtgaatcctgtttctttaagcccagggtgtcactgggagcataacagtcatccagtgcagctcagcttctccctacagattctaaaaatacccagaggcactcaaaacaaacagcgaagcactgaggcactgcccgtgcagacacccacacactcccctctttaaactgccttagcgctgtcactatagggagaatcagcaactcacgcagcccttttatttatttattttgtttttatttatatacctctttatgcagaagagatgaggggttcctgatggaacagaattgattggaagaaagggaaagagggagacaaacagcaaaagtgtttgcactgtctttttgcagctcgctgtagacctgaactaagatgtatcgagagatcagaccaatccagggagtcgcacagattagctgggatttaaaataaaactctttaacaagagatcacctagaataactcgcacatatgcatccatgaagaggcccaaggaccacatttggagaaggttagtgctcacaatgaccagggctacaacctggcttatttttcagaagcaaagcaaaagccaaggccttttccatggaatctttaggtggagtcgaaccacccagagcatcagggtgttcttatgtcaaggaggtgtttcatttcacaggactgcagagctgagggtattggcattgcatgctgtgcatctacagtttgggaacttgcttaatgttgattgtcttatcaaaccagtgagctcttgggtttttcaaaagcaggctgagggattaaatgataaaatcagatggattatgaaaatatgagaatcatgggaattataacaggtatgaccttttatagattgcctgggacaatcaggtgtctgcttaacataatgaacctgacccggtatcagcgtgcaagtaaagtctttgcagtcggtggttaaatggagtttattaaatattgttagtgataatcatggaaaggagaatttaaaatggccatagcttctaaccaactctggggatgtctggatgacatttgttttggctgttgggattcgccacgtaagtaattgattgcccagaagttgttctcagatcaagctttcaattggccggtttatggcaggatcctgggatttaaattaaaaagtgaagccttaaggataagcataagtaagttcttgggacagaatgtgcttagcattgtttccatccataagtgagtggaggaagcctgcgtgccccggacatatgcttttcactgggaaaggcgatcaaatgtctctcttcctctctccctagactgattctcatggagagtccttggcatgttctcaagcctgaagcaaaggcttctaagctcccaaattgctaggtgatctctcccgaggaatatgtccgaggcacaggtgccatgttctttgtgggtgggagtttgcttacccaggattttatgtctggcttaaaaaaaagtctgtattgcctattgaaattgcattgtctaaatgtggcaaaggatttgcaatagttttgtgaatcagggcagtctaaaaattttattagtaataacagtagcagcagcaataacaaaggctggcatttacatagacttcctatgtgccgggcactgccctctgtgtcacaatttttctttttttttgagacagagttttgctcttgttgcccaggctagagtgcaatggcatgatctcgtctcactgcaacctccacctcccagcttcaagcgatactcctgccttagcctcctgagtagctgggattacagtcatgtcaccaccacgcctggctacttttgtatttttagtagacatggggtttctccatgttggccaggctggtctcgaactcctgacctcaggtgatccatccccctcggcctcccaaagtgctgggattacaggcatgagtcactgcgcctggccatgtgtcacaaattttaatgcatttaattcacagacaatggagcttcagacttacccctccatcttctccttccccttccatgagctacatttagccgcattggctatgcatccttgccaatctggccaggtattgccaactttaactgcatccttatagacaactattcatagagcttaactgaagagaaccacgggttatatattagtctggagacactcttgcctgtcacactcttgttgcttttgtgagcagtaagttcaaggcacaagacttatcaatccaattgagagcttcagttacaggcagacttattttttcaccctgtccttcttgtctccaatgcattggaaaggttcttaatcttatactaggtggttcttagttttcatgaaaattttcagttattcctaaagacacaaattgctgatgtgaataagggtgagcgctttcagagataaagatgctaacaaatcagtgcaggtttgtgacaattttaaactgcttcagaccagctggcatcaatattttttcttggtatttcttctgtttttgatgaacgatgtctactatgcagccacaagctaatactgctgtcttcccaggaggcagggccctggtgtcttgggtatcatcacccaaacaacgtttcagaataatcagtccctaaagtaatgctttgcaaaggcatcaagccactgtgatttgagcctgggctttaggatctgggggttctgcctttttctaaatttgcatattgcttttcccgttcagaatttggagttagtaactgtggaagggcttttgggatgggaggcagtggtggtgctgattatgtttccaagtgtaaaaccaatcagctgggtttggatttctgggagcttgtgtggttctgtatggctttattcttctggctgaaactactaaaggaacctccaagttcctgcacaatgttgcttccatttgccatgtgcaagtatttttatttatcaatggccagttagtgaaataggttgtgaatctgtgtttcttaaagaaaagccaacactgggataaagaaaaagaatgcttgcaattttctagataagctagaacatgtcagtatgtaaaatgagaaaacaaaacaaaaacgtttctttctgttcagggtctgaattatctggatttgacaaatacgacaggcaaagtcaatggaataatcagcatgaatatgcctattcaggcctatctttgcagcttactttttaggggttgttgggaggttcctttcttggtatctacttgatgattttttttcatcttgcgagtcttccttggaaatagaatgaatgaagagagcacagacctcggccatcagggatgtgtgggcttaagttctgacatagccacttagctctctggtgctggacaagttccttagcctttctgagcctcagttatctcacgaaaatagagttgatcatcatccccctttggtaacgaacagatggaatgacgggtgtagagcatctgttacacagtgcatgctctgtggcattcatctggctgacctgcagcccactctctgagttgagaacaaaccagggatgatttgacagagatagccagtccaatattggttgaaacaagaaagtttgaaaaggaaaaagatgcctacagtctcttgagacacgtggtttccattctctatcccaactttactgctgacttgctgtacatccttgggaagttgcttaacccctctgaccttcaatttcctgatctgtgagatgggaataatattaatggctccttcctcctaaggatgtagtgagcgctaaatgagttaatggggatagagtgtttacgtcagtgccccgcacattggaaggggggacatacacctatttctgctttaccattctgcctgtcagccattctgatcttcatgaagacacttggcctgctcattcctcagtggttatagtaccagctgcatttctggaagctcactgctggctacaaaatgaccttcaacctccaagtgatccaggcttttcctagcagcttccatcaatgtgcaggggttgaggaaatttgtcgaatagcgacattgaggatatgagtcaaagagagggggagatgatagattcatatcttgaagcatgtggaagtaatctggtttttgtttttgcttttttttctgaagcagatccaggtgtctaaatgtaaccattgccggcttaaaaaaaattattattcacaattgaaaacagatataatgttaaatcaagatgagtaattattcacatacataagtggaaacaggataatttggttacaattataaagataaacatgttggtttttaacccaagaatggcagtggctttgatccttttttcatttacattttttgtcttttgaaaatttttaaaaatttcagacaattttagacttatagaagaattggaaaaataatacatagagttcccacattctcctccctcagcttcctttaatggtatcgtacgtattacataaccatagagcattgatcgaaactaagaaattaactttgcaacaattgctagaatttacttggatttcatatttttccagtaatgttctctctctgttctaggatccaatccaggtcctgcactgcatttagttgtcatgtctctgtagcttcctcccatctgagatagttcctcggtctttccatgtcttttcatgatcttgacactttcaaagagggtttttttttttttaatagaatacctctcaatctgggattgtctaatattttctccatttctagcttttaattgactgcactaaacatactttactgtttaggccaaggatccagtgacaaataggagtttttaagcctaatagattgtctagatatttctgagactagcctggctggttattactgatactggaggttaggagtatggactgtggagccagacagcctggattccgcttctggctctgtgacttacctgctgtgtgactttgcaaatgttacttgacttctctgtgccttgatgtcctagtctaccaattggggataataatagaatcaattcttagggtcacggtgaagatcaagtagaagtatgaagtgtgtagaacagtttttcacaggtggtgatcactcagtctgtcttagcttttaccattgctcaccctcctctgtagccctcctcatcccagtccaggcccagtgacctgctgatgccactgcccgggtctgcaagtacttgtgtggctctgaccagagtgacgactttgcagcaaggacctggggtttttagacatggttctcgtggcccaactgaaatagccaccttgactggagggcccaaagcttggatgctactaccacacgggggttccatctccagggcctcctgctgtgctcagctcaccagccacccacatcctgcaacctgcacctgcagtcgtgagatctactcagaaatggccccaggcccgcttcttctactctgctttactgaccactttgttctgggggtttttgtcctctcacctgtgtctcctctcttccccttgttcctctgaattcacgtgaagcggggaaccacaatgataacacattcagcttctctggaaggactgactgggtttgcttctcagccataattcaacttcaatctgggcttcaatgtcttggtatctaaaagaggatgatcgtagtaataataagtatcattaaatgtaatgaggttttattctctgcagggcactactttattatttttattttttattttttgttatacaatttttatctgaaaaatccatgttacacaaatagtcatacagtaagtcctcacttaatgtgtaaaataggttcttgaaaactgcggtttttaaaaagtgaaacaatgttgctatatgccattcaaataccttttgtttgtatcaattaaactatggtaaaatttgttttcttaagcaatatgttgcttcacttacagttacagcttccaagaacctgtcaacattaagaactgactatacacatgtacgatttatataggtatgtgtatgtgtatcaccttacacatttatatatatagatatatcttaatgacacagtgccagcaggctccctactaagtataagacaaaattataagataatagttattaaaaaataatagatggcttaatatttgcttagcaatgttctaagctcattaatgacacaggacatttaaaaaatctagaaggtgagtagatacttttaaccagtggtgtccaaccaaccctttgaatgagaggacttttttgcttatctgtggtacaaatatcatgaaaactatacacaaaccctttttctttttagctcatcagctatcattagtgttagtgtattttatgtgtggcccaagacaatgtttcttcttccaatatggccggggaagtcaaaaggttggacactcgttctttaaatttggggtttggctactgtctcatctatcttcaaattgtaggtctcttttctttgctccagacaggtgaccagatctagggaggccaggtctctgtaattctccaacaacacatcgctatttaaattctgctgggcagggtccaggcatttccactcttctggagagaattctgtggccacatccctgaatgttaagagttccatttctcagcttcgggagtgtcttggagtcttagctataaatcattcaaagccagcaagtcacagagcgagggaggctgtggtagaatcacctaggcatcccagagcagaggacacagggcagtgaagccctaacctgcagggcactactttaaatgtcacctctattattttatttaatcttcatcacaaatgtatgacatatctactaacataatcccacttcacagatgaggaagctgagaaacacagagtttaagtaacttgctcaagatcacacagctaagacacggaggagtcagcattcaaactcaacctggctttggagccgacgttcttaggtactacatgtgagggttaaataaggtaatctgcatggagtacttagcaaagtgcctggctcagagttaatactttgaacttgagctatattaatcccatgatctgatttctgtttcctctgcctcctggtgtatatgactctgggatgctgtgttaatcattgacccagtgctctgtatcatggcaatggctccttgcccagttctcagacaagtatgccccttgcccatgctgcattagccctaccacttcctgcccagcagatggggcacccacagcccctcaccttgttgcagcacagcctgcagccctctccctgtttcacatctactcattttctggggtctttcctgcgttcccacttagtttcaccttgtacctcaacctttgtttctgcttctctcacccttgtttctaccttctgctctcacccacagcctgacctcagcccctccctagaccagctgctccccagccctttgcttggttcctgggacctgttgtttggcacagtctaggggcagaagatcatgactggcatccctaccgggtttgtcccattcatgagggggcccaacctggctatggaaacagcagcacttggtcatgggtcttgaggtctgaaagaaggtgttgaatggagaaaggagctgaaagggcagctgctcctgcagaagggacagtgagcaggagcaggggtggccaccatctcacacgcccttgcctcttcctgtgactgggccttgctcctccaggctttatcaagtcaccatctctgagagaaggtgccccagtgccccacacatggctcatgccctgccctggtgtgtcgtgcttctgaaatgtggatccctgggttgtacataggcctgaatctctgatcatgctgtgagcagtgggcagaagccagatgccccagccaggctgcctgggcttgcatcccaaactaccatgtgctaaacaagttcgagcaagttacccaaatcctctgtgcctcagtttccccacctgtaaaatgaagatccttaaaaataccaacctcacaaacttattttaaggattaaatgaattaatctaaatgaagggcttagaatggttcctggtgaaaaatagttattgattataattctaagagttattgattataattacaagaattattgattttaatcattggttgtagattcttactttgagttattgattacaatttattattgtctataagtgctattgattataattataacctactgtaattaccttgatgataattattgctacaataataagttattgattataattcttactatgactgggaacttcttgaggccacccaaagcaccatactcatatttgtggctggtcctttgctaggtccttcctggttattgagaataagtttgcaataatcacctgtgaaactgaggataaatatctcaaataaattgtatggagtgtgtacttgagagatactaaaataacaggaaaagctaataatctagctttgggagttgtcatgtggctaaatgcccagtccccagagccaccaaagcaggggagaggggaccaatacacatggtgacaccataagatagcatagcagaatgaagccatcacctgggtggcgtgatttgttgatgaaggctctgtaagtgaggagggtctggtccagctgaaaaatgagtgaaagatgcatctgatcctaagagacaagagaggccaaggggcagccttgtagtttctctttaccaggcatacttccttcccttgccctctccatcccttctctactttctctccaagtcacctctttgtttactcccttctgtcctacattgcaccccttttggtagttgcagacagtggtgaaggcaccatgactgatgggggagccagctgctgggccagaccccaaggcttcttcatgcattgtccaggagtattagtggctccagaactctcaggctactatcattttgttttgcatttgcttttccaactgaaacaattttagacctgtagcctggttgagtgaatttcaagatcaggtagaatagtgcttcttactgaaactctcatgtgtttaagaatcacctaggattctgatggaaatgtggtttctcattctgcaggtctggttggggcctggggttctgcatttgtatggggctcctaggtgaagtggatggttgcttgggtgcactctgagtagcaagaagtcagcctgttaattcagctaattgtacttctgactgttcagcaaagaaacaaaactgtgaaagtctctcaagtatcgttgcagatgttgcctactcctaaaaacattaaatgaggtcacagagtctccctttgcaaagatctcaaggcatcatgggtgtgttcccacccctggtggtactaagggaaacgaagtcacaggttcaggtttcaattctcaggggacccatcagcttcactttgctccactgttgtagactgcccagtggccattggtcaccaaagtcattgtagttgacagatggtggcagggagatgaagagtgagaacaatcagtaaaacctgagagaggaggttctgagggtccagctggaccatggtggatacttgcctatgtcactaggaagggagggaatgtggattggagccaagttggtgctgtatcaaagtcatgagggaagctcataaacaagaggcaaatgaaacaatgggaaacaaggaaatggggcttgcattcagagtttcaacagtgggtgagacaaagtaggttgctttaggatgaatgaggcaaagggttctcactgagggtagccacctggcctacaggtgctggaccaaagtgaacacagatgagtcaactccacccattgtctctgcaagaaaacagctcaaaactcaccccatgaatgagagaggaagatgccaccctttgggactgtctgtaccctggcagaaatggaatgatttatccaaataagcaaggcaagttttcatatatttcatgtattcttgcatatatcttagccatcttttcttttcctgggccactcagcatgtgcagctcatgttcttcttggcctgggaggtcatggaaattctacctggctgctgcaatgctggggagggatactcagcaatggggatttcactttctgccatccagttcttctttcagacactgcctccagtgagacagcctctcacataagatggaaagatgcacctgctctcattccccgcactgagccctcctctctgctcttagctctgggtgggagctgctctctacctctcatgaaaccagagtacaccttataacactcactctgttctttgggcttctcctccaacccatatgtaccctctgtcaggctgctgagtatttgctaagaccccagtcttcttttctcttggtgaggcacagttgcccaaagtcaccactgtccttgttcacttgagagctgaagtaacttaggtagttatttcagaagagataatttgactccttctttgaggaggcttagcccggcactgacaatgtgccaccactaaaggtacctaggaagaggtggaggaatattctgtggccactcctgcctcatcactttccctaaagagagtgagctctggaatcacataaacctagccccagttcttagaggatcacatgcttgaccttcagcaaggccaagcctgtttcctcaactgaagaatggggcaagtaacactgtatttccacatcaaggtgttgtgcaggttaaattggatgctgtgtataaagcccttgcctggctgatggtttaagtgcattataagtattaacaattattgttactgacaactgtgctacagcctattggagggtcacgtatacttttcccttcatgcctttgcccacactgttctgcctgaatcatcctccctcttcacccccacccaattttgtgagtctggtaagttttactttaccttatcccaaattcttgatttctgacaaccagatactttattcctatatggactgtttcttacttgactggctagggatccttatattatgatttttgttagcattagttatatatttgagttactgccatgctatcctgccccagctcctgcctgaatacatacaccttgtcatctgggctgacgatgatgatcagttcttagagggcaaggtcagctttgtgtcacttgcaaggcagagcttaagaggcagtcaataaaaattcagaataaatgtattgaatcttgaagtagaaattctaagttctttttagggatgtgtatgtggctgtgtcattctctggtaggtgtgacgatctcatgtgtgggacaatgctttggtaagcatcaacaaaatgtcagaccatttagcttctttatccccaaggccccatggctttttatttccaacctccagcatgagtttccattcattctttacatattttgttttgcttcagctggggagtgggagagagcctcaaggcatctggtaaggaacctggagcttggtaagctgattctagtatgaggatggaaacctacaacacaatcagagctcatgagtgatgctgaaatataacttgtaatttttatactgaaagtgttcaatctctcaccttccctcacctcgagttacatgacaaaaggccctctttattacttttgtctctagagcccccagtctctgggaaggtggtgggggaaaaagtctattctgggatgtgttatttttgctgcccacatattatccactccagagcaggacttgatgttttaaaaccagggagaagcctcgggaagggaaagcaagcagcatatgtagtatgagctctcccagacttgtgtttttctataatgttaaagtcttctctctaggcagtgatttgaagtggagcttaattaaaatcaggcaagaagtgtagaaatggaacattaaaaatagaaaggtacaggaatggcactgtccatcccacccctgtcataatgtcagtggcagggctctgcacttcattttgcttctccaagtggtgctagacaagacctctgtcctcatctgctttcctacacaaaatggcatatcccagggtaagctggcatgctttgggggccaaagacgtgtcagggacatcatggctgggcctgaatctaccccagctgatagcttatgtgtatgcaccattgttctctgtatttcagtgtaaggcagctaagcaagcctgcagagctaggaaaaataaaacaggacaacagtaaacatctctgacttaaaatattcatgacaacccttgctgctttttagaacagttgtttagtagagtgggaaaagcaaggctacgtgagcttgatagattactcaactggaccttactttctttatgtgtagaatggatatcaaaatgcctaccatatagatttgatgataatcaataataatgtcagccataattgattgagcatgactgcaggccaagcattttttgaaagtctttaggaggtagggactatgattatccccattttgcagaccaggaaagagaagctcagggaggtttagtgacttttccaaaatcacacagctaggaagtggtaaagcaggactcagacctgcagctgacaagctgtaaattctgtgttgtcagtagctcaaccatacctgagtaaagatccagggaaatcatatagctttactcaaagtgtgaaatgaatgttctgatgaattgaaagatgattttagggggcacatgagatgattgggggtgcattgatgagggattaagttatgtcctatcatggggtgagaaaattattcctttttaaattctttttcaatctttctgagtatgacaaggattaaactttgattaggtggtgctgtgccttcaacaccgtctaatactttttaacctccatttttaacaaacagagcagatagcagaggcttagcagacaataatatctagctagaattcagtaaaaaatggttttatgtcatattcattttcacttccaccctctatttatggcaggtgatactggatttttattgatggtagtgatctaaaattttgtcttagaatacacttactggagtacaaagaatcagtcagtgttcaacactattacagaaataatactagaggtggcgttcacatagggcaaaaatagcggaggctgaacatgaatgactcaagcatgagaaatgctgtgatagcctgtgagcagttttcagctgatggtagcacgtggatcataataaacgtcaaggacagagtgaaggaaaaatgtaactctctcttctgatctcttaataggagaaaagaaatgagctgcttatgaactagatgaaacagtctttcctctgacattttgggtatgaatttagcctgttctgaaggctgatgggtaaagcaggggttcgggaaaatggagtttgctttggtcttcattgaaccatagaagctgagtgctggggacggaacttaagctcaggatcagatcctgtgttagacacatgagggtccagatgcagaaggcatttcccccaaggtcaccctggctgagagcaactgcagtgtgaataattatttcatccatttctgggtcaagttcctcatcttgagtctctttttcccacaacagccaccaggcatgaactggcccatggtaaaacccagatagctcagggtcaaatctaccagttattgtaggtgctcaccaatgccctggcactgcacaaagcaccatgcattacaaagaaactccacaaagagaaggaagtaaacaactgtctccaaactcaaggagatgacagggttatgctatatgatttttacccttagatgagtatcatttgggaggtaagtagcaagtctgctatgatagagtcagttaggaaggtcctcccaggagtgagaagccctgtattagtcagctttgaccaggttctgcttcaataacaaccactcccatgtttcagtgatttccaacaacaaaatttgattttgtgtctgttacacattggttgcagggcaactgcatgcatttactgtaccttcttcacctaggacccgggctgaagcagcagccagggccacacctctcttaaaccagaggggaaaagagcaatagcagaaccatggggaacttcctaatgcttctacttggaagtggcatgtgttacttctgttttgtgttggtttgggttcctaggagcagattttacaacacggcttcaaactcatacagattattagggagatataggaaacatcaatcagggaatggagaaatgagacaaggaaggcagtcaggagaacatgtgttatcaagctagctaccactgtggacaactccagttcagtcccatggagaaattctggaaaacagggcaaatcatgtgccttagaattaccctcctgaggaacaagggagctggtatatttacacaaccaaaccttccagacatgggttgaaggctactcctgaggagttttaatttcctagcacttccagcccgtgtgtacacacagagagtagccttctagcttccgagaaagcactcagacaaagagatagatgctagcagttacaagttggctggagtgcattagagggacagagaggagggacgtgagtggggcactgagagcatctgagacatgctcacatttctttatccaaaggaattcacgtggcaaaggacgtcttcagggatagagaagtgtaatcctcccacagaggtgcagcaatacttgagaaccaaaacaggccctgaaccctgattcataagtataataaactctagttgacacagtacatgtaatagatggttaactgagagctaccatccagaccagggtgttttgacctcagcactattgacatttggggctggctaattctttgccgtggaggactgttttatgcattatagcatgtttagcagcattcctgtcctctacccacttggtgcccatagcctccctcccctcacctcataattgtgacaaccaaacatgtctccaggtgttgccacgtgttcctaggggaaaagtcacccctgtagagagccactgatgtagaccatatatgcattgctaattcccaaggaactgaaataaattgtggatgcctcgatggaggtgtgcacagcctgatgggagagacagacagacagacatataaactgtaatggccagtccaccctgggtaacaacaatttgaattatgtaaagaaaacagaaatagttcaggagtggtaaacatcacttttgttgcaggctggggatggtcagggaagtctttgcagagacagagacagcagagcggggttttaaaggatgaagaggagtttttcggatgagtgatcccacatgtagaagttaatgtttctgcttgaaaatggcatgtgttactttggttctgtgttggtttgggttcctaggagcagattttacgacaaggattcaaactcacaccgtttatgatctttggtgattgtggagacttgggaatgctacactgagactgatgctggaaatgctgacctcagagccaggctgatggcagggctgtagttacaccagctttaccatatcattgatcatgtgtaaggagcaatgtcaagggctttggaggcacttagaggagttgcccaaatggcatggatacaacccagccccagagggaccagaagcacctttgctgtattattttagtcaagggagaaagccagcttattcctcggcctcctcagtatcatctcctgacccatccactttgatgtttgtcccatgtgttgtgcaaacaaaactggatgtggatttgtcacttaacatctctctgcctcagtttcttgacctgttaaacagagatcataaggttttctctcttgctagtttcacagtcttactctaaaacgcattggctgtgcgttcagatgaacctgccctgctctgccatccaccaggtatggacttctttttctccattttctcatctgtaatatgggcttaatacccacctcacagggttgtcttgaggactgaattgtgtgatgtctataagccctcagccctgcacctggcacacacagtaagagaataaatgaccataaatattaagaaataggttgagtgtgcataatgatagctaacttgtattgagtgcaggtgatgttccaggcaccatcatgggggtgtgtatgtattaacctatgactacaataggtatcctgattatctccattttacatatgaagaaactaaggctcagggaaatctgatcacttacctaatgtgtgtagttagtgagtggtattcaaacttcagcagactgttgagcaagtaattgctttgctggattgtttagtgcttggcattttaccatagctctttgaaaagaaaatcaagtctttaggtagatagttacattcaccaaatgattagagccagtgtagctactactgggtaaatgaacttttcttactattgactgaggcccctttagtacacttacagaatattaataagaaagtaggtgagaagaaatgtatttttaatcacagtatctgagctggcttctcagtgtgagtctacatgggtagatgatgaatcaccccaaactgaccctttccagaaatgccttgtgagggcagcacaaaggaaaactttccattgcttaactctccccacagcccccaccctcagctattgaaataaaatgccaagaggctgcttgccagctcctggacaccacctccagaacagcagggagtgtcttctctccctttgtggcagggacacatatggtgttcttagtgtcagagcaagcagactctgttccaagagctgcttttcaatccagcctctgtgcatgggatggcagcaatggaaaacagtgcagggtcctgggtctgagggtcatcctctttctgccggtgcccctgccacctgctaagctcttgtctttggtggaacaggaaataccactcagtgcaggtacagacctagcctgccttgtacacctccgtgtcctggtcctttgtagatgcttgaatgagaaccaatcagtgaggaaaaggtatgatgcccctcctgttcaaaacacctattgagtaccaagtactacacccagatatcattttcttccttctttctttggctcaggtcctagctccagaccttgtcagccacgtgtcctggagcaagttattttctctctctttgcctcatcaagaagatggacataataataattccgtgcagagagttgctggaagaactcagtataaagcaactggctgacagaaagtgctctaagtgctagttcctctgtcattttgagaccaagccagatgtgttagagatgtccctgggggaacttgtatcctggaatttgacagcctggagagatctgaaggcattctctggtcctgtaccccaaatgaggtttgaaaccctccaatgagctccctattttgtaagttacaaaacctttggcaaccgagaagaggcatctgtagcaactttagctgtgtcccaagctccaagccatccgcccttccttccccactaccaggcaacagcctgctgtctgcctcctactcagacatccacggtctggaacaaccccaaaattgtcatctggggcagaatacacaacacccaaaagatggttttgctttctgaacctcacctgcagccactcctggcttctccacttcccatcctttatgacattcatgctgcacacctccccttctctagagagacagtaagcctctccagtgagaggcagggtgtgcaatagtaacatgcattggctcaggagtccgactttgagggtctgccgctgacctgctttgtgaacttcagcaagttgctcagtctctctgtgccttcttcttgtccccaataggaataatagtagtgctacctcatcaggtttttgaaagattcaaacaagccaaatgtgaagcatttagaatgtggctggcacatagtaagtcttcagtgaagattagctagtatcattgtcctaaagtgataaatgtcaccaaaagggggagtagatgctgcaactagaagttggatgtagtcaggctgctaagacatgagacctgaaaatccagtttgctgtggatttgccatggattcccatggcgactctcaaaagcaaagttgctcaaaggccatttaaggctcataaagtcaatggttgttttgcctaagaaatttttgtggaatgaacaaatacaacatagtaaggataatcataatagttaccatatgttgcatgccacattccaggcactttcacatgtattgatggaattaattttcactacagtcccgtgaatagttattattattatcatctgttgtatgaatgaagtatttgaggttcacagatgttagataatctgtccaaggccacacagctcatgagtgttgaaagtaggattggaatctcaggtggtgctccaaaagatgtccactgcaggccacaggattctttattttaacatatttatctatggctgctattaggaaccaactgaagaacagtcctctctcagatgttatatctcctgtgaaaatttcagattgggattgaaatggcccagggaggggccagagacagctatgaaagagccacagatatggtgaggagtgtgtctagatgatccagacacctgcggggattgtgcagagcagagctctgcatcaggccacatgcaaaacatcttgggcatctgctgtctggggtagatggtagtttggagagtcccctggcccgatctccaccattgcctataccaggtgagaactgaagctccattctctgtgctaacctctggtcagattaataattctatatagcagcctgaatcctaccaatatgatgacaaaagtctttaattatttatttatttttgagacagggtctcactgtgtctatcacctaggctagagtgcagtggtgtgaacgtggctcactgcagcctcaacctcccaggctcaagtgatcctctacttcagcccttggagtagctgagactgcaggcaggcatcaccatgcccagttaatttttgtatttttgtggaagacttggttttgccatgttgtccagggtggtcttgaactcctaggctcaaggagtcctcctgcctaggcctcccaaagtgctgagattacaggtgtgagccaccgtacccagctgacaaaagcctttattcctttctaccctaagactaaatccaactctgtggcttagactcagagtcctctgtgttctcacccatttgtcccctcttcttaacctaaaggattgccatgatatgggagattttgatgcctgacaaggggtgggggaagcagaaaggaggagcgagtaacaaaggccttctccagaagtgagggaggccagcctggacacagagggcctgtgtgctatgttagggagcttgatctttatatagaagactattgcttcagagtatgttccttggatcaataaatccatacatctatatagttcttacataagaaaaataaaacaaacaaaaagttaacatgttctgggtaactttgggtatggcttggttaagcaaagttgaatgtttcttcactgcagaatttctcagagcctttaataaactaatgtacattcttagcctccaaaagtgggcagctctgtcaaatctgatttgacccccatcatcttaaaatgcaggagcaggccagtcatggtggctcatgcctataatcccagcattttgcgaggctgaggcaggtgaatcacttgaggtcaggagtttgagaccaccctggccaacatggtgaaaccccatctctactaaacatacaaaaattagttgggcatgctggtgggcacctgtagtcccagctactcaggaggctgagacaggaaaatcacttgagcccgggaggtggacgttgcagtgggccgagattgcaccactgtactccagcgtgggcaacagaatgagactctttctcaaaaaaaaaataataataaataaataaacaaaataaatgcaggaacattttaggtgattagtgttctgagaggcacatctgagaaatggtgttatggtttatggaagccatggaaggtgacatggagactagagtccaaacctacctcaaaacaacagcttgacctttcattttacatttaattagaaaacaaagagaggtccttccacaaaatccaggagtaaattaagctatggaacatttagaatttaagcatcaagaaaagatcagaagctggggcatctctgggccttaaaatgagctagtttcttctacactgggatttagaagttaaagactaatgactttactgggtcagggttaaatgtcaaagagcaagtcttccaaggatgaaatggttaatggtcactggggttggaagggtggtgttagagaagtgaaggtaggcacccagggaaggtcatctggtgtcagagctactgacaggctcaggggcttacccacaggctgctgggataaccaagtagaaattcacaaaacgtgggagggaaacagccatggttcttgcctaaggagagaaaagggacatcaaaggccaaagatgacactgatgatgactttaactcccataattacacaatgtccaaacaaacagtgaccttgggctctcgaaccaaatgacaaaagtcagtaggacagtttgtgacgtctttgtcatcaaaacactgggtaggtaaactttaaagcccccgacagcttttcctctatagtatagcaggactgtgatggaaggcacagctcactccagcactacgtgaccagcacgttcctggagccgagagaatggtcaggtcagaaatcttggatgggttaagggtgggttgtgaggggtgatgagaagggaggaatcagtttgcattcctggagagggaggagaaatgaaaaggcagaaaaataggttattataagacactcatgagagcctattttggtatttggcaaagacacttgcttttcccaggggctgaaataatgtgatttcgctcctgtgaatgagatcttccttaggaacattgaggctcagagaaaggagtaagagttgggaaatataatctgattttcaggaaaaacaattggtttctgaaacatcttaggatgctgaataaaatgcacaggtctctgcatgccagtgcctggcagtgagccaagtacttggtacgctgaatgaattaatgaattaatggaagaaccagagttatttttatctttccacatcaaattattccccttgaaatgactgcttaaataatatattaattacatgatactgatgatgactttactctcatgattacacaacatccaaacaaacagtgaccttgggctcctgagccaaatgacagcagtcgataggacagtttttgatgtctttgaggtcaaaacactggctaggaaaactttaaagcagctgacagctttttctctgcagtatagcaggtaagtggtgacttggaaaagctgtatttttttaaatcaaaatcatcatccatgattggatcttgaagaattgaagaacccaaaagtgtgtgacgcagtccttaatgaatatgtcctctactttcagcctcatgttctttctacaggttctaatgttagtgtcttcagccatcactgtgaagaaattgacacaaatgaaaattcatgaattgcagctctgccatttccctgttgtgtgatagctgtatttccactagcaagtgcaagtggctttaactaagattttattgtcaagcagtttaccctgctgtcaaagtcttgggtccaaagatctaaagtaaaagtgtcagcgatgttgcactgctgcctgtatttggtgggaaaattagcaggtctggcttttgtggtgaaaaaggtattttttaatagtactaaaggcataagatatttggtcccatgttattctctgggtccttgttaagtatttctctttcctcttgcaacgtagagtgtgggtgtgacaatgaccaccgcctcccgcttgctattcatttattccttcaaattactctttctttttttccattattggaaaaaatggctagtacttatttattctctcaacacattattcagtgttcactaggttctgggtgcagctttagggtttaccagaagtgggacaatattcagtactctgttctttcgcatgttagtttcccttttcagaagtccaagatgatgataaaaaaataaaataaagaagtcaaatgaaacagaaattgcaaatagcagttactcaggaaaccagaaaacattgagaaagtctggaaaaattggatttgagcaagggctttctgtatttgcttggcagtgtggatgatacaaagttgtgaagaacctggtaattttccttgctacaataatataaattacttattctgttcacattttggcctatttctcctgtttaaaatgaattccttgaagttcatttgtttatagtttcagcttttaaaaacatgattaatattatgatcataaaagttctacatgctcattgcagagcagtattaaaacatataaatgtatgcataagggaaaaaaatcacctgcaatttcttcaactagagataatcactgttgaaatgttgtattccccttctagtcataacatacatcaatactatttgagatcatgttacatactttatatctgttttctaggcttcccccacctccctttttttttttagacggagtcttgctctgttgccaggctggagtacagtgacacaatctcgactcactgtaacctttgcctcttgggtttgagcgattctactgccttagcctcccaagtagctggggctatagccacctgccaccacacccagctaatttttgtatttttggtagagacggggttttaccacgttggccaggatggtctcaatctcttgacctggtgatctgcacaccttggcctcccaaaccgctgggattacaggcatgagccatggcacactgcctttcccccctttttttaaagaaaaagaacttaaaccattttaatatactataaaattcttattttaaattcttttctagccttggttgttgtcctaatggtcactcttatattgtgtggacaatatgtaggacctgactatgctcagctttatgtacatgcagtaggttgccatatgagaatatgggtaaggaattctgtcttttaatggctctgttatacttcactattgctgtggtgtcatttgtttaactattttgcaggaattggacttgattgtttccagttttcttattttataagtggtgttgcaaatgaccatctttgtattgcatttattttacttagagattgttccatgcaccatattcccaaaatgaagttacgaggttcatgaacataaacagatttataatgctttttacccattttgagaaagattaagcctgattaatactgctctcatgttgtccgaatgtacttgtttgcacaaagccccactcctgtctaatttaagtcattgatttagattttctgcctttaatagagatctaaaattaatggatttgaatttgcttttaaaaactcttactttttttttttttttttgatatagagtctcgctcagttgcccaggctggagtgcagtggcacgatctcgactcactacaacctctgcctgctgggttcaagcaattctcctgcctcagcctccctagtaactgggtttacagacatgtgccaccatgtccagctaattttttttttcttttttcttttgtagttttaacagagacggggttttaccatgttagataggatggtctcgatctcctgacctcatgatctgcccgcctcgacctcccagcgtgctgggattacaggcgtgagccaccatgcccagcctaaaagatcttacttttttataataagagatacaatgcttgccataaaaatgagcaaattaaatgagtaaaaagttaattattgcctgaaataacaatacttaaataatgtgttatcagaaaattagttttacatttttatgtaataaaatttacataaagactttatatttgaaagaataaggattacttttattctcattttccccatttttcttaatattctctctaaattgtcagagattttacatttgtcaatgccattcacctgcttagtctgtttcaagacaagcgtaaacgacaagagcaaaggaatattctagaccctcagaagaaatttcaaatgtctgagaaggatccttgaattttgctgccccagagaaaagatacgttatattcttgatcaaaagtaggtgtcttggaatgcaccgcatttttgcccacattgcaaccaagggccttctgcccagggttccaggggagtgctgggagttgccttgagtcttagccacctgaccaagtgcactgccataacgcatggccagaggtgcccaggaacattagcagatttttgactaagcctttctactatctcgggacaccaatgaggtcaaggatcttattcccagaaattttatagaacaaacacacacctgcccataacatcactgttcaaaatcaattagggatattgtatgggtcgattataagtttgtgaggatgaatttggaaaaaaacatcatggggtcccccagtctaggtgtatttgatggtattcaattcattcaggaactctcaaagtgtagctaagtacaaagttatagaatctttagaatcattactgctagacatcctacaacctgctcagaaggccacaccaactttcatgggcagttggccatgcaccatgtatttcacataattattttgtttgtaactaaagagaaacagctctgtaatggacagtgttgttatccatctgctgtgccttacatatgagaaaaccaaggctcagagttacctaacttgttcaaggagaccatcagctaagatttttttttttttttttttgagatgagatggagtcttgctctgttgcctaggttggagtgcagtggcatgatcttgactcactgcaacctctgcttcccaggttcaagtgattctcctgcctcagcctcccgagtagctgggattacaggcacatgccactatgcccagctaatttttgtatttttagtagaggtggggtttcaccatgttgactaggctggtcttgaactcctgacctcaagtgatccgcctacctcagtctcccaaagtgctgggattacaggtgtgagacaccacgcccaaccaactaagatgttaagactggatctataactggcctcactccctctacagctggtgcattgaccacttcctgctgttttgtgcagacacgcagcaaaacaaggcagtcagcaggcacaacccatggatgctttttttcccagtgaactccagtacacttacaagtgctaatcatctgaaatggtgcgaattatggaaaaacacagaaaaaaagccatcaaagattattggagtgaagatgcagtaggagggtgtgaagggttgggaggagggaagtcaggtctctctgatgctgagattctgaaagtgagctcaccatggttggtctcattcacagaccgtcttacctttggccttttttcatcctgagagtaaactctataatgttttaagtctctctaccaacaaggtagaagagtttgaactcacattggccaaaggggcctgccacaagggaaaaattctttgaaaccaagcaaatttttacatcatgctctattgtttgtttgtatttctatgtaaatgttatggtttaaactaccatgtttctctgattataaacgtaatcatttataggagtttccattgattttataacagcattgggataagggaaactacattcattatgagacacattccattttcagaaaacttaaaatatgggaaaatgtataattagaacggaggaaattcaggaagattttgctgttcgtggaagatgtgtcatgtttctgttggggctaggccaggcttctggtatctatttgtgtccacatgagagtaggcacgtatttcagtatgtggtgcaaagtctcagatgtgttcttgggtgacagggatgcgggcggttgggggtaaaaagtgtaaggaattgcccatggctggctccttctgcctccctgacatctgttgggatagggtttctcgacctcggccctattggcatttgggtcaaaataattctttgttttggggggtgatttgcagcaaaaccaaaaatgtgtccagacattacaaaattgcccctggctgagaaccactgtgttagggcaaaagagaaacgttggaagaggtgggccaacacagatcctttgatttcaggattttttatttattttatttatttatttagttagttttaagaaacatagtcttgcgttgtcacataggctgggtacagtagtgtaatcgtagcccactgcagcctggaactcctaggcttcaaggaatccctccacctcagacttcctggtagtggggactccaggtgtgcaccatcatgcctggctaatttaaaaaaaaattttttttttgtagacacggggtcttgttatattgaccaggctggtctcaaactcctggtcccaaccaatcctctctcctcagcctccaaaagccctgggattacagacaggagccactgcacccagctaagactttctttttatatcagaaggcctcttgtcccagtatgccactaataggatacctttgccatttggtaatagatttgtgttttggtcttctatctgtataacgatcagacccaagggtttctagggactcttctaggcatgaaacttttctcagtagttgccaggattataggatttttaaccagtggtaccattctaacagtgctgtctgttgaaatcctccctccttaaagtttaaatgtatattaatattgcactaagtcctatgatcatactctttattcacttaacatcctttcaagggaggctttggcctgtaattgaaataggagtaaggagtcactgggagccagcggggcaaaagcacaataataataaatgcctaaatactatttaacatgcaattaattaaatatcaacatggtctgttgatggtagaaaggtgacaagactttcttcttttctgaaggtctagctcatgtccacccttgctattagggatatttgccaaggatcattgaaagaaattttgatcatctgaggtgggaattaatcatttgtcttcgagctctctattagagactcacatattttaatgtagctaaaatttattggaaaccctattgtgctcttaataggtgatttagcagtgaggaaacaagttccaattctgttctcaagaagggtacagtctagtgggggatgatgcacatccatcaatcacacagatcaacaggggagttagactttttcagttaggtcagggaagcttcctggaggaagcaacatttgattcaagattggaaggatgagcaggagtctgctaggtgaagaagagaagctgaggcattgcttctgtgcatttgtatgaacggttaggggagtggaaaccttaagagcaaagagacaagaaaaggagaatgtcatcccaaccccatctgtctctatcagaaggtttctaaacagccacattcactccattctaagtcacccttagttgtaaattgcactcacaatgtaataatagtttttcaagtaaaaagagacatactatagtagataaatgttgatattgactataatatgcatcccaatttcagaaatgttaaatcttaaaaaaaaagcctatcttagaagcaaggacataagatatcaaaattcaaagtcggtcttgaaatgattattgctattattgtcattgcttttatattgaggtctctggttgtcactgctgggacagttttcattggccatctctgctgcccaggcacatgcttccccaccacattgataggatctcttgcttcctgctcaaacctcccctcttttctccccagctccttaattcccaatcccttgagttcccattgatttctcgcatggtgcagtttagccatgcatgaactcactgccaaccatctcaacctaaccctctgaaatgtatccagtaaggtgtattacaaaacaagggcagctctctcagtgcagtgagcatgccctgagacagcttgcaattctagacaggggtgagaatatcaggaggagaaattgtgccactcctttgcagaagggaactggggccttactgctttctcaagaggcagcattggaatggcttctagaaagatgggcttggccttgggatggtgaaaatgctctctgtctgtgacctctggggctcagccaaggcagggatggataaagaactaacctgccctgcctgccagccaaaaatagtgctaactgcgtcacagagcttttggtaattaaaccttccctctgcagaaagctgtggcttggactgataagggaccgtggatgtgttaaggtaattcactcccaacactgacattcttcactcaacatcagaagcaggctggaaaactaagtggaactagatgaagtttgagattcataaccagggcatggtatgtaagtagcaaaaagacagaacatgtgccaacaaagtttcttatagattaagtagttctttgtttttactctgagtcatatggacttttttcctttttggtcagtcagcttagttagcaactttgtttctgatcataaaaatgcttcatttttgctgtagaaagttggaaacataaaggaaagaagcaataaggaagtaaaaacccatccatcatcttatcattcacagatagccactaggaaccttttgtgtccacttttttctcgatgcaatgtacaatttttataaaattatgatcagggccagatgcggtgactcacgcctgtaatcccaccaatttgggagaatgaggtgggtggatcatgatgtcaggagtttgagaccagcctggccaatatggtgaaaccccgtctctactaaaaatacaaaaattaacagggcgtagtggcatgcacctgtagtcccagctactcaggagattgaggcaggagaatcgcttgagcctgggaggagagggttgtagtgagccgagattgtgccactgcactctggcctgggcaacagagcaagactctgtctcaaaaaataaataaataaataaaaataaaaaataaaataataatcagagtatatctgcagttttctgtcttaccttttaaatgtacacacaatatactcccaatcatactgtatctgatggggtcattcaatattacttgaaaaccagactgtttttagcttataaacctccttagggcctgagctgagtggggtgaagtatctgggagaacacacgtccatgtcagtaggaaagtgctctggtctggagtgttcttcagacaggatccatggtcccaggagaaactgacatgctgtctgggaaagcagagatgttctggtcattttgggaggcagagaaggagtgggaagttcactggggagagcattatgcagagagaagagcatgggctcgtaagtaaagcattcctggcttggattctgtctctggcactaatcagttgcctgatcatggttagcctacctaatcctctaaacctcaattttctcacttataaagtgggactaatggtattatgtatttcactgggttattggaggatagtacctgactcagagtaagtactcaatgaatgttagccatcattagtatattatttttattaatctctccaacaaggactgggtcagctgattctattggatgaggatagtgggtagatgggttcactctttaagataatctttaaaaggaagtaaaaatattggtggcttttagtattaatatgttctctcagagagaaggtgtatttaaagtttaggggagtcagaagaatgaaatcttaaggctccttccatttcattttccagaccatgaattgaggacacttcagtgcctggtaggagatttgggttcagaccaacaagcagctccaatctcagcccaggcatcttcctaatcaggcttgatgggcagctgcagctataagtatttaaataaatcatcaaagggtttgttgcatcagccaagctttttagagtcccaaatttaaaagctgagataaaatcttatcttgctgtgtctttacggaaggatccccagatacctggggttaaggtctggctcaagtcaggacctaggaagcagcatatgttgactggagagacctgggtttgaatcccagctgtgcatgttattagttatatgaccttgggcaagattcacaaccttagcccttctttaccttctcaccctaatctggggtaaacatttgtaccttttggggttgttgcaaggattaaaagaggcaaactctgtgacaatgcctagctccatgctggacttaatataaatgctcaataaattttgacaccatcttctatcccccatatcctacaagataaaacaagacagaatgagaaagtgcttaggtttcttcatctgtaaaaaggtaattggaaaaagaaaattaaaggcagaagctcactcagcctctagggtctgggagatgtcttcttgttgtttaagttttagtctgtactttctaaaaaccagtagtgggcctctggcatttcctggcacatcttagcagataggtattgaatatataccatgtgccacagtactgcgccctttgtatgggtgatctcatacagtgctttcatttcatggaggagaaaaactgaggctcagagacatgaagaaactcacccaaagtttcttagctgttaagtggtggagctgggattggtacctaggtctctctgtctcggagcccgtgtttgtaactaccccgaacataggtctctaaccatataggactcctactccttgctggaaaacataagtacaaaacagacaagaatggccttttcaattactaaactgtaagccccctgagcccaaagactgtgtgttccccgctcaatcccctcccaggcatgcagctaataggaaaccctggagacatactgggaatctaagaatctgggttaggattcctttgaaatgcagatgtcctgtgagaagtaagcacctgatttcttatatacctgagttcattagatacttatctttgatatgggagagagtagagctttctcagatacctgggtggctagctgcagcgaaaggactgaaaatctggaggggaagagctcttctctctctttattttctcactaacggaagggagtaaaaggcagaggaagtgggtctgagatgaggaagacagtaccacagggttcataagatgtacacatcagaattcctggcttgcaggccctgggcattggctggacaaggtttgttggtctctagggcacagaaagaatctatgcctccgaggattcatagaaaattaccacttcctctgtcattatcttttatttattattctctgtgatctgttggtctttgattccctttgtatttttgattcttttgtgattctccctttcgatttggcgctggtttttaccctgatctcatctgtatcgtccacacctcaatgcaggcttcccgcgcccctgcccgggctcccgcagtgcccccatctacatccctgcctccagtcttgttcattgctgctgccagattcacctccctctatgtccacctgttttggaaccttgccactcccatcctgctctgagcttttgctctgtatttcctctgcctgatgtatcctctcccctttcctcttccaaccaaaagaaagtctacctatagccttccaaactcagcacacatccttctcctttgggaacctgttcccaatgattccctcaatttctctgtcttttttttttttttttttttttgagaccaggtctcggtctgtcgcccaggctggagtgcagtggtgtgagctcggctcactgcagcctccacctcctgggttcaagcaattctcccacctcagcctcccgagtagctgggatttacaggggtgagccaccacgcctggctagtttttgcatttttagtagagacagggtttcaccatgttggtcaggctggtctgtaactcctgacatcaggtgatctatccgcctcagcctcccaaagtgctgggattacaggatgagccaccatgcctggcctctgtcttcttaattctagtagtgctgatgtgtgcctacatcagctggtcatgtgcttcctcccctctgcttagggcattgtttacctcttggacatgacttctcacctgtttgctttcctcccatctatgtcaggagttctttaaatttaatatttcttcttcatttattgagtatctgctacatgcgagcaccctattgagggttgagaaacaaagaggaattattaggtttgctcatcaataaataattgaggtgagacccttagaaatgtgtgtccattggcctgcttcaattttagacagttttttcaccaactccaggggaggccaagccaagcatgcctctggctcttgcattccacatgtctcttattaaaaacagatggcccaggactgctttggccattgcaccagttgacaggcctgttcctggggaggctctgcttatgaattctagaatcctttagctgcattagtaacaattcctcctgcagagcaatgaggggatagtgtctgtgggctgggcactttccatgaataagaaaggcctgaattcaacccaggtgccgcccagacttgtcacatggagcttggcctcaggcaaggccaaaatgggaagctagcttcagaggaagaggtcccttctgccacttctgaattcctgaagctcacaacaaccagcttctttgtcctcatttttcttaggaacaaatgtattcatttaacaaacatttgtggctgagtgtggtggctcacacctgtaaactcagctcttttggaggccaaggcaggaggattgcttgaggccaggagtttgagaccagcctgggcaacatggcaagacttcatctgtattttaaaaaattgctgagcacaatgatctctgttttcccagtgcctgcttggctcagggcctggcaccgaggtaaatacaactgctgctctaaataagctcatctctaagaaatgaaatgaatgcaaactattgaaagcaaggaaggcaaatacgggcatgcatatgtccacttcttaattttgtgtccacggcagatactgctaattaatcatagaactcattcactttgaatctggatttaagtgaagattcagccttggaatccttctgaaaacattgctccagcagccactatcagtgatttggactttgcccatgagatgaaatctgcttgtgatcctttttctggtctttaaagtggtccaaatgccactggaagtggggagcaggggttcaaaacagcaagtatattgaattaccatgtctgtccagagcagactaggagactccattcatgggagtgtccaaaagtaacaccgctattgcagaagccctgaccattgctccttcgcacttcttctcgctctcatggctcctttctgtctgacttttgtggactcctcttcctcctcatacccctcagaagtggctgttttgcagggttaaactcttatccctcccaaactcttttttcttgtctgttttctcagttggagagctaatttcttccctcagctttttctagctttttaaagtagttaactgtcaaatctgtatcttcagagatgtctttttccaaagtctaaactcctccctttggcactgaagcacttccaccatctgaccctatttatctttccagtcccctttccagtcccagctccttgcctacagaactactgctgtgagcacgaggtcttcttccatcctgtgtccaagatgtggggtacccatggggagtcctgctcccatgccttggcacatgcccctgccctgcccctcttctctgtttggtctgtcatatccatcctatgagtctccgcttcactgtcatttcactgagaaagccctttctgacttctttatgatttcagaggataataagtgccatgagcagaggatcttactagcttacgctttgagtcactcaacaaacagttattgactgcctcctctaagtccctggcgtatatgacgtgaacctgccctcaaagagcctacagtctgtttacatttctgtcattagttactcttgtttataggtcatgtctctgccattagatcgaatgccttgtggtccagagctgagtcccagtcactgtatcccctcaatcccctgggtatgccagatgctcagcacatcccgagttgagtgaaaggcagcttctttccctgtctggtttgctggtggctcttttgagtgtgtgattcttggggaggctcataaagggttgcagagctggcaggggaaggagtagcccatggagactaagggaggaagaagtccctgctctatgcttgaccccagaacagcaggaggtgggatggaaatggatgcctcaaatggaaagcagccatggctaagatgcattaagaacatgggtctaggggagggatagcattaggagaaatacctaatgtagatgatgggttgatgggtgcagcaaaccaccatggcacatgcatacctatgtaacagacctacacgttctgcacatggatgccagaacttaaagtataaagaaaaaaaaaaagaacatgggtctgcgttttaattgttgcagctcttatgcttaatgattgtgagaccttgagcaagttacttaatttctctgtgacttggtgttctcacctgcaaaatgggtcttaaaacaatgtcaactttatagagaggttgtgaggtttaactaagaaaatgagttaaaatgaatataaaacatttaaaataattattggtacaagcattggctattacttagattttcctggcagtgggatttactggtgattttcatattcatcattgtatttttctgtagacaaaatgtatattatttagctcatctggaaaatatattgtaaaactatttctttacctttttttaagagacagggaaagagtctggttggtgaaggggttatagttaactctggtaacctctgccccaggtgctgtgtgggtatttcatggtgtgattggtgtggggaggtaaccttcagctccccgtcttctgcctgtccccatcactggtccccctccagtcccaacagtcagatgctcacagtggcggtgctgacctttctgaatggtgcaattattggcgcccagtgagccttgcacagggaacagggagtgaaatcacccagcacttcctctgcaaagaggatgtgatcttcagacagtgcaatcacaggcaagtgacctcagtttcctcagaactcagcagaaggttctgaaagctggaaggccatttgcagaacccaggagagaaaggagggaagacaaggctgggtttgcaaaagcaggagcaaggtctgcacgttttatgaagtgttttacagtggagctgtaattggaaccctggtatttagcaagagttatgaggtgtgatggtcttagcactgcgagtcctttggcggcatatgtgatactggcatgaaacaggccaagcatcatggactggattgcttgggttcagcatgctgcttaaatcggcttgtttattatttttaaaaggactatttttttttactcttggggcattcaaaactccacttagagacaaaccaaaaatatttctcagttacgtgctcactgtttgaatcagagctgctaagcctaattggttggtccaattctcttactaccttctggagattaaaagctcctctagctcacttccaaatcagagtggatggaatttgatccaatccaggtgctcagggctccagaagcccttcctgttacagagagggtgagtgagcaggccgaagattgtgctttttattgctcgaagatagtttcctagtccttgaagctgagaaagcaggaagggtctcccattctttttgaaattcagaacaagcacattgtctgaagagggaggttggccttctttttgtctttcaccatgtgagggatggcagccaggactcagccttttggaatcacagagccatgtcagaagcaacaactggttggagtagaacaaaggatcttaactaggggctgtgggtaaaggtcttccggggtctgaaattgtaaggaaagtttgtctgtatgtgcattttcagggggagagttccataatcccatcaagcatgcactcacagaatttgacctgtgcactgtgtagtgagagcttgctactatttgtagcatataccaagcttgcttctgcctcaggcctttgcacttgctgttccttctcagaatacttttccccaagatccacatggtcactgtaactttcttcaagtcactggttaaatgtcacctcctgaccaccttatattaaatatcccgctcaacagtacattgcttcattgttctttacagtgcttattccatatgacattgtttgttattacctccctctttcagtatgtaagcctctatggtattcactgctgtatctgtagcatatagaacaatgccaagcccagagaagatgctcagcaaatgtctgttgaatgggtaaatgcatgaacaaattaataactttgattatacttaggtctcacctgtaaaaaaaaaaagttttaatgatgggtaaaaaaggatctgagttctcagtggggccacttctcagccatgtgtcttgggttccagacatttcatctgctatgaaatgatcacctgacattgtaatagatgtttaggcagaagttttcaagggatttcacaatgcttgtacatcattattaatttctgtttttcgaatacaccagatctgtgtgtgtgtgtgtgtgcctgtgtgtgtctgtgtaaaaatgtgtgtgtgtgcctctgtgtgtgtgtctgtgcacatcctggtgcacagatactattattattattattattctggtgcacagataataggttatctccatttgaaaatggggatgctaatactactgctactgatgtgctagggtaggtccccaaattcccaggggacctccatcctggttggtgtccaggctcttgacaccagagccagaaggaattcaaggactagtcaggaaaatagtgaaagtatggagagttattgcaagtgaaaagtatacactcaagaaaggggagtgtgtgtgtactcaagaaagtcatgcccagtggggtttgcggcttctaactttacgagtttctttaaccaaggagtggaatattcatgaaggttcctggaaaaaggtgaagatttctcagaactgtggtgccacccatttttacaccaaatatggttgtttcggaactgtcatggtgctggtgggtgtgtgatttggtatgttaatgagtgtataatgaggtcctaggtgaaacctaggtcaaatccagtgctatgttgggtccagtcggtcctagccagcttgtcccacatcctgtttttcagggtcttttatcagcccctagcctatgctgctaattcaacagtttcctttttgctagttttgtgaaactgcttctattctcctgcaaccaccctgtattattcctgtctcactactgacacaccagtgtggtttttgtgacttgtctgaagcctcacgatgtatcagagcaggatagtgatagaagtccctcttgcaaactccagttccactctagaaccattagtgttccattctggaaaagatgtcctagtagttgaatataggtggtcaagaccaacttggggctagtattttctgacacatgaacttgagtgtgaatgggatataattgcgtctgctactgaatgtgtagggttaaagttcagaaaagagatgctgcattcttctctaatcttataaaatttcattttatttttttaattttatttttttgagacaaggtctcactctgtcgcgcccaggctggagtgcaggggagtgatcactggtcactgcagcctcaacctccagggctcaagcgatccttccacctcggcttcccaaagtgctgggattacaggcatgagccaccacacctagccattgttctctaatcttacatgaggcagcaaaagttaccccactagaaattattatgctgtggctccttttgaaccaaggcaaaaaaaacaaacaacaaacaacaacaacaacaacaaaaaaaacactcatttgagaggtacattacatctgagagaaataaactctggtctcttctagacaaactgctttgattttcaagcataaacctcagactcattttgggcagaaagttactttttgtcggtatctgcatcgggtgagcttggaggtaaatcttcacacagagcttagtacatcctggataacttcctttataaatgacagcttcttagactcatcttttaaaagttaatatttttcttgttaaaacaaatgctgtcttcttccaaacatcttagatggctgattcaccatttcttaaaagtagttttaattgtacagcatgatacatttatatgcattattttaaacgtaaaagcctagcaaaaaccctacaaaaatatataagaatctccatttacacacctgtctgcaaaaccctcatccattcccagaggtaatccttgcctatcattttttaacttttctttccagaatttctttccaaacattataaatatacacatgcatatgcaattttcaacttcttaaatacatcttagatatttttccatatcagttcatatagcaatgcatccttctttttaacaggtccatacactttcattgcatcaaaatatatcagaatttattaagcactcctctattgatgacatttaggttattactcagttttttacttttataaacaattctgcaaagaatcgacatctttgtgaacatacatccacatttctcaagacagatgttaagaaaaacattttgggatgtgaaaaggtattacatatcttaaattttgatagaaactaccaaacttacccccaacacccaataccggtttggactcccatgttaaatttacctgtccttggcaatcacagatgttgtcaactttttaaagatgttttgtcaatttgatggcaaaaattggtgttttcacttactctgccctgattgctaaggtagttgagagtgttttttgcatgctgcttgtgatgttctataccttattaggtttttttaaaaaaatatttttaaattatactttaggaagcggaacatcacacaccttattaggtttttaacagggttttaaacattttcgtgaatacgactatttcagaaatgcttcttctccagggttgctatgcagctggtagttaaaatatgccttcatttattagtattggtaggtagtaaatacttaaatacttgttggtaaggtgcgccaacccaagttcactttcctcgatcttaagtctcgttacccccacttctcccctctacctctccggcctgggacctccctaggaggcaacaattaagaggttaatatgtagcacttcggggcgaacctgaaccttccagaggctgctctaatgcagttccagcctctattcagatagtttggcatattgatataccatttaaaaaatattttgacaagtcccttccccgctgtcaaccaaatgtactcaatctgtgttttatgtaagttcctggcgtctgggagattcacagtaacatactgctggtttgctccttgaactggtcactgctttgtttgtcaatttctcaggattatgcttacataatttccttttgaccttagcctccacaccataatcccagggggcacactgggggaataagatgacccttatgtaacttgttacataagagtccagagaagctgggtctcacttcagtgtctgcacagttttctaagaaagttcatttagttttctgttgtctctttcaatcaataaattctttaaaaaagcattccctttacttctgagatgccaaaggggaggggggaaccaggccaatactgattgcttctttgtagttggcacttaatggaagtgatcccatctaatttacgctacaatctttttcctttgtatggacaaggaaactgaagctctcagggactaaagtgagtggctgaggatcatacagctagaaaggggtagaagtaggctttaaagccagacacaggttcttcctacagaatatgtgtgtgattcagaattgtgcaggacagctctgtttcatgtcctattcttttgaagtgatagacattgtccactgactatactaaagcagatagggagctcagatcattccatggacttcaagtcccttagaggccagactgtggacagcccttttatctctgtgccagcgttgccctgccctggctccagcagtgcccagatggactagaggcctttgtggcctgtattttggactccttcctatcaccctttgccctttacctctggcttggcactgagttggggcagacaccaaaggaacaggtctcatgtaacatcttttcctgacatgagctgggtcccgttgcttcttctctctgctcagagaagtgacacgtgagcagagagctcatgtcagtgtgtctgcatggctggtattacaaagcctcaaggaaaaaagcttaacaagaaagcctgaggaaatggggttttggtcatttaaattttagggtcattgagggatgaagccaagagggctttgtcattaaatatatttttgataattccctcttatttttaatcctaacattgaaaaagcaataaatgcacataggaaaacatttaaacagagctaaggagaatacagtgatctgtgagtcaccctctcatttgagatacccattttctcagttctccctagaagctgctactctcagcaatattctgtgatctttccagaaatattacttgtaatctctatatatacaattatacatgtatatatttgtgcttatcaatcttctgtgtgtccaatatccatccctccatccatccatctgcccatccaacttatgctcaactctcatggttgaaaatcattaaaaaatgcttgaatccattctctcatttgatgtggtgtgttgagaccagtggacccctgacagagggtcctgtgagtcaccaggatccctatctgaaacccagtcctcatgataaggtcctccagctggtaaaggtgtaacattgagccacacactaaccaaacatctccctgagagattctgtttccataccctgcactgcatgtttccttctggagtctgtccccttcaaagcagagtataagaagatgccctgtggaacggatagttccagttaggtttgattttatgaaatctcttcttcagcaaaatctgtcctgactgactccttgacacagaagggccctgacccacaatcttgttcaccgcattgagattccctgattccatgtttcttgctgaatgactaaatatcccaacagagggaggtcaagtttctccccagcaaaaatttttcccagttaaatggcaagaatgaagagctgacaaatggctatgacatcactctttgtcataacttgccccaaattactgcatgagaagccagtactctactgggtcttgccatgggacagtcataagtagaaaacaagatgatcccccaaagaattgccctttagagagcaattcaaagacaggaaaatcacccgttggttgtgtccctgcttctagccagatcttctagagagctctagatgctgaccccttcatcttgaaaagctcagtggagacctgggtcctagcctctgccacttactggttatgtgatcttgatcaggtgtatcttagtgggtaaagtaattgtgtctatttcaaaggactgttttgttttagttgcaagtgagggaagcctaccttagtctgacttaagtgaactagagaatatatcagcttgttaaccaaagagtctagagataactttaggtgtatctggatctaggagctaaaatcttattattaggactgattctctttccatatctccttgtcctcaaacaaaggcaggtcattcccttataagctcccggcagctctggacacatcctagcagctaagaaacctcagcaaagaagagctcctccttcccactttttctagccaaagtcttaggactatatctcactggaccaacttggtccacatgatcacccacaaatctatgtggttatgaggatagagtatcctgattcaccagtcctgagatgggcatgggtcagttccatccaaaccatagggacgggagttagaaggggaattgccctgagaagtcgagaggatagaaccaaaagagtagcaagcagacactagggaggcaaaaaacaacagatttgttatgtagggtctaaaagaagggggtcaacaagtgttttctgtaaagggtcagataaatattttagggtttctgttgcaattactcaactctgctcttggagtgcaaaagtaaccgtagacaataggtaaacaataggcttcgctgtgttctaataaaaccttgtttataaaaatgggctgttgactggatttggcccatggctgtagtttgccaactcctgatctatgcagatactacaatcttcttgtcccacatattctagagacctgaacaaataagatctggcacatgcaaagcacttaagaaatgctagttattattatattgttattatttatgctatactaaggataataacaatgataatgttgatggtaattataatactaattagataatgagatatgatgaattatgagtcataagtcagcagtgtattccaggactgtttctaaactgttggtggagcttcccctccacatactcatagagctggaaggcaggggagaggcatccaactcaaacatctcattttatagatgagtcttaggctcagataagaggcagcacatgcacaagttcacacagcaagctggggcagttttggagtttgcagctgtttcttctgcaaccttaaaggactctaccctataggtagagtctgtttacacctactggtacacccatggtacacctgttataccatggtacatctagtacatttgaacatgcaggtgtagttagatagatattccttgagttttggatccatactgagtagtgtggtgatactgttggtaatattcctgaactggtggaaagacctgatttgtgactagcatgtgttatatgactcatgagaactccctgctgctgagatgactcagatgtctgttttacacaaagattaccaaacacctctcgccacgtttgaaaacaatgaatagttactcactgcctttctgactaccctctttgtcactatttctattcgcttagcatgctggcagccatttaaacagctagtcttctgtttggctggatgttggtaggaggagtcttctttaatcccccatcaacatggatacagagaggcctgtgggcacttttctctgtactcagtgtagacccattcataaaattcttcatgattctggcaaaaccctccctggattttggttaaccagcagctctgcagtagtttaggaggtggatattttacaaccacaactctttagctctttttttccccaaatttatttccaactttcatcactcagggtcatttacataaatcaatgcaaataaatatttttcttgagttaaaaaatgttgtggaatctgctggtcccaagtactacagagacctcagtacactgaatggaaaatttgggatttggtttactgttctaggccaagggtcagaaaacatttttctgtaaagggctaaagagtaaatattttaggcttcatgggccatatggaaagccatgagttgctgaccccggctgtgagtgcttgtaatttataaatataaaattggaggatggagtatttgaattggctgcctagttacttgagcatagtcctacaaactaaagtcttggatttgggccaatgtaggtttagctatgtgattctgatgcttactaggtcattttaggcacattggtggccttagttccttgtctataaaatgaggataataatagcactctatctgtttgttccttcctcctacttgcttatagaattgttgttgtgaggatcaaacaaaggaaaccacttatctcagagctagtatgttccataaatgttgagagtataatcaatactgttattaatatcaaagcccattgggtgaaagcaagtattcaagagcaaacaattaatgagctgattgggtcaccttcaaagggttctagatagagatcatcaagaaaccttttttccttctctttttaattttaattttaattttagttgtggggtacatgtgcaggatgtgcaggtttgttacataggtaaacctgtgccatagcggtttgttgcacttatcaacccatcacctaagtattaagcccagcatgcattagctatttttcctaatgctctacccccacccaccccaccccctgagaggcccagtgtgtgttgttcccctccctgtgtccatgtgttctcattgttcagctcctgcttataagtgaaaacatgtggtgtttggttttctgttcctgtattagtttgatgaggataatggcttccagctcaattcatgtccctctgaaggagatgatcttattcctttttatggctgcatagtattccattgtgtatttgtaccatataagaaaccttttttcagcatcttctgtgggaggatgtctgaagagactggatcagatttttaacaacattttttaatttaattttttaaaaattttatttacttaatttttttgagactggcttatgagactacctaatttttgtttttggtagagacagggtttcaccatgttgctcaggttggtcttgaactcctggcctcaagtgatccacctgccttggccgcccaaagtgctgggattgtagatatgagccactgacttgggtgagactggatcagattttgcttggcattgttgtgaagaccctggtagtaactcatgatagactgtcttcctttctccaaaaaatgaagcctcacattattcaaaggaaaatctcaaattaaaaatcctttcctgagcatttccttcagctatagagttcagctaaatggcatgcccagggtctggatcatcaacacagtctgaggtgatgagtgattacaggccagaggagtactgggacctctgctaatttgttccccgtgacttcatcacagctgcccttggttgtgcaattgcggttgctatggctgaagtttgaaagaacttggcctgaagctgcctatatggccaatatcttgggggaaatatagctttcaatagataggttttatgggtatttgtgaagaattagcagctatgaggttgaggttgggtatgttgatgagactggaggagaagtttgcttgagagtggcaaaatacaacaatacacaacaatacacacacttcccccccatcaatgcatacactcttaactactttggacaattgaaggctatgtctatgatgctgtaaataaagaaatattgaagaatgttattctcatcttaaagtatcaggttctttcagctgccatattgtaatgaaaaggggttgggtttggatgaagacagaccaaggtgtgattcccagctgtctactcctagctacccgacaatggaaaagttacttaactttgctttctcatctgtaaaatgactaacagtcacttctcatattgtacaaaatgtctgtcttaagggatgttgcaaaacaaaacaaaacaaaacaaaacaaaacaaaacaaaacaaaacaaaacaaaacaaaattgctctccagccagactctacaagctgtgagtccaactcaccaaatcttcacatcctgccccccaaagtagactggtaaagaaaaggctgaagtcatgtctcagcatttgagcattgctctctagtcattgctctagagagttctaatcttggggctactgataataaggggccatgcagagaagatagtgaagccctcctccacccgctgtaacctgctagtcagtcatcaatgattcttaaagcactgcctctgcctgctctcaggaaggtgagatgacgcatcacttgcttttgttttcacacctgtcccctgggaacctttgctcaaagttgtaaattatgtgacatctttagtaacaacaacgtgattcgctctgttaaatcactccctacctgcttgtagcctggtgaataaattttcattccttttttgaagattttacttaagcatatgaagaaagctcccatctgtacaatgatggaaccaaaagggacaggggctgctaacttaatgagagccaggcaggtatgcacatgaaatcaggaaacagtttgctttcctcttaacactctcttcagaaagacagcaatggaagcctgatgataaatagtaattgacacttcgcattggtgtcaaggagacaataagggatggtggggactgtggcagactggaaaatccatgcctatctaagggacaatcacttcttagttctatctgattgttgccactcagggatctaggtttcataattataagtggacaaaaccctttagtaactttcaataataatactgaaacaaagtgcattgaagtttacttaagaaaaacttaaatgagcagtggcttgcacctgtaatcccagcacttttggaggccaaggcaggtagattacttgaggccaggagttcaagatcagcctggccaacatggcaaaaccccgtctctactaaaaatacaaaaaaaaaaaaaaaaaaaaaaattagctggcatggtggtgcatgcctgtcatcccagctactcgggaggctgaggcatgagaattgcttgaacctgggaggcagaggttatagtgagctgagatcgtgcctctgcactccagcttgggcaacagagcaagacactgtctcaaggggaaaaaaaaagagaaagaaaaacttacatgattaacaatatcttactataaattaaagggttttagaataaatttccaactcttcgtcattaacattgttaaagttactgcttatttagcttagcaataaagaaaaggaatccttatcttaaggtgaataaattctgtgacatctgttaattttggtataacaatataggtaaaagttatgttttctttttgtttctgtttatggtttttgctttttttttttttcctgaggcagagtctcattctgtcacccaggctggacagcagtggtgccatcttagctcactgctgcctccgcctcccaggttcaagtgattctcctgcgtcagcctccccagtagctgggattacaggcatgcaccaccacacctggctaattttagtatttttttttagtagagatggggtttcaccattttggcaaggctggtctcaaactcctgacctcagatgatccacccaccttggcctcccaaagtgctgggattacaggtgtgagccactgtgccccctcactgcaccctgccaaaggttatgttttttgagtagctgcgaaagagacctgttcggagagtgaatacttgatcagctgtgtgcggatggggaatgagaccactccagggagccaacctgaggaacagttggcagttgtttgaagatccaccaggtttagctcagtgggctaaggaagttaagagcgagaactgaagtaaaagagaaagaggagagagactctgaagagtatggggaggaagaacaaatttgcttataatgaaattgtattgcatgttctctaggtagcgtgtgctgcagacttcttccctttctccccataaaatacaaaaacaatttctgccctaaggaactgtggagtcgaatctgctctcagataaaggacaatgggctgagtgtgtgttcagggcagatggggagagggaggatggaggaagaaagcatgattgtccatggcaaaaaaaccctgccatttctgtgttaactcaaagccctagaatatatttgagtccagagatctcatctggacttatctgtaagtcttatttgacccctctgtcttaattttgtcatatacataattcaatctaccagcttttgctgaacacctattaggtgcctggcattgtacatgtcattatatagaggattcaaataaaaacaggacatgttccttgctttgatgtcataatttaagagtcaacctgataagtcactcggcgagaaactatcctcagcataaatttgagactttacgagttgagcaggaacaagcctttcttccaaggcacttgggatgaaggcttttcacctcagttgctaaggaattaagtggtattgatgacccggtagccaacataccacatcatcaccacttccaggctgttgaggagacgtggtgctgctggaatgacttcaggaagtgcataaaaattcaagtcatgatcacttgtggtaattagaagccctagttgcttttggcaaggtcactaaacattagttggagcttctggtggacttcaggtttcctgatcctttccttgtgctttgtttaggcttctgtccaaagccatctccatgggagatgcttaagctgataaggtcctgccactcgctgtcagaggcacctcccagtccctgcagacttgggtccccttagtacctccaaatcactagtctctcaaaaattcttattaaacacctaacatggacagggcccagggatagatgtatggcccttccttcacagagtctaaggcctagtgggagaggcaaaccatatgaatgtgatgaattgtgcaacgttaagatctcagaggcatgaaaagtagattgggggctcaggaaaagattattcgaagagacaacatcaaagagtcacttaagatttcaggttcgaatgtgcgaagtaaaatattccccaaacaccacgaactgcatctgtgtatggaaaaggtgggaagagaatggatcgtgcaagaggatgtattgcacttgtggactgtgccatatcagcacaaagccctgtgaaccagcctgtctccacaagctaccagagtgataaatatacattcttctcttaagaagaaattctcctggtgagaacattacccttcaggggtgactggatggctcagtttatcacttgtaaatttagcagatcaaactagttgagaagcagttgggcagtcagtaaactgactggactgctgggatcaacagggactggatgtttagttcactttcaatagccacaaatttagcagctcattagaaggaaccaaagtaaagaactgcacaagtcctctgggaggccttgaaaggcttccatgggcgatggaagccatttagaggcatggtgttgctgagccttttaaacacgtgattagctaaagagagaaagatgttactttggtctgcatttctctagggcaggaggaagtgaggaagggaggagcagaacacttcagcctacatctcaggaagggaggctgagaagcagtgtctggctgagcatgctgcttctctgagcagatttctagaagcagcagaggtgtgggtgtggacaggaaactctctatgtctatcaccttctgctgaggctttttgtaaacaacaaatgagatagtgtagcataaggtctggtactaccttagtttcccattgttgcagtaacaaatgatcacaaatcaagaggcttaagacaagacaacttattatcatatagttctggaggccagaaatctgagttgggtctcactgggctaaaatcaaggtgtcagcagggctgcattcttttctggaggctcggaggaggagtctgtttccttgcctttgccagtttctagaagcttctcacatgccttggctcctggccctttcctttatctttagagccagcaacattgggctgtgtctttgtcatgctgccatccttcagttctttcttttctgtttccctttttcatgcataagaacccctgtgattccactggtcccacctggagaattcaggcgcatctccctatcttgaggtcagctgattagcaaccttctttgcaactgcagccttagagcccctttgccatgtaatctgacacatccacaggttctggggattaggacatggacatttgttggggcattactctacctatcactggtacagaataaaaagtcaataaatggttctattcattaccagtactccctaccaccttctttctctactgtgaaattacctatgcccttcagtttttcaaaggcagggcagaagcctcagctctggtagaatctgacgtgctggaggttgaaagtgagaaaggcagtctttgatgggcttaggggagtggggaagtgaccagcccttacctggaaggttgtgtgcaggtctgggaggcacaggcaagtaagtagcttgaggtgctttaaccaggatagtgacaaacttgggagaagagaaaaccctgagcagaaacttcatatgcctcaaaggttggtagatggagaagggattcagcttcattttctgtaagtgtcgtgattaagtgtgtgcaccttgttcaggccaagctgggttgccatcccagctcatctactcaccaactgcctgacttggagcaaatgtgctcctctctctgacctccagtttttcatctataaagaaggactaataatagtagctatcttgtgagagtgttgtgggaagtcaatgaaataatgcatgtaaagcatccagtacattgtctgatggcaactgttattattaggtagctccacaggatagaaaaataacctgtgggtaaaagctgcagggaaacagatataggctcaccataaaggaagggcttcttaatagtcaaagctatccaacggcgggatggttagagtagaagtgataagctgccctgcactgcaactgttcaggcattgaccagacattggtatgtggattagctgcaacagtgtcatctgggtgcttttgcaaaagcccagaggtctaggccccatccagatgtgatgaattggaatattcagggatggggcttggagatctgttttgtgctttgttttgtttgtttttatttaatatgctgttttttaaagagtagttttagttttacaggaaaattgagtggaaagtacagagagttcccatatacccctgctcacattcaggtgcagcctccccaactgtcaacatcacccaccagagtggtacatttatcacaagcgatgaacttacattgatacctcattatcatgcagagtgcttagtttacattagggttggctcttggtgttgtacattcatgggtttggacaaatgtatgatgatgtgtatttaccattatagtaacatacaaagtattttcattgccttaaaaaatcctccgtgcttcacctattcagcaccatgcccctccatagttttgccttttccagaatgtcatatagttggaatcatacagtatgtagccttttcaaattggcttctcccacttagtaatatgcatttatttttcctccatgtctttttttggatagatagttcatttcttttcagtgctgaataatattgcattgtctgcatgtaccatggtttatccatttgcccactgaaggatgtctaggttgcttccaagttttgggaattataaataaagctgctataaatatccctgtgcagtgttttgtgtggacataagttttggagatctgtatttttaacaagtgatccagagacagagttggggccactagaccagataatcatttgtccagaggctgagaggggacaggaagactctctagtccagaaattctagggttccatgactgttgtatgtagctcttggatcaggctctggtttggactaggtgttaactttcttctctctgggatccttcccatcccccaacagcaaaatcactcttttggccaaatgttcagtgtcgatgtctattgctagcatgaaattgcctaatataaagagcaagttttctcgggctggagggagagtgggctgaccagtttttccaagtccaggactgacagggatcaaatcctagctctaccatccattacatttgtgacattgagcaagtaacttaaccattcaatgacttcatttttccttcagtaaaagttgctgatagtagtacctatctcctgaggttattgtgagaaatcaataagttcatatataagaagacttagaaaaatacctggtgtgaagttagttttgagtaaatgttagctgctgtcatcattattgtcaccatcattattcttattattaccagttaccagacattagggtccctctgatgggggagtccttcccggtgaagaaccagagttggagtgaacccttgaggttatttcacagcagcaagtgctggctgagtcagtgggaataggatggttcctgtgtgccctcgttgcctgaagggaggagtcagttgagtggatgccattttcttatgatggtacatctggggccatggcaccagcagcatatattgtccaagacagacaacaaggccatagctccccagagctcactttgccttttctctcatttagcagcacttcctctctctatcttccctctccatgtgctagaatgcaagtctcataagtagctacctagtgccttggtgtagatggtagttctaacatgtccattgctctgtaaataccccaagaaagagtatacccataaaacactggactcaaaggcaaaggacagcacaggtttaactttgctgcagaaccacagcacaggtttaactctgctacttccaagcttcatgagcttgggcaagtttcagaatcttctggagcttctgtcttttcatttctaagatagaataatccttccctctccgggatgtcattaactcttgatgaatgcaaaaacgctttttaaatgacacaaatgttattattagcttatttgttagaaagttaaactgatgaaatgttggttattatttacgattgaaagatgaacacaaggagaagagtctgcttgggttcctgttatggaagacaagaaaggaaatgtatgagagttctttgctgttatgggcatggaagagtagaaggaagatgaaggccacaaacttcttctttggccagtgaggtcactctgttataacctggactaccttaaggccccgctgttttgcctcatctgaaggagatgtttacatgttcccaaagtataaggtgttctttgggcaaaattagtacctgttcttttgctgggaaatccaccagtatgggaatcagccatttaaggccaaagatagatatactatatgtatttacttctaacaccataatttaatttgcctatttttcaactttagctcaagtttagcactcagacaaaaaagcacacaaatcttacatgaatagtgtgattaatttccacaaactgcacactcatgtgaaatgagcatctggattaaaaaggaaaaaaaggagaataaaattgctagcattcaagaaacgctgtggaggcctcagaatttcaaacacggttgacttcaagactgatcctggcaatggtatgcagttagcaaagtttacgtcatttatgttttgacatctccttttgtctggcttccagatatggttctgtccaggacctatattaaggggttcctccagacaattctattttgggggatggattgagaatctcctttatactaaggtgtcagtgaatgggttgctttttccgtgagtttctggcttaaatctgggtccttgggtggaatccaaagggatagttctctcaaggaggaaatttgggtctctgggagccagaagtgggtgactttgaaggtctccagggaacttttgaggaagctcttaaacatcatctcacaaaagaattgtgtggcgttttgaatgcctgccatggtaaatcttgcaatttgcaaggtcatggtagtgacttgccttcttgcttgggattgatgctacattgcctggttggctgctcagtctagaaggaagaaaaaagagacagactgcactgaagaaaagcagttgtaaagtgtgataaaaagacccagtcctggctaaggtatacagcacctcacccagtttctgcctagtgcctgaaggcgctgcagctaattaaaccacctcttagtcaacatcccagtcactcccatctgggagactgattggaaaggctcagtttgagaaacttcagaggctagaagaaactcccaggcctgagggccaaatcctgagctcttttaacctcaagctcagggttccagtggctcttggaaggggaatgagtactcatgctttctagcagaaggaccacattttggagggtccaatttagagatgttgatgcttggtagttgggtcctaagatatccttcacggacaagtgcatcttcccgggtcctcatcagtttccccaaaggccttgttgggtgaacctagagtggttcctcgttccatcttccctcaagagtgctgggagcattgaggccaccatccttggtcagggcagctggatcacaaccaccagcagaaaagaaccagacctgctgtgatgctgcccgtttctgctacacactggttttcccaatgcaggtgttccctcctttttttttttttttttttttgagatagaatttcacccttgttgcccaggctggagtgcaatggtgtgatcccggctcactgcaacctccacctcctgggttcaagtgattcttctgcctcagcctcccgagtagctgggattacaggtgcctgccaccatacccagctaattttttgtatttttagtagagacagggtttcactatgttggccaggctggtctgaaactcctgacctcaggcaatctacccgcctcagcctcccaaagtgctgggattacaggcatgaaccacttcacctggcccgcctgctttttacaggacgtgacttccccacttgaaaccatttctgatattccttctctcatttctctcttcttctcagatttgttagccttctggaccactacctcttacaatggagtgtcacaaagaacctgtgacaagaacatattttaacctaatcatccattcattcattccttcaggcaacataaactaattgagcatctactatgtgccaggaagatgctaggcatggtggagacagagacaaataagacacagtttgtcctcaaagtgtttatgttctagtggggaaaacatacaagtaaactgtgaaaaatgccttgagagcacaggcgacatggtaaactgcatctacaaagcaaacctgggagtcatcaaaggcttcctgagggaagtcattcctgagttatttggaaggaataaaagttggtctaagaaggctgggttggagggtgggtagaggatgttttagctagcagagatggtttgcttcaaggcaagctggcttattcatctggaaaggggccaagttgccccggctcaaaacccagagtgcatgccacatgaatcttcctcagcttgttgatgttgtgtgaagttatcaaatgtattttcgtcttgttccatgaaccagaggtgggtagccattacttcagaattgacaggcctttggggactaggctggccaatatgttcctgggccatggcataatctttatttttagaagaggttcccaatttgagatgatcaaacaccccaccccagtctctcattgggccctggaggctcattgttacttggtgtcttatttctgtttggggtgatgagtctatctggaaataagcaaatttgttgggtcaaagctggctaagtctctgcctggggaaggatttcacagaagtccagaggccatatccttaaggttgtactcctgatgtcttttgaggggttatccagtcattccatcatagggaggctgatggcagtgggaccttcccaggcccccacccactctggaccctctgggactttctgtttgtaaaaagcaccagcaccaatgtattggcaaggagatttactaaaactcaacagtgagtaaactctcttactggtcattttgcatcatatgagggatttcaggcaaagaaaggatattaaaattgagtatctactatatatcagatactatatcagtgctttcatagatatcatctcactggagctctgtaatgacccagtgagttgcatggtttgtccaaatgactaaatgtcttgtctcagccactgccagaaaagagacattttaaccaagaatcaatggccatgtaattatgtgattgcattccaccaacttgtcttctgacagttactcatcagagctggtgttttaacatctgtttctgagccaaacaaatacaacttttattgatcccttgaaaactttgtctcctgctactttgtctttgcagcttctgtgtagacacctgaaggctccactggctgtatacctgccattcattgtattagctggcttgggccactgtgcttaggaagcaatatggaaaaaaaggctcttctccttcgatttctcatcttgtcttttctgagtgccacctcaccagttccacagtaattgactgtgcctgatgtaggtggtctctcaatgacttagtggtaagtttagcactttgctggtcccaatgccagtttacctgtttgactgtgttcccaaggcattgacctgcccatgttagaaatctagacctgagaatgggtgaaggatggatgaggaattagaagatgctcacgtctgaattgtgtactgaatttcatcccaacccagctttattggccctagaaaaacatgcttccgtaacagataggacaggttaaaaggaacacaaaaacatcaagaaatggttgttgttattgttgctgttggtttgtcgctcatctctacctttccctgtgagggttgtggtatagctactgagctgtctcatggcgaatgaaatgacttgtcttcatggtcagctctaagcttattccatcgtgggtacctagaatggaatccacatctctagaactgaatgctactactatccttttccctacctggagaattagagaatcacaggattttaaatgttaaagaatttccaattcaaccctcttattttatagattaagagaatgggacctaaaaaataaaaatgggccaaaattgatacttaaaccttattgatatcttacattagaacgtgtttttaccatttcatagcagtttaccctactgtctgttgatcacagaaggtaacattatatccattttatcctcatacttttcccctgacacacccatttagcagccgtcctggaattagaacacagacttcctgacttccagtcctatcctggcccaataccatcatgattcaggatagctatacactgtattctttaaccagcccctcgaatggactggaagaagctatagaaaagaggtttgtgaagtctggagtgcctcaccagcaggaccagaaagtaattctgtgatttagcaaatgaacgctgtgaagacacaatgaatagaagaagggactgaaggagactttggaggctgtcaccctttaagtttcatttgcaggatctgtgacaacacggtatctgtcagagagagactgacatcttggttggtaaacatctttgacacagttaaggcaggtcttacaggatctaggaagggtggagggatttgcaggctgttggaaatgccagaaagtcttagagtttcaggcccttttaaagcaggggtggcattcttcaaggagctgggggaaaccctggatgtgggacaatcaaagctgaaatctctgcttcctggttcttggtgctcgagctgatgcaacaggtatttccagcattcttatccaaatacaacaactgtcttacgggagaggacctgcagtgagcactgtttttgttcttgattctagggtgacctagtgtcttccagtagggcaatctctggacatctttatctccccagtacctctccagatcctgaagcctggggccagggaggagaggttagatgtcagcagtggaaggacaggtgggtgaagcccattgcaaacctcacatcctccaggagaaacacaccagttgcttttaggctccctggggagtgttctgttgccacctcatcaaatcagtgaaggtggaaaaaagagtttggtgccagctaaggtgacactgaagtgtgcagcaggaaatctgaatccaacaccacatctaatgagcctattattacaggctattggcaaagcaagggaaatcgaatgctaatgaaaagcaggttctgagaatagtttaaaacttagcgttagccccattacacgttcccttctgagtcacagaggatgatttgcacgataagctgagcttgccttgaaacaggactcacgtggatttgcatgagaaagaactgggcagagattgcaatattaacagctgtttaaataattcaatggagaggctaaggctgaaggaaattatgggctcattgttaaaagtttttaattatcccaacagctgtcccatcacatggccttactttgttaggcagtggaggccatttgagagatcggcctgagttggcgcactggaacttccaacattaaggcattgcattgctaatattcctcaatttaggaggcagtcaagcagaaacacagatggtgggcagtgtcagagagcattagcctcgagggatttggtggacccaaatccaacctgggttttattgctttgttctgtgtgcacagccacaggacataggaagggaatattagtaaaggggtaagcgtgcccactggacgtgacttactgtgtatccggtggacttcccagaccagatttggcactttctgctcattgccatgggagcaaacctgctggctgttgtgaccttaggctttccatctgtatccaactcacctcttcctggtaaccatatctcttagggggcgctgaaatagtcatttaaaccctcataatattcatgatggtgacagggcccagcatgacttattacatattcatttgaatccatgtaaaaatcaacatgtggaccccagagtgtgcatctgggtgggagctttaggatcttggtagtaagacagatttccaaattgtgtatgttccatttatttgctaagctctagacaaattgcataaaatacttgaagaaacccctcatttcttctaggtttctattcaaatgtcccttcatcacagacgccttccctggacacttgatacaaactcatgctgcctccccacacactgctatccttctcctccacccttgatgtggtttggctgtgttcccacccaaatctcatcttgaattggagctcccataatccccatgtgttgtggaagggaccccgtgggagataactgaatcatgggggcagttaccctcatgctgtttttgtgatagtgagtgagttatcacaatatctggtggttttataaggggcttttcccccttttgcttggcgcttctccttgctgccaccatgtgaagaaggacacgttctcttccccttccaccatgatttgattgtaagtttcctgaggcttcccaagccatgctgaactgtgagtcaaacctctttcctttgtaaatttcacagtctcgggtatgtctttattagcagagtgagaatggactaatacaacccccctctgagcacttctcactacttaaaatgtatttatccatgcatttgttctctcactaaagtgcacactccatgatatcaagggctctgtctttttgtttactgcaacatctttaacatcaacaacagtatggtgcctgtaatatgggcccactagaaatttgtggaataaatgcacgaatggtcaaaatctgactgaagtggcatgctgccagtctgtctgcagaagggccttattcccaggggcaagcaaggggcccttttagagctgcttttcaattctcaatttctcttggcaaacattgattaagcactcaggactaggtgttaaagatcacaatcttgccctcctggggctcatagactggtggagaatgtaggcatttaaattaaatccatccttcaagagctgactcaggtctcggccccttctgggaccccttcttgaacattccttcttcttccctgaacctgggttaggcattgttcttatgatttcccatagactcctttgcaagcttgctcatggcctgtacataaagcagacaattacagtacaatgtgctttatgtttcctctctgagtaaaggctctttaagagtaaagattgtaccatacccattactgagtatagtgtctgatacatagagaacactcaataaatataagttatgcctgttattgtcactgttaccaggtgtgtttgcaatcagcatttatatagctgtttgtgtgaacacattttttaaaacttatatcttattctaaaggtatataggcttagaagcagctgtatattatataatattctatcatgctatactatatgatagttcccatgtcagtctctgtttgtgttctgggagacgtagtgattagttagactaattagaatagttggaatttttagattagtcagaatttttacaaagagttcttgggggactctgtgtttccagctgcgagctgagtccctgaattaccttaaaaattattttctatgtgcaaacatcaagaactcttacaagtcttccatatctgtttaattccaagagggtaactcacgagaattctctcaataaatatttgtgggtttatagtattttgatgtagccactttgatgtggctgttttgattcagggcttcagggacattttgttatggcctaaaaaacaaaccattaaagaggcagcaattttgtacaacaaagaaatgtgtggcacaggcatccaaccacattgccaggttgggtgtgtatgctaacctaatgtttgtgtgttttcactttgacatggctgttttgatgcctgacgcttccattacatcatatggatcttgccagaatggttgctttaaatacttcctagttttacttgaataccaaccatgtgcctgattctcatttcaatggcaggagggattcaaatgaagcagaaggcaaggagattaatgatctcaaggggactggagagttttgccaagagctggctaaggaaatacattcaccatttcagaacgcatactacctccattctttgtttgacatttcctggtttagagcttcagattacttgctggagacatgtttaaaaatggaaaaagatcccactgcaaacacagaaatatggtctatccacgttaaaaaggtcattttgatcatttccccctgctgtgttgtaaaatgaattttctgtctgtttcacttggcgaggggaggaagtgatatttgttgctcactgatcagaaaggccctcacccaactgctgtgagcagtcataccctattttctttttcagatggtctgagggattgttattgcacacatatgtcaggaaaccagaagttgcctcagaaattaactagatgaatagaaaattaggccattaaggggagactaagaagcctatattttgactaacattctcatctggtcatgcaatgttattcctaattttaaaacatttgggtagcaagtatattaagcagcctgttatgaaaaagcaagtagttgtatttgggttccaggtcttaactctgagtctggaagctaagttcttggtgtcttgctagaatggcagggcaagtgggtaagccccctgaacaaaatgtcatccttgtcatgaagttgatgggtgttatatgtctcttctttgtgtgcactggagaaaggtactatgctagcatatttttgtttaatttttatgaagtaggcatcaggcatttctttctacaccccacacagctagcaagagttggagtcaggatttgaagtcaaggccctctgactccaaaacccacactattcccattataaccagttattccaaaacactggtctgcagctcggtgttggttccaaaggaagttttctccagtctatgacaagactatctggataatgcaacacctccctgtcttgaaagcactgtcatctgttcagagacacctctctttctaggtgtgaaaggcttattttttttcttttatcaaatgatggtgattgtaaatagcagctaaaaaaatgttctaagatatcaaagtgaaaaattggcctccctatggcaatccccaagcttacatctggaatcttattggcctgggaagtgacaaagctgaggaaggagaagtactcccattaccccagcaagggctcctttgggcagactcccaggatggcttaggcttacctgaggttaacccagaaaagggcttggctgcagccatagctggaggtgatcaaaatacttcttaaagccatacttcttggactctaagtggtattagctcttgccagtttagctgtcctgataatgtaggtggccttttaaaagccacaataggttgaattattattattatttttttactagataaactatcttttccaaaaaagaaataaagcttggatgatcagtgtttgtgacgtttacatgtcaggatggggaaggcttgagcttggagatattttaatgttgatgtaactcaagtatgactctcctgaaaaagtcacctttttactgttgttacaagaagaaaatagctcaggctttggagccagacctatctggatttggatctctattttagcctttgcaactttggtcaagactcaagtaaaggctctgtaacatgataacttccttccccaagttaccacggggggcaactctttggaagatcctaccattgcatgcggtgttcctttcctttactgggaggatccacatcagttctcagtgtgtcctcctgtcctgcttataggtgaccctgagtcacacttacttttattttcctgcagatggttccagattccaactgtgcctggagaggttcctactagtcgagcccctgaaactgtataggggaggtgccagtctctctaatctctgccttcacttctgttccagtgccaacaatatgcccaagcaggtggaagtgcgaatgcacgacagtcatcttggctcagaggaacccaagcaccggcacctgggcctgcgcctgtgtgacaagctggggaagaatctgctgctcaccctgacggtgtttggtaggtacctgcactaccccacccccagccccctcttctctgggactctcctggctctgtggggcagctggtctcagcagccagcccttccaccagaaaggaagccacgtggtttgcctagggccctgtctgcccaggcttcagtgatataattttcctccttacctcctctagccattcgttctcctttggattctagtagttcttaaattttttgcaaataaatatcttgtgagagtgttggcatgtggattcctatacttatggagactttgctttgggccacctgaaatgaggtcctgcaatctacatattagcaaacctaggtggttccaaagcattggtccatggaccacatttagagaaccgcctgcatcaagataagcacaagtattgcacaaaaccccactaaaatggctcccaaggtctgagcttcttcagacacatcattaatttaggtaatttgggcacattagctaatgaggtcagtgtggaagatgtttgccccaatgccttgatctgctccagctccatcttgcaagtcctcttcctcctctgcttcaggcctcacccaggcgatggttgttctcaggctattgatacaatcttggtcttaagattcccgtgagggtttattgaaaatggggcaatatacagtttcttgtaatgacaaccacaccatttcctttctcaatccctcccttgttctgcagctctcacttaggtttcacagagaagcagtgaacaacttgtccttcccacccacccacctgcacacacctacctgaacccctccattccatggcctttcctttgagacagatgccttggttgccagtggcccaggatcaggactgggagctcgccacagctaagttcacttaataagaaaccacaggcatggttaggttttccaaaggttacccgccatgtaaccacatctaattcatcacaggacttgaagaagttggagagtgggatttttacctgcagaagaaaaaaaatcaggctttcagccacattactccttcctcatctgtggaattaacactgtagcctgcattcctggaactccatccctcccttatggccagtggtactatgacccaacttgtggtttctgaaagggtcattcatgttggccacccatttgcagagatataaaatttttcttctgggaactttgagtctgtaaagtgaaagatccctgccagcatctctgcctaaattgtttcctccaaaattatatatcttagagtccattcttgagctcccataagatcagcaatctaaaagctatgtaaaaggacatagaagtcaaggacaagccttgagagtgagccatgaggaaattattggaagccaaagaaaatagatgggaagaaaaaaatagaattcacactagcttggtcaattaaatgttcattttatcttgcctccagttacaatgagaagacacacattaaatgccatgccatgtggccaagcttgagctgggcaaggaggcaatatctgtccttgtgggttctttctttcttttttctttttctttctttctttctttcttttttttttttttttgagatggagtctcactcctgttgctcacactggagtgcaatggcaccatctcagctcactgcaacctctgcctcctgggttcaagcaattctcctgcctcagtctcccaagtagctgggattacaggtttccgccaccacacccagctaaatttttgtatttttagtagagatggtgtttcactattttggccaggctggtctcgaactcctgacctcaggtgacccactcgcctcggcctcccaaagtgctgggattataggcacaagccactgtgcccagccccttatagtttatttctataaacaatttctggctccaagtagacaaatagcctcaaataagttggagtcaagttgccagtgtgcactttcataaagccttgagttctccttgactctttgggtgctgactttttaagaatagttggaggtatagaaagttctcttgctagtcatcaaaatcagcttcacttatctaatgttgtttttgttacacattgttcatcatttaatactgcagaagcatgagaaaggtcaatgttgctgaaataagtgtctagagtaagtcatttgacgaaggcaaaaaataaattcatattgttttccccttccttttaggtgtcatcctgggagcagtgtgtggagggcttcttcgcttggcatctcccatccaccctgatgtggttatgttaatagccttcccaggggatatactcatgaggatgctaaaaatgctcattctccctctaatcatctccagcttaatcacaggtaagactacctcactagtgcctggctaacatgggtcatactcctgccctggcttttaattaactgtagaatctcaatttggttgagtgaatgtgatcgtctatgtcatttcatttcagagctttggttttcccgtctctgaaatgaggataatcaaccctaaagaaataaaagcttgccatcgattagtcagtctatttgtctttctctccagcaaaaaaaagaaaaaaaaaaaaaagaaaagaaaaggaaacacagccacatgttacaagtgatgatacctctagtggttttaaattttttttttttttgagatggagtctccctctgttgcccatgctggagtgcggtggtgcaatctcagctcactgcaacctgtgcctcgtgggttcaagcgattctcctgcctcagcctcctgagtagctgggactacaggcatgtgccatcatgcctggctaatttttgtatttttagtagagacagggtttcaccatattggccaagctggtctcgaactcctgacctcatgatccacccgcctcagcctcccaaagtgctgggtttacaggcatgagccactgcacctggccttaatttttaatgtctacttttctcccctttctaaattatattttgttcagatactgataaaggtaatagatggaaaaggaaattatctactattttaattgggaattgagggagattggcattaaaaataaatgaaatgctaggtatgaaagccctctgagtttttcagaacaaagttactcctaatatgtggcatcatgttcacttatttttcactaccaccaagttggccaatgtatgatttgttaacaggtgtatatcctgagtcccagcatcaattatctttgactaaaataattaattactttatttgaaagaatttgttcttcctctgtgggcttatactggtattttcctccttaccaaataatattgctcaaacagggtataaattgatgccctttggagactaaactctgagttaagggcaggaagctgagctttggtccatatttgggtaccagccagctaagtgatctggagaagttgttcccctggactggccacctcatgaaagaagtgagtgaggctctggtaactccaggagattcaggggctgagctgggttgaggcttcagctggttgaccagtgaccccagtacctgaaatgctggaactcaggatcaggcacttaggggctaagtgggaccttatcattcagcgctagattgagtgaaagggtgcatttaccatcagtgctcctctataaaccagagaaaatgttctctgcacctgttaacaggtcatacgttggccaacttggtggggaaacctagctcccgtcggctagaattagactaggttgtaaagagaagtaggtcacacgtaggtcagcttaatttagagcagctcacatcactaacttcttcccccatagcaaaaaggactaacacccaaaaaggggttcaatctctctttctggtaaaagcaggaactgaaaccaggaagtgaacacattcaagaaacaactggaaaaaaacccagtggggctggagtttttgtgaatttgcttggaatttcctctaacctccctaggtatagatgaagtgcccaccattggcagggtgcttcacggggtgttccctaatccctgcatgaggctgggaatgtggatcttcatgcttcacctcagagaaatgagaggactgggcaaaatcgttattctcagactctccatgtcagttaccagtaatatattcaaaagacattttgagtgtggcacagaactactagctttttagtcttccaagtgaggacattaaaacataaataaataaacaagttaaaaactagcatgtaccagcagcatcgcttcataaaacaaaggagatgttaagaccaaaaaaaataaaaagtggaaaggaataatctcagaattaaaaatgggatgtcttcaactttattttaactcattattgcagactgacaaaaaatttgttacagaccatttgtaaactctaaacaggaggatctccaactctcccagttctgtaaaatcttgaaaatctccctggataatagaatgataaactatgggattgatcaaatattcaatacagtcggccctgcatatctgtgagtcccacatgtgcagattgaaaatatttgagaaaaaaaactaataaaaaatacaaaataatgcaagttaaaaatatagtataacagttatgtacatagcatttacattgtattaggtattgtaaataatttagaggtggtttaaagtagacaggaggatgtgcataggttatatacaaatactacaccattttacagaagaaacttgggcactctcagattttggtatctgttgggagtcccagaaccaaccctctcatggatattgagggaagactacagtaggagatttaatcaaccattaacacatttgagtaatatgaagctaacgtcatagaaatgtagacacaggtcattagcacaaacgtaatagaattaatccttctgcatttcttttcaatccagggttgtcaggcctggatgctaaggctagtggccgcttgggcacgagagccatggtgtattacatgtccacgaccatcattgctgcagtactgggggtcattctggtcttggctatccatccaggcaatcccaagctcaagaagcagctggggcctgggaagaagaatgatgaagtgtccagcctggatgccttcctggaccttattcgaaatctcttccctgaaaaccttgtccaagcctgctttcaacaggtaacccagagttcagatgttctctcttctccagtcctctaagttatcaaggcgataacttaagagtattttaacagaccaactctgggtagaaattttctaaatatataattatctctgtctaggcccagggattctatgaggtggtttagggcaggatcttgggattggagtctcctggttttaatttttttaaacatccctttttttccagctcacttaatatatttttgctgtgggattgtcctcctttctcccccaccccccccccccgcctctctctctctctctctctctctccctccctctctctctctctctctctccttatatctatctcttcctttcctttttgtgcatgaggctgggaaatgtgtctttgagttgtccatgggcatatttttattagccttgcccacaaccttctagaatacacagtggttctcaaacgtggcagtaaagctaaaccaccaatggcacttttaaaaaaatacaaataccctacacaatcagaatctccaagagatgaatctggagcttgggtagttttttaaattgtggaagtaatacatgcagattatgaaaattttagaaagtatagaagtacacaaagtaaaagttagaagcttctgcttccccttctctagagctacttatgttgagaatgctgtttcctcccctgtatttttcttttgccacttatgcaagtgtgcataatctttaaaagaattcaaccctggctgggcgtggtggctcatgcctataatcccagcacttcgagaggccgaggcagggggatcatttgaggttaggaattcaaaaccagcctggccaacatggtgaaaccccatctctactaaaaatgcaaaaattagccgggtgtggtggcgcatgcctgtaatcccagctactcgggaggccgaggcaagagaattgcttgagcccgggaggcagagattgcagtgagcagagccactgcactccagcctgggagacggagtgacatactgtctcaaaaacaaaaaacaaaaaaacaaaaaaaaagaatttaacccaatggtactccattgttcataaaacgttacatctgactttttcacagaacaatgtttgaacaatgaaaaacattgaacaatgttttaaagtcatctcttctttttttcatgattgcataatatttttaaaggataaattcctagaagtaaaaatgtccttgtcaggacaaggagttttgtattttgagtttgctggctgttgcaaaatggcactacaaaagtatgtagcagtgggtacagattccttagcaatgtatactcttgcttgctgcatacatgcctatacatttttttaaacttgagatttttttaaaacaggtgattctgttgagtggaaccactgagttagctgagtaggccccattcactaccctgttttctagccccaaggccagcataggctagaacacatcccgcacaccccggtttccattaacccaggtagaaactaagctaaaaccaagcagtctaagctaaaacttcagccatttccaagcacagaagaatgagcttaggaaacagtttgcttagaagaaaagtatgtattcctagctgtctccaaaatgtagtccttaaccattgctgagcccagattactctgggttgggatatgttccctggtttcagatactattttagtggaacatgtagcatggacctatattaaaggaaaccattccacgccagggaagttggatgcagaaataaacagaaataagctggagaagaaggtgcttagtgggctccatctgtatagcgtgtttgcccctcagccagcctgctcagaaagatgaactgacttgctttagtgtgagagacacgattgggtgctatccattcttaacattttggaaagagcattctgggatcgcagctgcaggaggctgagctggtagtagattgggggagagtggagcataggagggcctgggaaggacagatttggacacagttctgtgcctggtcatgccatgctctgtgaaaaaaggaaggcaggaccaagaagcaggcaggctcctggagctattgctctggtcttggagtgaacttttgtggagctggccacactcacactcggtgagcgctgtggtggatgggcagtctttgcatgcagctgcccatggcaaaggctgctctctgccattctggaatagagacctgagccattccctgccccacgccagccctgaccccaactttctattgccaaaattcatatgaggactgagccttggtccctcagtaggctcagtatcaaggtccctttggattaggacaacctgaggaagaatggtgtagaatccacctcagggagaggatggttacagattccttaagcctggaaggaaggcactgaagaggacttgaggacaggaaactcttttaaagggacgtggcatttccagagagaaagggtgcgtgagagacatcttctgtgtccatgagtacagctagaagtcatttaaaataacctgtcttgagtggaggaggctccttgaccagagttagaaacagagatgtaaagaggaagatgagctccccgcagagtggagactgcctcctcccaggcgacagggcctggtttgcccaagttaagtccctgtgtctttgtgagcagagaggtctccagcttgctttctggggcttactttgaaccaaagtgagatttccaagacagtaactggctgtaagatatgaccttacaacgttaaatccagcccagtaatagagaccgcatgggttcttttcctccagaaaattccgtgatctgtgtatgttcactcggccaatacttgtgagcaggacgggctgccaggctctctgctttgtacaaggatgccacggggggaggagacagatgaggaccctgccccaaggagctcacttacattaaaggggagggaggtagaccaaaacaaacatcagggaaacacagaagagacttaaacattaagacaggtgttctctgagggctagaggcaggatgataggctggtggtaactaggggagatatttcagctgagaggataggggatcagaatgagttaggcctacaaagagctggggaaaggagcttctcagtagaggcacagatatgcagaagctgaaaagtacttataatgttcagaaaagaaaaaggaggctgtgtgaggccagtgtggaggtatagtgagtggaggaaggtaaactcagctcaggcatgacttggtgggccaggggaagctaaggatatagatagggttataggtagccacacttacctatagactgtatgcagacaagaagaaagttgagtaggtcagtttatggttttgcaggttttatgatgagacatgatggtggcttagggacagggagactggaattagcacctgctatgctttggatgtctgtcccttccaaaattcatgctgaaatttagttgccattataacaatattgataagtggaccctttgggaggtgattaggccatgaggtctctgctttcatggatgggattaatgctgctataaaagaatgagtttggctcctttgtgcctctctttgcctttctaccttcctccatataatgatgcagcaagaaggctcttgcccgatgctgatatcttcattgtgtacttcccagtctccagaatggtgaaaaaataaatttctgtttatcataaattatccagtcttaggtattctgtcgtagcagcacaaaacagactaaaacagcacttacatggagttgtgcaaccgaacagcttctgtgaatcaggaactcaggcagagaactcggcctgcgttcgtgttcctatctcctcagcttcaacttacatcactggcctttgctatttgaaatctggatttctggagtcaaacataactcatctcgaatcctgcttcagcaactaactagcaagctgcccttgagtcgaagggctactgttgacctaagacgtaatggatgtaaaataggtagcagctggcctcctgcctgatcctgacagccaccattcatttagatccatgagtatttctcttttaaaccaaacgtaggcttctttagcatccttaggataggttgacagttggctttggttcccttttctttcctgggagcatgactctgctgttcacataagcttctcttgtgatcctccctgcattctcttcacaccaatgttgcccagatgaaggggccacattgaggggagaagtgggctgcctgttctcccctcacacagcaggccctaggcttcctctctccctgcacgagtacatgtggccaggctagaacagagagcaccctgcctcacctcagagaacactgacctcccttcccatccattttaaataactggcagttcagcattgcttcctatgggaaccagcacagtaggattgggtccctatagcttaacatacagcacagactgtggaaataactcaatggaggtgaggtcatctgagttgacatcccagttctgcccataactccatgacgtccaacaagtcacttgactttcccgtacatcttcttccgtatctattcggggttcagccatctgttacctactacatgccagcactgacaatctaggattctgcattgagttctattttaatgcccctggaggtggtgttttttaagctcagatgtggatttttatagcactctgcatgtagggtgcctggcacctttaaaaataggaccactgccatggatgtcgaggaatagcgggagaggttccttgtgagtcatctgacagagacacttggggaacattgagaaaggcttggcatcactgctcagaaggagtggctgtcttcccaccttgaatttggatctgaaatataagcaaatgctcctgccatggtggctgctggcagctggcactcttggtgcccagatggagatttccagctgagcctggctctagaaggagcccaaactgaggcagcctgtgatacccctgtccagtggggaccaggtagaggggaaaacaggtggatcatgagttgctgatctgacccctgccaaggcttcctattcttaaccagatccagggcccatcacaactggaaggaccatcacaactggaaggaccatctaactgggtctcacaattgggaagagcatccaagttagacatttcatactgtttctgagctacaatcataggagtgaaagaagacatttatcccccaagtttaagcctgtgtcctattattgactacagtacttatagtacatttgcaaattattttcatacattctatatttatgaaattgtgtcatttgaagcaacatggataagactggcggtcgttatcttaggtgaaataagccaggcacaaaaagacagatattgcatttctcatttatatgtgggagctaaaatatttgaacacatggaaaaatagtggaaaaatagataacagaggctaggaagggtgagtggggggaaaggggaaggacgaagggaagtagcttaaagggtacaaacatacagaaagatagaaggaattcattcaatgtttgatagcagagttggatgactgtacttaaaaaatgcattgtactcagatgttagacaccttaaatgccctgatttgatcatcacacattgtatacattaaaaaatttatcatgtaccccataaatttgcacaaataaaaaattgtgtaattatctgtgattaggacaattgtatctcactgtgtataataaaacaccactttgtaaatatagacatataaaatattctccagttttcataaccttgttttggcatttcttaattattgttaacctgttgggaaccttaaaatatatgagtagccaatctttttttttttcaccttataggccaaatctcagctctatgccttttttccctcactctgttagattcaaacagtgacgaagaaagtcctggttgcaccaccgccggacgaggaggccaacgcaaccagcgctgttgtctctctgttgaacgagactgtgactgaggtgccggaggagactaagatggttatcaagaagggcctggagttcaaggatgggatgaacgtcttaggtaggccagctggtggtccgggattctgcttccctggcaatggctgggctatcctgcactcccttttcagaaaactgatgactcagctgtcctctaggtggagcaggaggctctctctggggagcaatttgagggtcactgggactgagagctgagcgatttaaggaagagagagaagggcagaggagaccataaggggacagggcagcaagaagctgggtatgggaaaaaaggagggagctcaccgtcattgggcacattccctgactctctgtgtggtgttagaaagtcactttctctgactctctgtgttattaagtgacacatccattgctttcgtttcttaagcattttttaaaagctgcccccatgtactggtgctgtgctaggtgcgggggctggaccaccacagcccttagtctgcaaacaaatgcaatgctaccaggattgtaaagtgttggagtaggtaccaagggagctttacagattatcttgttatcttgttttactttctgggatcccagtgagccctttctcctagcccagtaccttcttagcatgccatcctagaggtttttgggctctgcagttgggcagacctgggtttggatccagtatgggccacttactggttatctgaccctgggcaagttactccatttctctgagcctcatttgtaaaatggaaataggattggcatctattttgtagattactgtgaggatgaaatgtgattgtgcatatagggcacagtagcacatgccatgtgctctctccgtatgagctgtgatcattattcaaagtgggtggagagctgaggagttcagtaagaaaatacctccatgagggacagaggtttattaccatgtgagcggctctagtctgcccagtttgctcccctcccactcagtgggtccactcccttccgtaacctccatccatcactagaatggtgtccccgagacaggaaataggggcatttggccaaaacctgggagaaatggtgaatctggatggatgaagtatgtttatttatccaagcacaatttctaaaggtttggatgacagctacttagagatgaatgagctcagtagtcctttcacgttgtcatctgaaagatcacatggccttgtctccttagttgggttgtcagataaaatacagaatgcctggataaatttgaattttagataaaaagcaaatagttttttagtgtaagtcacaaatattgcatgggacataataatactaaaaaaaaagtattcattttttacctgaaattcaaaaagtaattgagtgtcatgtttgtttgtttgttccaaatttggtaagcctactccttagccatctagaatggtagagagaaagaggagagagagggagcagaattgcacagtcactgagaagcagaagcagatcttttttgtttggcttggcaggaagcaggttggatgagtgagagtgagggaagagatgagctgactaggttgctgggcaatggaagatcaataaacattgtttaacaaccagtgggaggtgagaggtggaaggagcgaggagtaggaaggagagttcctctggggagattttgcaaatatccccagcacccaccaccgagcagctcttctccctcactgtccagctatctatgttcctttcaggtccttcctaactcccccatggtcttttctggtgggtcataacttaaaacacccaacccccttttgtcaaagtgttcctcagtcttctccatactcaggaggagcttgaggccatgaacaatggggccagggctttggagtgaatcattcaaagactttcctggttgtttccagagtcttggtggattctgggaagtcacaggacctttggctctactggggagtttcaacacaactcactactctgtaaccccagcggccaagtccaagagggttttgttcagatgcaacacccccgttccagtgagcaatttcaattaggcaatgtttacaaagaaaaattacaagctgaatacggtttccatccaagtgcagatcaaggctctggaaagccaagggaagttagactgttgagaaacttcccatttacaaatcatggctgaaataaggttctttccacggtcttctgagggtggagatagtggcttttttatttgtttgttttgctgtctttctgttttttggctttggaaagtcccgaggattaagcacttgcaataagtgaagatacaaccccagctcttgcctcccacttctttaaggaaccatttctctcctaaaaaacctccagaaacaattctggtctccaccctctcccaactgcttaaatcaactccaactgttcctttaaaaacctatctctcatagatatggccagtttctgctgacactgaatggagctttttttattccagttctttgggaccttgatacctcgggcattttctcttaatttcaaatgaaattaaccaagtaatatgagctattctcagccagaatattcagattgattctctttgacctcccacgtagcagactcctctccatgggcttgagagaaggacttgggaatggcctgaaattgattttgtacattactgcggaactagttccctctgtcctggatctaatcttccctaagcctttgtctttccagaccaataacttacttgtgaagtcatttgtcaagctttctagctgagagcaaaaagaggagatactaaatgtgaagtattagtaaccccaagtgcaagtgatggattctttttgctgaagatagaaaggatccagcaaagggtagttagacaatctgggttgatatgtgcttggtgtaaagaggttagtgggttagatgactagggaaagagtaaagtcaaaggttcagagagaaggaattttgttataagagaatcaaattataatgctaaaatttactgagtatgggttaagactttaggcataactggacaccataggaaactggatataatagggagggactggaaattaggactgccaaattgagcaggttaggtgtggagaagaggaggaaagagaagatggctcatacttcagagtcagagaacaagtcaggtggggaagcaaagtcctgtagccaaggacatagcaacactgatttatagaacatgtaagtagtaagaactgagacctcaagaatggcaatactagatcaggggtcagaggtcagggagcacatggggattggaaattagaaatccagatagcccccaggcagtactggaaacacctgtaagccgcacaatgtgccccagtccctggatgcgttggagtgagactgcaggcctgagcgtgaggtaccgagggagagaatggaagggaccaacaggagtggtaggaagagcaaagccaggcctagccttggaggaactaaagtgtagggcagattcccaggatctcaggcacaggggatgaggtaaagccaacacagaagtaagactcatggttgggtattggagttggtccaagacctagtgcaatgtgatgctgacatgaagagggcagagatgaagctccttaaatctttcctggggttaggattgaccccaaaggctgatgtgaggctggacttagatacaagtcaagaatgtcaagtaaaggaagaaaagagtggagggactaggaactagcaaaatctgacagtgaatctatattctgtctttatgatcctgaaaaaataaataaaataaaaaaagcattctaaccatttcaatcatgaaaataattatgacaaattcataaataacagattacatttaaaaaaactggataaaatggaatttcggattccttattgttttccctttgatttttcagtatttttttctccctgtcattttatgtgtgtagtaataaaaaataattttacatataggattttgtaagagtgaaacataccagccatgcattgatttgggataataccaaaacaagctagatgtaactctagcaaagaatttattggctaattggcctctgctattccaatattggctccaaagtttgtatgataatccccaagtcccaacaggcttttcctcgttaatctgtgtaataaaggaatctgcttacacatgatttcataagtgaggggagggaaaagagagcaccttttagtttggaatgaaaatgaatacattttcttcaaggacctaatgctgcttacagtttaacttgctcatgtggaaagtgttcaagaaatccaaaattatccaggggaaagttacattcagtatcaaatataatgctttgttcttttaatgtctaattcatagggtaaccagcagtgagaacatggctccatacattgggaatggtaaagaatgagggagaaaaagtacattttttgtaatttgtccttctatgtaatgtgattcatccaacaggtctgatagggtttttcattgcttttggcatcgctatggggaagatgggagatcaggccaagctgatggtggatttcttcaacattttgaatgagattgtaatgaagttagtgatcatgatcatgtggtaagtggccttgttcttacttcttagcagtgggttgagaaagccttggggtccccagaggatactggagctctccctgcaggaaaaagttggcatgggctgatcaaatgtctttccagaaagactttgagaaagggatgaaaatatcttttttggagcttcccctagaacaagtgtagacaaattatgccccttgggccaaatctaacctactctctcttttatatggccagcgagttgagaatgggttgtatatttttatgtaactgtcttagttgggttgccataacaaaataccaaagactgagtggcttagaaacaacagaaatttctttcttatggttctggaggctggaagttcaagatcagggtgccagtatggttgggtctgataaggggccttttccaggttgcagaccaacttctcattgtatccacagttagaaagatatttatttatttttatttgaattttattctattgtaatttttttgagacagggtctgactctatcacccagactggagtgcagtggtgtgatcatggctcatcgcaggctcggcctccctcactgtagctcaagtgatcctcccacctcagcccctcaagtagctggaactacaggtgcacactaccatgcccagctaatttttgaaaattttttatagagacgaggatttcactatattacccaggctgatctcaaacttctgggctcaagtgatcttcccacctaggcctcccaaagtgctgggattataggcatgagccacctcgctcagcatgaaaagagattcagaaagctctctggggtctcttttacacagtcattgtctttccatctattataacaaaataccttagactgggtaatttataaacaataggaatttattgctcacccttctggaggctggcaagtccaagatcaaggtactagcagatttggtatctgtggagggcctattcctcgtagttggcacctttgtgtgtgctctcacatggtagaaagggaaaacaggctccctcgagcatcttttattaagagcactaattccattgaagagggcacagccctcatcacctaatcatctcccagatggttcacctcttaacaccactgccctgggaattaagtttcaacataagaatttgggggacatatgaattcaacttatgaattgcagtttttgccattactttcaatgggaaaaaccacagttacttttgcaccaacctaataattaacttgcctaagatgattatagctagggagaggaagagctgtagttcatattggtatcaaaacccttgatgcataagcaggtaggttttttggtttggatcgtctaagcaatattgtttcccctttatttcacatgtgtttatagtcagtgactctgaaatctaggggagcctaggagagcatgagtatctattctctcattgtggaagctctgtcatcttcaatcattggaaacttttggtgtcccatatccatcagacagaaagctttttacttgcatttgtttcagatctctaggatggtcctgtatgtctgcctagaaaaaaataaaaccactcttagaccaagtcatacctgtgttctcttttccacaggaattctgggttacctattccccatctctgcatgttccaggcctacccaccttctttgccaaacttcttctgatccttttccacttttctgtaggtgtctttcgtggaaattccagctgctttttctcttcctccttttcttgtctcccaccccacctcacaagggcaaaaatctgttcttttttatctccacagaaccaaacatggtgatgtgcctgtagtcaattgttactaaaactttaggaacgagtgggatagctgataactccaagatttcagatcaagaagatgctcctcactatttcatgaaccatatttaacagacctggcttgttcagatcattgttttacggtgcttttaaaacacagaaaggatgctagtgaaataacatcatgttctcttttatgattgtactgaaccctcagcttctcaggcaattctagatttctggatatttctgttgtatgaagatttgggaatatggtggtgttgtaaaacatatatatatatatgtatatacacacacacacacacacacacacacacacagagagagagagagagagagagaaagactcgccctgttgccaggctggagtgcaatggcacgatctcagctcactgcaacctccgcctcccgggttcaagtgatttttctgcctcagccttccaagtagctgagattacaggtgtgcaccaccatgcccggctaattttttgtatctttagtagagatagggtttcaccatgttggccaggctggtcttgaattcctgaccttatgatccacctgccttggcctcccaaagtactgggattacaggcatgagccaccgcatccaaatgtaaaacatattttttaagtccttcagattcatctgagtctgtcgagactttagtacacaatgcagaataagtctcttgcttaaacattaggattttccattgtttcctagaatttctagcagattacgcatctttacgccaaacatgcagcccgtatttctgtaatatgatgccaataacatgggcaatgtatgtgtccttcctatgtccataccaatgtgatttccactaaacccttgcaggaaagggaatcttctaggacatcagatgagtctgtgggatgaagtgtagcctcccttctccccagagatggagggtggtggtatgaattaagaagtttcccattcactgaaaccagaactcctaaatacttattatcatcttgggaggtaaaaagtggttgtgaggcaggaataagaccttagaatgatttctgacagctgtttggttacctcatctaggctcatagtcaggacaatgtcacatgacatgagatgccaattctacacatttctttaattctttcactgcctcgtcagcatcagtatttgctaatgatgtgtgtaaaaaggttctggataaaacagtcaactactctttaactgacccctcaaagcttaaaaaaatcagaattcttttgtattcttttctatgtagcagttataatagtaataatagcagaatgtaacattgaaaagattataataattctttttattattaaattataaattagaattactaacttcttgctgtatgctcagtactatttcggttacagtacaggtactaacccatttattactgaggaaacaattattattaaataacttaaatttaccaaattcctgctaaatacttaatattattccaattgttttacatgcattagctcatttattcttcacaatagtactgaacaaaaataggtgcttttgttaacccatttaccaaatgagaaaactaagcacagaggttgacttgcccagtgttatggagctgtacggaagtgatacctacatcaatttctttttgacttcagactggattgaatccaggatcctcctattgcaagttgtgtgactttaggcaatttagacactctaagccccgatattctggtgtgtaaaatgggataattctagaatccaggccataggttgctgtgagaattaaggctgtgaccaacagtcatgaagcaccttctttgtgctgggaactgtctaagcactttacatggattagtattatagtaatagctgtttgctgttaccaatattatcatcaattcaatccatatcctttgtatctctgtgttcatgaattctttaagaaacctgaaaaccccttaatttttgtatgattttcgtatcctcattttcttaggtagttatttaaaacatttttttcaaaatttgaaaaacttaaacagaaagtaaaatgtttcataatctcacccctataaaaacataaagtgagaagtaaaatctctgcctactcttccaattcctttttccaataaaccaccatccatccacactgttaaataaaaaactattcaatgacacgtgttaaaacacagtaaggcagattttattcaggatcattgcaatgagcacagggaccacagcaacgggattttggagtgggggagagagattgggctcacttgcaagtacaacatgggtaagtgggaatttatagccatggagcaaggtgggggcagtggatgctcgggggtaaggagtattttggctaaaccaaccccacaggattctagctgaaggccacagggtgaccaaacatcgtccaggagaggatgaagaacctgatcagatttgagggtgatcagattttgaggatggaggttcttgctaacctgacttagatgagttttttgctaaaccggattttataaggaaggtttagcaaagagcccagaagaggccagaagaaggttcagacgcctaactgaagtttggtcaaacaaagaatctttgtcaatccatccattttttttttcattcaataaatattctattctgtgcaggcaatgattttaggtactggtgagataatggtgaataagacagagaaaggttctggcccttgtggagcttacattctaggaaagggagagagggaaagccaaaagggagcaaatggtagcaaattgtctttgtagcacttattattaattcgaatagtaataagtgccgtgcaatagcgagagatagtgatgggggtagaagtgatggcccacgtggtgctgtctggaaaggtgacctttaatgaagacctgcagagtgagccaagcaacctggtgaagaactgaggggagaatattccaagaggaagaagtggcagggaaagccttttgagggtcagaacaaaggtctagagaggctgcagtgtggttggtgaaagggggcaaaaggaagtcaagttggagaggtgggcaggaggcagatcctccagggtcctgcaggccaccttgatgggttggaatttcatttccttgcaaaaggaagtctctggaggaataataaacctggaggctatactaactgcttttcactctgtcttgatgaaaagttctaatccacaaatggtaacttttaacaaaaatcactctttgggtagctggaactcctatccctaaatggattgggaaagatgaagatttgtgatactttctgagcacagacagcacctttcagcaactcttggaatgtgtgtttaggtctattgacaagctattggaaacgtgtgggacagaaccagaggtgctccacagcagggctgagaaagtccctcagcttacctccactccaagtgtctgtctcatcatctgtcccaggcctgaaagtcccaaatgaattattcgagtgggttaagacctcaaagatcctgaagtagttggagctaaggtaaatggtttccagaaggtcaccaagtaatatctgcgtttcatcagttgcagttaagatttttgtttcttgaaatactggttttcaaacagatcagaattacctggggagcttgtttaaaatataaatgccccaaggccagctccaggacattctgactccataggtatgtggtaagcccagggaatccaggtaagctcaggtaagcccagggtaagccagggaattgttaacaggaagctggtggtttctggcacccggacaccgactgaattctaggtagcttgcctgctgtagatgagtgtgtttgtggagccctgcgaggggcatcttaggctggcaagggctgaaagacaaagtaggtggaggctagaatggatacagtagtaagaaaaagactccacaggccagtcctggatgaatctgtggccctgaaaacagagaacaggaacagcctaagagcagcatgggagccattccctctccccaggctctccagccatgtccttctcatgtggaaaatggaccaacaatcactgggcattatttggcttcagaactctccgtggagccctcagcctctttatgcactttgatttgtggttttgattgctggcttcatctcagaagctttgagtggtggccttgggtgctgggcatttgcccatccttttccatggaatgttattttcaattaggtaattcattgatatggaaacccaggaacccagaagtcccagtttcggagtgaaggcctaagttgtttgttttaaaaatgggtgcagttggtcggccacacctataatcctagtgctctgggaggctgaggtgggaggtttgcttgaggctaggaatttgagaccagctgagcaaaatagtgagacctcctacaaaaataaaaataaacaaaaattagctgagaatggtggcaaacacctgtagtcttagctactcaggaggctgaggtgaaaggattgcttgagcccaggaggtcaaggttacagcaagcaatgatggtgccactgagctccagcctggctaacagagcaagactctgtctcaaaatataaaaataaaataaaaaataaataaaataaaaataggcacaagaaagtaatggccctgaaagacttcatagaacaaacgttcttaccttcttctacttaatgctcatcctattcccagagatcaaggtgtttggattagcaagggcttcttcttgccatatttataaaccctaacacttcactttctggcctttgattaacactctccatttacaatgggagctcatgcttttctcagctggctaagtgccccagaggtaaactgttacctctctctagtccatctgtctgtggcccaaatgcattctccaggagactctatagctagtctttttttggcaaagagccttgaaagcattttctctccattctacaaattgctcgtcccaggagagaaggaaaattgaatggcaccccaaacagcttatatttgtatttttctggacatctttaaagggtgcttggtgcttgggaaagaattgatctcttgttttatgaagataaatgctttttggctttataggaaggttcattctgcttatttacagtctcaatgaatgaagtgctggtccctgagactaccttgataatttataagatgtgactatggacacaccagcagaatataaaatggcgggagagctaagggtttaatgacatgagcacaggtttgtctcagactccctaatgtctagggaagcagtcctcagacttgaccagcctgcaccccacggaaaggaaaagtaggaccttcaggctagattctcatatgggaagagagcagctatgctaatgttagtttaactaatttgtgtcagttacagatcagttccttcaggattaggttcctcttgagagaatatgttgctataaaatcatcttgcaattgggtatcccatgagatgttctagaaagcatcactaactcaggcttactaagcatgagtgatgagaggacatggggtacatgtgtgaaaacagaacctacaaggaatgcctttgtcgggactcagagaattaatggtactgacagagatgcgagaggggtttttagcagcacacatatatgaatgctcaaaaatttaatccccacagcatctccatgaggttggagttagccgctctgagccttgacatacatatctgtaaaatgggaataagccactaaccatggtcacatattaataactaataagtggtgagacgagctccatgtcttatgtagtattcatatatatgtgtctcatctactcttcacattttttctttaatccaggaaagtgtttgctccaggcacaattgcaagtctgtatagatcttacaattacagcatcctttcctgactccctgacccctgctggaagccttatctagggacttcattctccccatagtctttctctcaagtatgttcataatttttaataaggtagcagccttcccataaatattttcatatcagccagaaactgtcacaggctgaacaaattcatgccctaacaacaccattctggataataaaggattttaccaaatatgggaagaatatattcaggttgagagagaaaatagctttcccaagagtgaggaccaaagtagtttccaaactctctataaattaataataagatagaactataacatcagtttatataagataaattggtatacgacaaactgcttatctacaaagagctgtgattattcactaaaaagaagtggcttgtcttggttgggaaaatcccccagttgggagtttcacagacctgagattgttttcatttcctggtttcctggtcttgggctgattatttagcttttcttaacctcagtttctttatttgccacgttgcaataatgacacctagattttcgggttgtggtaagcattaagtgagggaatgggtgtgcagctctcaccatagtgcttaaaacaaaatgaaagtagccagcattattgttagaataagtatggaaaaaagactttcagacttagaagtcataaaaccacttttctctaaatgtacattttggctcagatgatttccttgttctctctctctctctctctgtctctctctcatttcaatatattccctatcttcctaggtaagaacaatgcaaatttacaaattccagtttatagttttctaaaaagctcaaattcccaaatttctaggaaggaactgaggaacacaaatcaaacaagattcccagagacacacctgggtctctcaactttgaacttgatggtaaagataaagatggcaatgcatgtctctcctttattcctagaactcaccttagccacaaaatttgcctttggacttttcatcagagcaggcgccaccagatccacaaaacagattttggttaagggaagtggtccaaagtaaaaaataacatgaacttttctcagcaaaagtctttttttgtacagaagagccaagcgttttcctcagtgtgcggtacagaggaggcccaggttctgaatccctaatgatctcttcaatgctgtttttcccttttgtgtttttcaggtactctcccctgggtatcgcctgcctgatctgtggaaagatcattgcaatcaaggacttagaagtggttgctaggcaactggggatgtacatggtaacagtgatcataggcctcatcatccacgggggcatctttctccccttgatttactttgtagtgaccaggaaaaaccccttctccttttttgctggcattttccaagcttggatcactgccctgggcaccgcttccaggtagagaacaaaagaaatcacctttctctttgctcactcttttgccctctttgccatttctcatttctcaaaaccctcccatcacaaagttcaataagaacacttggcacacattactaagatcttttggaaaaggcgaatgatttgaatttttgtctccttctaggaacttctgagccttctggtgaacatttttgctggtttgcaactatattggaaatacgatctcacattaaatttttcagataaatgcatgctatttgtttgcatgcctaatttgccacttaaatcattagtttagttttagatgttttctaaagggagtgtaacaggatatttttcaataaacatttcacctgtgatttggaaaatgctatcacaaaatattactctttgaagattttggtaaatacattttcaaaagtaggagaagcagcttttacaaagtaaatggtatgttaggtgagactttttctaacaaaattcggccaagtctttgacctcgacacgaacctctaatggattatttttccccagagttaacttggcattgatgaagaatcagttccccctttgttacttagttccagtacctagaaagccaaagaggaccccagagatatgtagagaaaaatcattttttggactatcatcttggactgaatctaacaaaaacaaaccaaaaaatgaacaagaagaaatacataagaaacgtcttacaattaggctgggcgcagtagctcatgcttgtaatcccagcactttgggaggcctcggcaggcggatcacttgaagtcaggagttcgaggccagcctggctaacatggtgaaaccctgtctctactaaaaatacaaaaattagccaggtgcggtggggggcgcctataatcccagctattcggtagtctgtggcaggagaattgcttgaacctaggaggcagaggttgcagtgagctgagattgcatcactgcactctagtctgggtgacaaagtgaggctccatctgaaaaaaaaaaagaaagaaagaaagaaatgccttacaattgagaatttttaagactagtgttttactttcagcttgcaatcattgttttatttctgcacatatgtccttgggtcacaaaactaagactgaatcataaaacaggtggcagggaggcaagcaaattctgaaacccatagctcatcattcaggtccttgttgcagaacctgtgcccatgcaatgctagggaggtgccactgcatgacacagcagggcctgttgctccacggctactgagcagtcagtcaggtttcccttaagcgacctaacagaccaataatgccaaccacctgggaagccaaataaaacttccatcttgcaaatcaatgaggattcagtgctagtagaaaatggagtttcagacaaagctggaatatatacaatcttaagggtctagattctttacccagtttccgaagatgaaggaaaacacttcaaaatttccttcttgatttataaattttccatgactaagtatctctatccatacagatcttcacttgaagaaaaagagaaaaaaaaaaaaacccaacctggtttaattttatttttgttttctggttataagcctggtatctcatactttatctcataccaggctcataaccagaaaacaaaaataaaataaaatttctgcaggctcaatgtgaaaaagttcaggcagtgaatacaattttgaagaagaaaatgagctttgccaattattctatcacccagtgataactggtcataaccttttaattagtctttagttatatatctttcaagttcttactatgtatgtatatattgttttataaatagttatttttttactggtcaacgtatcataaaagttgtatctattgcaagagactttactaccattttttaaactgcataataatgcactgtatgtactacaatgcaaaccccaccctgtcctagccacagtgatgtatatttaaggcatgtctattaaacagggctgtgacaaacatccttacaaatacatctctgcaaggttgtatgatgatcccctcaggataagtggaatttcagagtcaaatggtatgcacattgacagttttgaagcacattaccagattgctattcagaaaaatgtattattttatgttcccattaactggggtttgagggtgtgcccatccctgcttgcttaccagctctggatattgccagtcactttaatgctttccagtcctattgggtgaaaagtaatctcatgggatatgcatatctttacttctccttcccctcccctttcgcctgccttgtgaattgttcatgaacttggtcattttcctgttgaggtattcgtcccttcctgattgattttcaagctctctttttgtataagaatattagctcatgtgtcacaagttgcaaataatcctcctcttcacttgacatttgtcttaaaaatttactgtgctttttgcctctagaagttttaaatttgtacttagtcaaagctatcaatacttttctttagaatttagaatttagattttgcttaggaatagcttctccaagttaatacaatatgactttttattttcttccaatacctttatggtttagatctttcaactatttcaaaaatattagtattattttcttttgaatgactagaacattatttcagtaactttataagacaaggtgaatcttaaggggatttgcatggcccaaatttgtatttaaatcagagacaaatgctcagattatccaaccaaggctgctaatattagaccaatttcttcccctaactctgtatttcatttgaaaaaaaaaaagtggttttaatctttagttaaaatgtggtttttgcctggatgtggaatttctttttttaaaaggccatgtggcgtgagtcatgtaccgagaattaactgaaggtttctttgccatcatggtcacagagaagaaaaaaaaaaatgtaaaacccagggacagcccacaaaatatccttcctgcctcctcggcccttgtacagaataaagacgttgagggtagttgaacatcttttctcaatggttccagaggctggtgtcagggaggacagagggagtggggtggcctgagactgacctgtcttcagccctccaacttcagtgcagtctgttaaaactaatacgtaaaaaacaaaagaagcatttcaaatatctgacagttattattagcaacatttgaaggctgtcatatggccattgaggcaggaaccaaaaaagcaatgtcagcatgtcagcccatccacacaggaaagcttgaaattaaaattctcaagtcctagtttgattgggtgggtgggttttttaagacaaaaagcctgtccagtagagaaatagaggatatttttatacttaccaatcatttttcccagtcgacttaattgtccaaagaccatttgatgacattttggaaaaatgaatgcaataataaacataaatgtatgccagcaattcctagtttgattgggtgggtgggttttttaagacaaaaagcctgtccagtagagaaatagaggatatttttatacttaccaatcatttttcccagtcgacttaattgtccaaagaccatttgatgacattttggaaaaatgaatgcaataataaacataaatgtatgccagcaattccagaagtatccttagatttgagaatgcttgcaatcgagaatcctggccaccaaccacaactgagcagtcatctcataccagtcctggtgtcctggcaacccttcgaaagggcccaggaaagggtggggtaagaggaagaaagggacactgacttctcattaagatagcaagctaggtctgatgccatcccctgcatgcaaatgaggccaggctccaactttgccctgggtttgcaagattttagttatgagatgtcccccaacaaacaattcttcttcctaccccagaccaagaaggaggcatgagacagacccctgacttgaaatcacaaagaatgttctggtaagagaaatctggctctcctaaggttgttttaggagctcgtgggccagtggtttgataagatgcacatctcgcatccctagttttagggcttctgattcgttggttctggataggccctggaatcttcatttcatttagcttccctggagcagatggtcttctcccactctttgagaaactaagacctctacagggatctatgtccagtttggtcactaattctgaccagtagaaggaggaaactttgacaaaagctgtaagtgcaagagagaaaacacctccaaatgttatctgcattgcaggttttctaattcactttgctaaagtttgaatagaaaaaaatcaagaggatggaccatgaagcacttccatggcagtttgagtgttctgcattgctttctacattacttaaactttgcagcaaatccactcaccctcccaggcacttctatccacatggaaataatattctggcctttagcaacccttactgtttattggtctccaattttgaagacatatgaacgtgtcaggaattctggccttcgaggcttggtcatgtggtcacgaatccacatcccaggcctgggaggagtgggggtgaagtcccttcatatttagtctttgatttgctaatgagcacatgctttcctgctccatgtcattgaagtgactgtagaattggccgatgagcatatatcagggtgttggactatctgtgaggttccccagtgaattgcttgaagctcaggttcatgctgaagtgtgctggacatgtttgttgttatggaaattagcaagtccagctcaggacaatttcccagggctaaatgcaatccattcagtcattttatcggaaacagcatttctagcatgaaattatgggttattcaaaaattcctcatcccattttgctgttgatagctgattcttttctgacatagctggcttttgtttttttttttttgcaacccaattaatatgggcaatcagatgcacttcaatatcgaatccaaggtggaaacagtggccaaaagaaaaaatcttcaagctctgagtatatctccaaaaccagaaccaatgaaaatattttgctgcctattagtgtcttaataagattgaatttgagcctccaactcacgagtttttaatctggctccagatactgcttttttgcatgtcacattgcttgattgacacaaaacaagaaaaactaaggatgcagtggcattccagtttatgcattgtcctgcttctctaaagtggacataaccctgtctctctctttctctttgttctcagtgctggaactttgcctgtcacctttcgttgcctggaagaaaatctggggattgataagcgtgtgactagattcgtccttcctgttggagcaaccattaacatggatggtacagccctttatgaagcggtagccgccatctttatagcccaaatgaatggtgttgtcctggatggaggacagattgtgactgtaaggtgagaagggtggggtaaaacacaaaacaacctctaccctgtttcccctccacactaactccatgtgacagaggccacttgaatttcatttctgctggtggaagacaatgaaggtaataaaaaaagagaaactattggcagccttcaaaaggaaaagattgtgacaagaaagaagactcttattaatacctcctgtttgtattgcacatgtcaacttgctttagaaattggatattatttgatttttagcaatcctgtgatggaagcagggtaatttctttgcccatttaatagacaaagaaactcaggcaccaagaggcatggtagtttgtccatggctacagcatggctgtaagtgaggccaacatcagtaatgatttggcaggactgtaactgaggccaacatcagctgactctggatccaatttttgtttcactgaaatatgctcccttcaatattccatcaccagagggtaatggcagaaattacaaaatactggaagagattcctcaatatgacatataagattttattacaaataaatagcacatagttttgtttttactaaagctatttttatttaaatgtattcatcattttaaaaattcagaaagaacattttcctaagagattgttaaaaatgcattgcctcaccataaacttaaagatcacacctactagccaagccaacactctgtttcttgcttataggttaagtcattgaaaatatcagtcttcagcccattcaatgttatattgacattacagcatgaaataaagctttttgcaatcatctttttaatattatcactcccaacccatctaaatgcttcaattaagccagaagccaatttctgccttatgtcatatccctactctcagtctcaatttcctcatctataaataaggaaggtattcataatttggggctaaaagttggtagttcatggatggactcccagcccagagtgttgctttgtttgccttgaaatatattgtaaaagattagaatttcatcctcttatgagacagctgcccttcagtttcccacagtctcccctgctccctattacttatgcctggcctgctgcacctgtcaccacagcttagccctttaagacaacggagtttgtcaatcttggactcaacaatttataagttttatttcccctctcagattctatgtgatcagaaaacatagggagtaagtgggtaacattctgtgtgacagatgtacttgtagtagaaagagaattccagatattagaacagccaaggcctgggtgattcactttaggaaatgaatgaggtagacactggaatacactttcatcctccatgatgataatcactccactctttggttcctctgagatggcggactctttccatacattgctttgaacatgcccagcagtcctgaagagaaggaatagtcattattcccattttacagaggaggcatgtgaggctcaaagaaattatctgacaaacctaggtctcatggctatgggtgccagaggcacaagtcaaatttctattccacagtttacctcttccaaccacaggtcatttcttctttctgactgtgactcaaaaaaagacattagaatagtgtttttattgactttttccattgggcattagaaggggcaatagtttttgggttcaggctaaggcactagcctctttctcccacttcaaaccccgggcagcactgtcaatctctatattagaaactttggtaataatctggtgtctgcttggttcatgttattcaacagcccattctctggtaggcctttagtgggctaaggccattttaggagatctctcctaagaggcagtgttcatttgggtctgatgtctctacatgctcaggctttttaaaagtccaagctcagggaccacccagtgtctgtagcagtgctggaaatttgctctaatcatgtcctctatgtgttctaggggctgatattgccatggaatggccacttcagagcctttgcttgatctatctagctctgaggtattcaaccagctcaaggacatttttgttaaaacacagctttctcctctctccttctaaccattccagaagatttagtgaatatcccatatgcatctgagttcactttagcaactcagtcagcaaatagagaaaagaaaaaattcaccatgtttaatacacacacacacacacacacacacaatatgaaaacatgaaataacaatcacatttatttaatcagctagaatgtatcatctgaaatgtctcccagtggttctcttgctaaattatctcaccttatacatagataaggaaacagaggctcagagaatagatcacacacagccgtctagaggaacaactataatttaagtttccaaatgctggcatatgcttccatttatttaacttgtgatcctagaaacagccctacaaagtagatattgggttctatattttacagatggagaaaatgaggcacagtaagttgaggtaactgggccagaatcatgctgtttgtaacaggcagaaatgggatttgaacccaggccaccttactctggggtttgtgtttttaaccattacacacactgcctccactatactatactgttgggttgcaaaataataatttatatatatatatatatatatataataaaatcttcacaaccaccctatgaattatatactataagggagcctcagtttcctcatctgcgtaatgggaacaataacaaattctagggtggctgagaacatggtgcctggcttatagtctcttatgagtatgagccaggcaccagtcaataaatgttagcttctattattattattgatgtctaataaaatacacaatactcctagaatattaaagaaaaatgtggctgtgacatcatgagtaccatgatgttactgacaatggaaaatatacttcaggtcagaagatcaagcctttcaaaattatgtcctaacagatatcacgagactactaacctcccttgctttaaaactcaaagatgaaaagggcttcttaagcaagtcttttgccaagcaaaggtaatttctggtatctcgactcttggtcttgatggtaaccatattttccattaagttcccactattagatgggaacttacagatgggagaatggaccagtgagtgattgaatttgtgcttaaattctataaatttatctacacagggtttgttttatattaactgatactactgagcattttcacttgacaaaagatgagtttgaccatatgcatttaaatctctggcccctgggtgggttcagtcaaatcctcctaaattgtagacaccacaagggctacctctggggcacccaccacgggtgtatatacttcatgcctgcagtttgtttggaggaaaatagccaaatctatcttcaggctgcgcttccaagtaaaattttcatttctctcctttcactgcatgtaggaaaatagtgattagaaattcttagcatttttattaattcatagaattttcagtgtagggagggatcaaggccatcaaggacaagtgtggcattgaaatcaagcagaccagtgttcaaatcccagcagaccatgttcaagctgtgtgacctaagtttctccacccatcctatctgtgttttcctcacggtgaaagcaggtgttaccatatatgtcccttgcagggttactgtgaggttctgctctgatattgtgtgtctagtatcttaacagcttccaggaaccctagagaagtgagccaggggagtggaaggccaggcaaagcagaaggcaatgagggatgcagggaaaatcactgcccaagaagctcttgcagggcttagaattccacacacagagacagtgcctaccggagggtgagggtattattagggacaagaggggaaagcaacttccaggaagaattatctttctaagactttgtctcacacaaccaaaggataaccagataatgttaatgttaaccacagtgcaaagggatgtgcaagagtgactcagagcaactgatgctgtgtataaaacagtcaaggtcaagactgttggaacttggggagttccccttccctggtgttctgtctgtttgggaaacagttgagaattcccatcttccagctttcagggctttagggaagttttcattgcaaagcagcctggtcctgtccagatttcttgataagaaaaacaattcacattcactgggcatggtgggggtgggggagttgcaatgtgcccagcctcttgtaagtgcattttaatttattagctcctgaaagcttctgaccaccccatgagagagataccattactatctcctttttacagatgaggaagtcaaggcacagggaggttaagttgcctgtagtcatgtggttaagtggcagagctggaatttgaactcaggttgttcaactgcagaactttcacggctgagcactccacactgtacctcctgtgacccagatggattcaaggaaattggagtgctctgagccttgacaccatggacggggaggggaagggtgtggttggggggtctgtagatcacacccagggcaagtgtctatgcaaggatgggcctaaacctgggaatgatggcaataggggaaaaaacagctcaaaccacaggctctccaggggccttaatcttccaaacgtaagattaggtatattcagcaataagaccccaggattctgtgcttggtcaactgatggcctggatttagttgaaacaatttgagaggctgcctctcagctcataaaatttctagtattttataactacaaagaaagcagtcccccttaccttttggcacccacaaaaacaacttgggaatccatatttccaaagtactcttggatattttgatatgacattttgatatgacagctttgtacaaatggcatctagaaaagaggaaaaagagtcactgccctttgccagaccacagagactccctggtgtcaggacagggcacttgaactccagattaaccctctcccagagacaaacttcaaaacggtgctgggtgtggccctggcattgcttggaaagaactgatgagatgcttcagaaagaaagccttcctttctttcattatcatttcttggcatcccctttctgaataatgtattttccagcccatggtgaggcatccaggcgcctgacgcttagtgtcatttggaatctgttgatttgtttccctgatgtccaactcagttgggtctggatatttgctattctgagttctcatgttaaccttggcaatggccttcttagacccttgccacatagtccaaaagcctctggtgctcacagagacataaaagcgtaagcagaaatgaatgcagttgtgttcccatgggaggattaagggtgatttgtttttatctttaatatttccttgcctgcttttagagccacgcttgccttatttgagccctgtgatatattagactaaccggatagcatcatgggaataaggctccagtccatgaatttataagcttacatcatagttgagcagtacccaaataggccttaatccttaattccttggtcttagtactttagatttctctattccttggtggagagtatggggtgggggttgggggatgaattttatggctgcaggaaaattagagcttaaaattgccagggttggttttgctaagattctttccatttccatgacctgaacttctctgttctcatagcctcacagccaccctggcaagcgtcggcgcggccagtatccccagtgccgggctggtcaccatgctcctcattctgacagccgtgggcctgccaacagaggacatcagcctgctggtggctgtggactggctgctgtaagtgtctgtggatggggttctgctgggactgtgagtactgcctcctagggatgcacaggtggcaaggttgcaaccaagatcttagctaatccccatggcaactccctcactcttccttcctccttcccgctcacatttactgaggacctatttgagaaccaaagaagaaaaagatgaaatatttgaaggcgtcacagtctagtggaggaatcagagagattatgacacaaggttaaaagtacagtaataaggaaccagctactgatgcattcaaagaatctcagaacattatattgaatgaatagagccagaaacaaaggagtatgtactgtatgattccatttatatgaagctctaagaaaagacgatgtaccacatatcaatagaaagagatcagttggggctgggtgcggtggctcatgcctgtaatcccagcacttgtggaggccgaggcaggtggatcatctgaggttaggagttcaagaccagcctggccaacatggtgagaccccatctctactaaaaatacaaaaaattagctgggcgtggtggcatgtgcctataatcccaactactcaagaggcggaggcaggagaattgcttaaactcgggaggcggaggtcgcagtgagctgagactgtgccactgccctctagcctaggggacagagtgcgactctgcctaagaaaaaaaaagaaaaaagaaagagattagtggtttcttgggccaggtatagggggatagagattaactgggaaggaacacaaggaaacctttgggagtgacagaaatgttccatctgcacaggtatgcacaggtgtctacatttgtcaaaactcttcaaaacacacacttaaaatgggtacgttttgttgtatgtaaattatgcttcagtaaagtgattaaaacacagcacacacataaaagcatagtgatagagagaggccttcatcccagtcaagaatggaaggacagagcggagaatatcaagaaacatgaaagtggttactgaatttgagtgttcactaggttccagctactagactgagcactttacatcttcctctttaacaaccttgaaagttaaatgttattattcccactttatagatgaggacactgaggtttatagaggtaaagagacttagaaatggacagatattcgaccctaggtcaggctgcctctggagcctgacaaattcttgtttatggtcacattcaagcttctaaaggcagtggtagctgagctgaatcataaccaataggtaaaagtttctcaggtgtatgtagggagacggggagacaggacattccagtcaaggccagcctgcacaaaggcactgaggctaccagcagtgtgaggatgtacaagtggtctggtactcttggaggcagggcgtggtgaaaggtgagcaagacggacatcctcaaaggccatgcagagaaacttgaacttgaccatgtatggtagttcagctacctttcccagtgaaggacattttcctcatgtagaatactcactgcccattcacaaaggtgggaaagtctaaccagatggtcttcgacaagggggttggaatggatcccctctaagtgcccacttgggcttggatgttctgtgagatgtaatctgatgcctcctgtccagcactggagttaaatgatagggcctccggcaatgccagtcttcaatgtcagaggcacagagtgacaagtgctggcccagagtcccaaggccaaagtgcccacacttatttttcaaactgcctgacttgccagtagcaaattttctgacatttattggcattgattttaagagccagaaaccacatttttcttttttttcagatggagtcttgctctgttgcccaggatggagtgcagtggtgcgatcttggctcactgcaacctctgcctcctgggttcaagcatttctccggcctcagcctcctaagtagctgggactacaggcatgtgccaccacacccggctaatttttgtatttttagtagagacagggtttcactatgttggtcaggctggtctcaaactcctgacctcaagtgatcggcccacctcagcctcccacagtgctgagattacacgggtgagccactgtgcccagcctcagaagccacattttgtggacttgagtctgtttctgcttcccactcccacccttccaaagagaggaaaatgcaagtggccgaagggaggaaggacagctgggaaggctagaaagaagcctgacttctccataagatgtgcctgctgttggtgcagacaacagggcttaggttagaaataagaagtgcccagcactttgggaggctgaagcgggcagatcacctgaggtcgggagttcaagaccagcctgaacaacatggagaaaccccgtctctaccaaaaatgcaaaaataattagccaggtgtggtggcatatgcccgtaatcccagctacttgggaggctaaggcaggagaatcacttgaacctgggaggcggaggttgcagtgagctgagatcgtgccattgcactccagcctgggcaacaagagtgaaactccatctaaaaaaaaaaaaaaaaaaaccaaaaaaaaacagaagtaagaagtggctccctgaacagaatcagttcaacttgggagggctgcaaggaaggccatagattttcctgattggctccttcatcatcagaaaatgctcaggaaatacctttagcggaaggtgacaagcaaacaaaatagcctcatctctgtctctgccagtctctcaggtggtggtagtggcgtccctacctgctagcttggttattctctgtgtcctatattggccccaagggacagcctttctcatgacatctgttcagacaaggcagctgagagtcaatggtggtgtatgggtgagaaggattgtgagagaaggggatgaaggatacaaaggaatggggtaggccatggatggaagggggacaaaagggaaataaagacattggcagtggtctagagacagagcaaatagtagcagctcaataaatgtgagctactcttaaccacatagttgctgtgtgataattgggtccatccacatgaaaagaaagacgaaggaagccatttaagttctgctggctttccccatgacttgttgcttacttaaacccttgactctttgcctctcaagtcttttcaatgcttgtggtcattgagggtccctcgcctgctgtgacaatattgcctcatttttttcttgggcttatttccaaggctttaaaccaccattagaaattcatctttttaaaaaatattattatagaggctgccccccattataatacaaatgcctttgagtggaaaaaaatgcactaatatgatcaggagtgaggaaaaggggtgatatttggtgggtactgcaatgtctttacatctgtctccatttaatccttaaggtgccctatgctgtatttccagatgagaaaactgggaatcagaagggttgagtcttttgcctgatgcacagcagagcttgtatggccaggtcaggacacttcacccaactccacacagcctcctaatttgtactaagtgttctaacagtggggaggaggagcagagaggcccagagttggaacggttggagaagacacacttattagggccacccactgggctatggtttgaatatttgtccagtccaaaactcatgttgacgtttaattgccattgtaacaatattaagaggtgtggcctttaaaaggtgattatatcgtgaaggctccaccctcatgagtggggttggtgcattataaaagggtgaattcagccccttcttgccctctctttgtctttctgccttctgctatgtcatgatgcagaaagaaggcccttaccagataccagtttcttgatcttggatttcccaacctccagaattctgaggaaataaatttctgttctatataaattacccaatctcaagtattttgctatagcagcacagactaagacacacctgattctgcatgctaaccagagaaatatttttgacctatttttttcttctctcagcatgaaaataaaacaaataggctcaatgaggacaaatggggtacaatcaaggtcttggccacccttagaattcaagtcttccagccccagtgggtctgccattgtaggtcctggtccttggcagtcacttgttttcaagcctgttggatgtgagtcacttcatgaaacattcaaaaccctgcctacttctgacctaaatgttagcaaatgaaacaggagggctgggccctcccagatcaccccatgcaggtgctcacatgcttacacttgcaaaggaaagcagagcgtcctaactccagggctgaagtgtgtcagcagaagggagttggctgaatttttttttttttttaaaaaggatgatacatttggattaactatgttgatgaaatcatataatagaaaaccccatcctaggctggagctgggaagaaaggagcaaatgaagagctgttgtccagttctggggctctgatctcaaatggagggaggagtgtgatcaagggaaagagagtctaagaggcaggagccctcagtctgagctctgcacttactatctaaaggaccttgggcaagtgactttctgagcctcagctacatcatgtgtaaaatggggcaataacatatcaggttggaagcaagagtctaggttcaatgcctttgagtgcccttctagttttaagacctagagtagaattctgctggggatgaatgtttgtatacaaataagcacgagcattccttttaagaggaaaagaaaaaggaagggtagaggatcctgggaaaatgtgtgtagctgtttgtagctaggtcagatctgctttgaattagtaatggtggcacattctttctcaccagcaagaggagttctggaaactagctcttggttgtgagctctgtgactattgggtgctcattagtgtgtaagtggtggtgggggctaagatgagatggggtgcaactggccattccctagataagtagtctgtggaggaaaagcagagaaaaagaaaagggggaaacttcacctctttagccaaggtttgtaagctttcataactctagcaatttttcaatttaaaaccaaacaaagcctacagtgacatttaatgtgtcacagtgtttgccaactgctggagaccagccagcctcattactgccctctaagccctggatggttttcaacaggcaggcttagctgctctgtaaatgtcatggtgaaaaccaagattctggagccctgaaaaatgccgagtcccagagcactggatgggtgggactgtttaaaaccagaaccttcccctgggtccaggaagccctttgcgtcaggagcccttggcagatatttatgagaccttgctgacaccccagtgtctctgaaggaggcaggatggagtggtaaatgggagccaataccaggaagaggtaataaataactgtgtctggctacaggtaggaaaaggaaaatcaaaataaagtgaaatccgagtggacctatggcctaattctcacataagactctgctagtgagatcttttctgggctcacatgtgctaattggggaatatagttgagacggcacttagaaggaagacctcaaagagcctccaccctccaggagggctctgaagctcctcccaacagcattcctctctggagagaatagagcattcattctcaaactcgagcatgcaccaaaatctcccagagatatatctgaggtggggctggagaattgacatttctagcaagttcccaggtgattctgatgatgcaatctccagggactctcccttccagaagcaatgaactagagacggagaaggaaaacaggagtttctgattgtgggtatatgagcacctctacttttttttgagttaactcttgacagttgatgcatcctttcaaaaaaatagattgaaaagatacaggatgcaaatagctaatacttagtgagtgctccttaagtgttagatattgttctaagcactttacatgggctcgtttgaaagtcacagcagattatgaagcaactaatagtattatcattgttttacagttgagaaaacaggttcagagagaagtaacttatcccaatttagtggatattaactggctgaattggggttcaaacccagatgatctagatatccttgggtgttccaagcatgctcatctgagttctgctgttttaaaaatttgagacacacacatgcacatgcacacacacacacacacaaacttaactaactgaccctccactcatggctggtggaaaacaaaactaattcctacgttaaccttttctttgaagattttaggggcttatgtctatcttagtcttttgctttgatttcccacttccactgaattctcttttttacatcttatctccggtctacatcaacctccccatggaatgtggccccttttccactaagtcctttcctctctcaccaaagtttctctgacttgaggcagcataattgcagatcaaggcgggatggggcagggctatagttctgcgcagcaaaatcattttttgatatatcacaaaataaatgcatgttcatagcaaagggaaggacaaagttcaaaagagtaataaaatgaaaaagaagtcgtctccccttcatcgactgttgaatctcaagtgttatttcactgttaataatttcaggtagcacagacataaaataaaaatgtaatgttaggcatctccttttctaaaaaatcttttagtattccccacccctgggaatttccccttgggactccttgttctccatctttgaatatttccccagctctctggacacccctctccttttcatctgtaaagtaatctgagctctctgtgcctctctcctcatcctgctagatcatggcctgcatcctgactttttaccacgaaaatatctaaccagatgttttactaaacaaaaaccaattgtgtctctagagctaatctgctttcaagtcttaaattcacaatccatcctggtcctgccccttccacataccagcctccccattctcccctgcccagcctgtgccataagtaaatgaaacatagtctcagtcctcaaggagcttatagtctagtaatggggtcaagaaatcccaatggagcctcctaggtgcaaaaagaaatggataaggtgtagggaggaataaaagagaaaatgctctgatccccttttcacctggactaaaaatggtaatataatgagaagcttcttctgggtcatataagccttttatataaaacagccttggtggaggacctcttggttgacaagcactcaatacatgttagcagttattatcttctcaacatgcttgcaggtgagtatccctctccatatgttacgaatgagaaagctgagcaggacaggctaagaaatctttaatgcttgagctgggagtgtcatccaggctggtatccggacttcacgctcttagccaatgcttacgtggatctccttttcttccctaaccccatgtgactttagcccttgaatgcccagagctgtgccagccttcctcgggtttggggcctcaagtgacccctcttccacaccctgcccctaaagacagtcccttcgcaccatgcatcctgagaggcaggtgctatgttttgtttctatcaatattaagttgaaccatatgaaattgccaatatttgacctttttatatggaaataaatggcaatttcatatggttcaatccaatgcaagacaccagatgaattgtgggtgacagctccctcagccctgttcttctctgtgaaccaggagttccagacgatttcacatttccctgttggaggatttagactgagagatgaagatgagagagagtaccttggtacttgtttttctttcagtgaaccagacccagtgactcagtgtgaagtaactcggtcaagcccctctctcatttttggttcctggtgacctctaaagcatagccgtgtcatctgtagaaaacccatgaaatgcaagatctgctttcatcttcatccccttcttgcagtcctgacacacagcgtccagacccaaagatggtgtcacacactctaaaagttgtcttttaccaagccttaaagctcttgagggcaacgcgaaagacagggtttcctgagtggtgagggatgattgtgagagaaaatgaaactctgcctgtgaagaaactttccacacatgaaccacaaactcccatgtcctgccttgggccccagttaaacttccccagagttggtcagacattcccctggcagcctcaagggtgttctgccttgcagcattttcagaaaggaagacccatgcagagcagccatgacctacctcctggctgggcatcctgggaatcttcccagaatgccttgtggcagagaaacctggcatgagagggctctgtattctagtttaatccaaattgacagctttctgtttaacagatcccctttaacgtcctgccttctcacttagaaacctattttcataatcttaccttttactccttcccttctgtattgatggaatacagtccctccaccaaaggaaatggcctttatctccactctggacttccatcctctctgatctctctaggaacctaacttcatcaattattccctcttctctgtatcttcagttacttcttccccaccaacctcttctcattttgatttaaacatgttcaaatattctacctcttaaaacaaaacacaaatttgatctcctttccatttccatctgccatttcctctccttcctttctcaatcaatcatcttgaataagctgattatacataatgtctccatttcttcacttcactttccattttttacctatagtgagctggcttctatcactacctctgtattgaaactgctcttgccaggccaatagtgacctctttgttgttaaaaccaaaagaatcttcttttttaagatggagtctcgctctgttgcccaggctggagtgcagtggcgctatcatggctcactgcaaccttcgtctctcaggcccaagcgattctcccacctcagcctccagagcagctgggattacaggtgcacgacaccacacccggctaattttttgcatttttagtagagatggggtttcaccgtgctggccaggctgatctcaaacacctgacctcatgatccaccaacctcagcctcccagagaaacgtcttaccctcatctcacctgatccctagataataattagggttgtttgccatacccttattttgaagcatacttccatttacttacaaaatgacaaactcttctagtttcctttaacttttgcaggctcttatcttgcccattcattaaaagttggttgaccttagtgttccagcctagactgtctgctttttacactctgcattctctccaagggttaattaagcacctcggtggcatcctcagccttctctatgggatgagtcctattatcacctgcatcacagatgtgtctcctgaccatcagtctatattaccagccatctgtggggcatctgctcataactgagtcacatgcttcaccctcaacgtgtccaaaccaaagccagaatctttcccgctccaactgaccatgctccctacatatggttacattgtctactggttgcccaaaccagaaacctgagaggaatctttgactcttttttattccctataaccaatcagtcttcaagtcctataattctgtctcctgagtcttgctcaaatccatctttctccaaacccatcatatcctcactaactggatttcactctttcaggcttatgattttttagttcgttcttcacaatggaacaaacatgatcttttctttcaatggctcttcattacacttgagataaagactaactcctgaacttggctgataaggccatacatgatttggttaattcttactttctgcgtctctcactatacttgttagccatcctgaattcaactaagtgttcctacctcttagatttcatgcatattatttctttcctctctctatctcattttcttggacttatccttagggcccaactcaagacacttctacttaaagcttttcttatgacccaagtgtgatagtgttctacctacatgaccctgtagcactctgtactcatttctttttgaacatttatctcactctagtggaggaggtagacaaataaacagtacgtgggttcttggggaaaagggagtttaagaaggatttttgctgcctaagcaattggcatagtgcccttacacactctaagatgcttattaaacatctgttgaataaataaattcactaacaaagaactcaaactattagagttgatgttttcttctttctacttagctattaacaggtgtaagaaaaggaacattttcttgctcatgtatgcctgtaacctacaatgagtacttaaaggatgtctagtatttctcttattccgcttagtacaacctcctgtgaggttgggattagcctcattcccttgctcaggtgaaaagttatttgctcaaatgggaatcagaagccctgggttagtgttctcacccaaggtccagggccctttgcatcttgattttgcatcaaaagaataaaagcatcaatctgcttttattgttttttaaaaattcattttaaaatattctttcattcatttttgagacagagtcttgctctatggcccaggctggagtgcaatggcacaatcttgactcactgcagcctctgcctaccgggctcaaacgattctcctatctcagcctcccgagtagctgggattacaggcgtgcaccaccacgcctggctaatttttgtatttttagtagagactgggtttagtagagaccagggtggtcttgcactcctgacctcaagtaatccacccacctcagcctcccaaagtgctgggattgcaggcgtgagccactgcatccggccagtctgcttttattctatacaactctgtcttccatccattcctgtcttaatggctatttcattggccagagttctttttcaaattcaaggagatttgatggcatggaagagatgtggtggtaaaaagaaaaaatgtggggaaaacttactcagaaatcctattccaaaaacttggctgcttcagtggctgcttctggagagcaaggatttggtgtcaagggttgaagaagcagtcgtttgtaaacttatgtcaaccacttgagtggaaatggatgtgttaaactggaaaagtcattaaccctttagcataatattttgtgcttttgttcataacatggtgtgtgagtggagttatccccaaaaacggtaggacccagcacataatgagtgtcaaccataggctaggaactgaatttgtcttccccaaattctacaaaatattaatagttattttggctacatgagaaaaattatggttgagaaagtgtcttagtccattcagactgctataacaaaatactatagaccaggtaggtggcgtataaacagcaaaaatttatttcttacagttctgtggaggcttgaaagtccaagatcaaggcactgggagattctgtgtctggtgagggcctgcttcctcatagacagctatcttttcactctgcctcacatggtagaagggccaaggagtctctattgggcctcttttctgaggtcactgatcccattcatgaaggctccacccttgtgacctaatcacctcccaatggtcccatctccaaataccatcaccttggagatgattaggtttcgtcatatgaattttggggggatgcaaacgttcagatcacagcagtaagtcatccagatcacacagttagtaggtggctgagctagattcaaaatcagggctgtgtggttccagggtgcttctcaacatgtggcagatggtggattctggaatggtaccgcctgtgttcacatttgctgtatgactttactaggatgtcagactttgggaagccactaatctctccaggccttagttctgtcatctagtaaatacgaataatattacctcttcagagttacagtgagggttaataaggtagtatctataaagtatattctttgttttcttttctttctttctttttttttttttgaggcagagtcttgctcttgcccagactggagtgtagtggcaccatctcggctcactgcaacctctgcctccccagttcaagtgattctcccatcccagcctcctgagtatctgggattataggtgcacaccaccatgcccggctaattttgtatttttagtactgtattgttaaccaggctggtctcaaatgcctgacctcaggtgatccgcccacctcagcctcccaaagtgctgcgattacaggcatgagccgccatgcccagcctataaactatattcttatacatagtaagtgtgatataaatttaactgtcatcatcattatcactaccaccaccaccattacctttggtgtctttctttgccaataatgcaaattattctgggttatgagatcaatgggtactcagagtattgctctgaaagacctcagcattctttggaattttgcaattggtcaaaggtattgtatatgtaaactaaaaagtatctgagtcaggtctcaatcaatttagaagtttatttttccaaggttaaagacatgcccagaagaaaaaaacatggaatcacagaaacagtctgtagcctgtacttttctccaaagatgattttgagggcttccatatttaaaggggaaatgcagactggagggaaaagagggagagtctggtcactttactgaatccacatgttgccagggaaaagaagctggtagggcaatagacaattatgtatttatcttgtgctcagtaaatcagcactttacataagataaggtgaatatagagtagctacctgtggagatatttaactattagctatctgcttaggaacagaaggagaggcagtttcttgcatgattcaactttcagcttttttttttttccccatttgacatagtaaattgggggctggagattttactttcctttcacagatatatgactcaggatacattccaggagggattgaaagtatagtggagtagctccaaagtagaccacaactgtataacggacaaataggtcagctagttagttgggagcgttgccataggaattgttgtgctattaaatagggttaatgttttcagggggagatagtagcttaactagccatatttggatgatctacctagaagttgccacaaatatatttgaattgacttgatacaatttataataatattaaaattatacatcatagaataaataatttttttgagttcttattaaatgtccggaagcatgtaagcactttgttatcttatttaatcttcacaacaaccttatgtattggagatttttattattttcattttataaacgaggcaactaaggctctcaaatgtcaagtatgatcagggttgtcaaacagccaagggacaaattggcatttgaatccaaatcaggctgcctctaaagttcgtgctttttcttaactactatcatgtattccttcctaaacccacgtactggggcttcttagcaattattccaagtgcccgattttgtggatgacctcaagacgcagtcttcactcagatgtagacccgatcacactgaggcagattctccaaagcagaagaggcgcaagagcattctcagatggagagatgcccctgagagttaaactccagctctgatcatatttttttccacattttcttcttagttgaaattagaaagaccaccagcttataccttgcaaacaactggccttgcaaaggagccaggcccgacttttcctagtgcagcttccttattattctctaataagaaatagatttgataatagcaactagaattcatttagagtctttgttccaagaacaaattaaagtttccgctttgcctggaactcatattatttgaattgaaagctaaaatgtcctggactaagactgtctcagcagcatctttatgtaaactccttcattttaatttttttaacttttttttgtggttttccagcatccttccttttaagactttgaatatctagtaaacatggccaaaagtattcttcacactgatttggcttgaacttatggatgagaggagaaaacttactcttaagaatttaattagctttcctggcactgaatttctaagagagttatcaaccattcttttttcaagtcaaaacttgcaactcaagacggggagaaggattttcttaacatttcctgattccagaaacattctggaagatttatttttttaggttaatagagcaagataaagtattttgtttttttcaggacaagtagtcataacacatattggtcaatgagaaaattatggctggatttcttatctaacagctgcgtctgtgtgtgagggaagcaggtgcagggagaaaggaagggttagttcctattcttacaaaaagaatgacttttctactatgagaaagttcacagatggtaagtttttcagtaaaacaaataagtaagataagcagagatagtgtagagtcttcaaaaacacaacagtttaaatcaggaggggttgctgtactcagctaggtgtgtctggagcctgtgtactagttctgatttggacacattatttttctttaatcttttctttcctcctcctccttttcctttgctactggttattggtgtttaccatttgccagacattttactaagcactttacatacgttatctcactgaattttcacacggcctatgagagaagtataagcatcacctccaactgacaaacaaggaagtcaaggctcatgaaagttaagtaacttgccccaaatcaggcagagggaaaaggtagagccagtactcaaccctatgtctctctgactccagaccttgacctctcaactaccacataatactgcttcctcactgaaccttttctgttctttgtccccagggacaggatgagaacttcagtcaatgttgtgggtgactcttttggggctgggatagtctatcacctctccaagtctgagctggataccattgactcccagcatcgagtgcatgaagatattgaaatgaccaagactcaatccatttatgatgacatgaagaaccacagggaaagcaactctaatcaatgtgtctatgctgcacacaactctgtcatagtagatgaatgcaaggtacatttcccattcatggatatcgagacttgtatatagtagtgcatgcttgatttctttaaaaaaaaaaaaaccgtaaagccctgcatgtattattgtcacatttattttcctaaagaatcatgtaacccaagcttctgtgagtcccagatcatctaattctgtgtctaacatggcaggaaatcaacaagtctgatggagaaagagtcaatcagttgcttatttcgtccatgtgatgtgaaacaaccattcgggttcccctatctaccccatttaactaatttgaccagttgtcttgaatatttcgcccaagaatttgtggttactaggccgaggcgggcagatcacgaggtcaggagatcaagaccatcctggctaacaaggtgaaaccctgtctctactaaaaatacaaaaaattagccaggtgtggtggcgggcgccctcctgctagtcaggaggctgaggtgggagaatggcgtgaacccgggaggcagagcttgcattgagccgagattgcgccaccgcactccagcctgggcgacagaacaagactccatctcaaaaaaaaaaaaaaaaaagaatttgtggctactgactttcaaatattttattcctcaaattaaacatcaagagaaatccccagcatcatctgatgtacctagcacaagtagtcctccttgctatatatcatatattggtcaaaaatgtgccaacttaactttacacaactatctttttcttatttgtgtgggaaaggtgaattttgacctgagagtaccttgctccaaaagtgggtaaacaatttcaagtaaagaacagctatccttcaggacaattatccagaaatgtctttttaaaaacactacatctcagacaatgcctggctgtgccatctttctgcagcatggatgttctgggctctcctccaagctgttgggtgctaattcttcaagcttgatgggctctgtctagccttcattgtaactaatttgacattgtcaaagtcagagtgtcatgaccagagtaaagcaaacttggagaaaccctggcaggtgagcagaatcaactctgggggttggtttctaaaatgattccacacagcagctgaggacaagctgaacccagccagagatctctggtagctttttgacttctgttgacaaggtcacatttaatcactaatttcttcctatattacttctgggtcattacaaatacatactgtggctcttgctgggcaactaagggtgtcatagaaacaattctctttactggattgtaacataggtccagaattctagtggactagcacaggctttttcttgtcctctctttgtaagatacatacatgggtgaacaaggactctgaaacaaattagggagggaaaccacccatcaagaggcaattgcacaagtttattaattgactcagtgaaaatgattcaaattattagaaattcagatgtacctagaggacatgatgcattctcatggaaagctggtgtttcccacatctgagtgaatgtgctggattattccccatcaaaatgttagtttgaatcaacaagggtcaataatcttgtgaatggctttatgttctagtatatttaagtacttattgtgtgccttgtaagattcagttgagtgcgcctgtctcattcctgtgagatcctatattttgattattcatccagtatttattgaatgcctattatctataaagccataaattaggcactggaggacagcaaaaagaatgtataatgttgtaatgatgataagacttgaactcaaattattgccatatgaggaaaaattatgtaaaacaaaaaaatcacaattttttaaacatttcataattatatttgagaagaatcctagtggttaactgcgtatggcccttttggaatttctcaagaggcctcttaatattttgtaggacactttttgaaaaagaaggtgtgggcgtggagatgtctttagatttcagacttcctggatttgtttttgaaggacatcaagcacctgaggataaatttgcttctttttcttttttttaagacggagtttcactcttgttgcccaggctggagtgcaatggcgtgctctcggctcaccacaacctccgcctcccaggttcaagcaattctcctgcctcagcctctcgagtagctgggattacagtcatgtgccaccatgcccagctaatttttttgtatttttagtagagatggggtttctccatgttggtcaggcttgtcagtaactccttacctcaggtgatccacctgcctcggcctcccaaggtgctgggattacaggcgtgagccactgcacctggccaatttgcttcgttttttaaagcaaactatttcaagccctataaggaaatgtgaattatccatattagtagaaagtaagctcattaggagtaaggctttgtccccagttatactactgtgacccagccctaaaatagtgtctggcatgttgtaggggactcaataaatatttgttgaatggatccttttagcatctttagtccttgctgtgttttaggtaacctttttgctggacagttccatagagatagtggctcagtctctatgtaaatggttagccagccaaccacctgcaaactcattggttaattagcctttaggtgaccagtggtcaagctgagcaggtcttgaagatgatgaaaatagctctattggtttatcaactatttcagttgtttacatttttaatgaaattgttgggttcagcttagtgaaggctatttgatcctcagcctttgctaggtaaagcaagttgattcttctcactctaaatcagttaactgtgttgatgctggtgtgggaaggaggcagccagagccatggagataaatttacaccctttctgaggatatctgggtcacatttacttattcctttgaacttccttatggttaattctgtctcactatttcccactttttaaaaactgagatgggagatgtcagcgcttgctgccaatgccatcctctttttcttttgtattacccaagtggttggagcagagagaagtgggacaggttggggaatggagtcctggctttctttagcccagccaagaaaggaaacgccaaaaaaatctgctgtcccagattcttttgaaacataggccccagtatttacaaacaaaaaaacaaaacaaaaacacttccccccaagtgctgtctggtctttcaaaggcaccacactgtgattgataattttgtaccactattgatgcggttcatcgctgagagccaaataggcacattcaaggttatagtgaacagacaactttctctgggcagacagtctgtccctggcaatctttcttgacagttcactgaaagggaaacaaatttgctgcagctctggtcaaaactttaaccatttcaagcattgttatgtcttgttggtctgtgtattcaaactcttgcctggtaatagtagtttgaagttacacaatagttttcaagtttaatcagaataactgcatgtggagcagtcattgctaattgcatggtctgtttttctgaaaaaaattggggggctaatggggattggataaatggtttttattttcctttgcttgattcgttgaagggcacttggttttctgttcctagcatgttgtatgtggtcatgatgcatgcatttcacttccacttgggtaagaagaaagtcagatttctttcaaacattactgcgtttgtcacgtctccatattctaatgctttcataaatccagtctctccattatgtggaatatcagtcgtgggtttaagtttgcacatgacgttgaggacagacagacagaaggtaagctaggaaaactacttagaagtggaggggaaaacctcctattctgcaaaaaggttcagttcactttgagccagggaagcataatatagatggtctggtaattttatctgattattaaatgtctgcattgaagtaatttagataaacattgtcaccaatctcagacttttaattctccctacttttctttttaatctttaaagctgggatagcttatttggcacagctgaaatgtcatgatttctgatttaaaaattagacacgtatgccatctacctggtgtcattgcaactgaacctttcacatgcatgagtagaactagatacctagttctggatttcttcctctgtggttgtatggagtagcacatgggcactgtattttaaggactgtgttattgtgtgatggatctctgggtagttagacaccccacaacactaaaaacatagtagaagttattccccaaattacaaagcagctttaataccttgatactcccaaggcaaatatggatttttaaaattctcagatcactgttgaaacccaagacaggttcaaattcaatttggaaagaactccatttaaaactaatatttcagtcatgtagtataatcttggatttggtgcttctccacataacccacagggcttttttctggttcgtggtctgtaagctggatgttgatgataattattttcaggtaactctggcagccaatggaaagtcagccgactgcagtgttgaggaagaaccttggaaacgtgagaaataaggatatgagtctcagcaaattcttgaataaactccccagcgtatcctatggtaactgatgatataaacaagctttctttaaaaaggaaaaaaatgcgtatatttctatgtttacttaatctgttagccgaggcttagaggagctcttgtgagtcagtgatgacaggcacggtgctgtgtctttgccaaataatgctttataaccgtctaattttctcacttgtattattatttgaatggatgctgctggaggaatcagttggaattgaagacacgttcttgccagcttcccttttctcccaagatgcagaaatgtggatgctcttttcccaggggacatgagtaaagcagtgtggtacactccagggacttgggaaaatgagcaaacacacagcgtgttattccttaaagtgttctccatgtctcgccttgttatgcacaagagattctattaaaagcctctagaagtaactccccttaaaatgtctagtaaagcttgcacatggattgattaaaagcaaatacctgtcttagggaattctgacaatttatcttccatatgctctttaagtaaaatgtttcaaagacagttttaaagggagccatgctcttaaaggcagttgattaaagaacctgttacatctctgccttaccctgtgtaatctgtgagaacaatggttgaaatttcaaagtatgtttcattattctttctaaatttgataattgattaggaagtattttatatataaccactgtagatattgacaaaagtaagagagcacagtcaacataaagtttaaccagagttaaatattcaaatttatttatgttcggtttgccttcacctggtgtagtaaaatcaaatgagattatttggtatgtgttttgctttgtttaacccaaaagattattttttggttcctaaagaaaaagatatttttaatctgtcaattatttcagtcatcatctcatcgtcctagaaagcctggtcattttactgtcctcacacatggaagacacttgtgttggctgtgcctcttttaatgtcatctcttgatgaaacaaaaatactggtatttatccaatatgttgaaagcgttttgttatcttctatcaaagcacataaaaccagttataggacacagttggaagcagagccagtcttcctcctcagtcttctcagtagaaaggaacagaaaacaaacatctgtgcaaaaccctataaaagtgatattcctatggcagagtccaggcagccttgaacaatgacatggcaacaaaggatggctctgtacaacttcacagatggaatcttgtttaaggctgtgaagttttaaggaataaataatataattggtgtagcacagtgccttgcatgcagtaggcagccaacaaatccttaatgattggtaatgcaagctaaaatttttaatgtctctactatccttttttattgaataacgcacagtattttcctaaggttgctgggtttgggagtaagcttgggacttgaatcattgagaaataaagcacatttgactctaagaagtatgtagaaccttgtttataggtgagaataggctgtattacatgaaaccagcggagggatgctgagacagtcatggtttatagaatccaaattctctgagatgagggtgcttatggacctcaaatagcctttcttatctgctccttgtgacttctctcttttaaatcagatacctttgaaacatacaagagacatgagattccagttgtttttgtctcctaaaccctagtgatttttggataaggatcactactgaacagtattaggcaacttttcatttttgcttttcaaatgacattggtctttatttccagtagatgggcagtaaacagggtcagggtggtcaagggatatgattaagtgtagtagtagaaaatgcattctttttttttttttttttttagacagagtcttgctctgttgctcaggctggagtacagtggcacgatctcagctcactgcactgcaatgtccacctctctagttcaagcgattctcctgtctcagcctcccgagtagctgggactacaggcacatgccaccatgcctggctaattttttgtatttttagtacagatgggtttcattatgttagccaggatggtctcgatctcctgacctcatgatccacccgccatggcctcccaaagtgctgggattacaggcgtgagccaccgtgcccggccagaaaatacattctttacagcaaatgttataggttaaggagacagttcctgggtttagctgtgaaactgtttaggattttctttaagtggtgttcccaagagc

SEQ ID NO: 14265 - DNA, 7232 bp, Human; identical to SEQ ID NO: 12580

SEQ ID NO: 14266 - DNA, 26416 bp, Human
tgaattctgatagacagtagttattaacatattcttttttgttttttgagacagtctcgctctgtcacccaggccggagtgcagtggtgcgatctgagctcactgtatcctccacctcccaggttcaagtgattctcctgcccaagcctcccgagtagctgggattacaggcacccaccaccgtgcctggctaatttttgtgtttttagtagagatggggttttgccatgttggccaggctggtctcaaactcctgacctcaagtgatccacccacctcggcctcccaaagtgcaactgatactacaggtgtgagtcaccgtgccaagcctgttattaacatattcttgaaaatttaaatttcttttgtttatagatgtgaattgtctcctgaagttatattctactaattttttattaatggaataatttcataattttcaaaattctttttatctttttttataattttcatacaatgatgagagatttctgaagcttttattattattattattatttaaggtgatcattgtataacaattattaaattaggaaggtttccatttgaacaaaatattaatgcttttaagtcattattgctatcatgagttttacgagtgttctacttctaaaataaactatagaagataaaaatttcagcatagaaggcttgcaaaataaacaaaatgtgtaccgtaggacattactttagtatagagggttgccagcaagatttatttattcaacaaattttgaacaatgtgcgatgcatagtagtaggtaattctccacgttaattattgaaagatagtttttatatttgtatattatttattatataggttttttttgctataacgtaattttattgtatggattttcacaaattacattcataagtttttgagccaaatgcctggaagtaataaagtttagtttgaaaatataatggcagatggctgaatattagaacttaccacagaataaaataaaacatttaaatattcatgttctattttcaaaatgtatttcctgaatgtaaaagtaaagttatggctttagaatgctacatgacttggagtatattgtgaatgtacggtataacatgaatatacagtctcaactgagataatattttagtttgtaattagaaatataatcagttttctgcttctcctagtatatgaattcatttttgtccttctctgctgccttaaataattaatctttttcaaaaaaccatggcagtacgtaggaacaaaatgtggggtcatctgaaatctttatcaactaaaagccagggatagagttttgcagtgtctggagtatcacatttatgtgagttggggctcgaggagtggaagacaaattcttggtcttgtgacttcacagacatgctaataatgccaagggaatttaaaacactggctaaagtgttttatgttttagtaaagaaattgagtggctccaataacgttctgcttgtagaagttctatttatgaacataatttagaacagaaattatttattcacactagttcagaatgatgtaaagagctacaattttttttttgcattatcttttggttattcctcagtgttcttttgatttagtgcatccacatttctctcttttaatttatgtaggaacagatctgtgaaaaaaatcattgaagtactagaatatcacgacttcagcatttatattagcatttttattttcatgcatttgtattttaatgtaggcatctataaaatatgaaattaaaaactacagatcttcgaactatgtatcaacattctctttgtaatagaaaagcagttatttctataacaactctcactcaacttttgattccaacataaaatatgtgcaattttataaggagaaacattttaagtcttttaaagtgttttttaatgtatcattgtatagaagtaaatagggcaataaatggatttattaatttaacctctattgataatgcttaactttttgttcacagggtttcacaaactggactaaacgagattttaaccagtttattaaagctaatgagaaatatggaagagatgacattgataacatagctcgagaggtagagggcaaatcccctgaggaggtcatggagtattcaggtttgtatataatttgaaacatggtgttgtattttaacgttattcatttatttagcatcaatttaattgtacctttgttcagagatgttttaaacttttatgaataagacatagatgagagtataaactataattgtatttctatgaaaaggttataagaaaggttataagatttatcctaacaaactgactgctattgtctctatcacctagctaaaagaggcaaataaagctctgataaaacaagggtggctcttggataagcattgacaaaattagtttcccaccttcccacctctggaatttggtcttctggttcagttctgagattcacattcagtggattgaattcgtgcctttctttctaggtcgtccttaaagtagagagttcctgtcaggcccatttagatgctcaaacaccctcagagttccaccctattccagagagttcctgtgggtcccattaacttggggctagcgggcgtagagctgaaaagattgctttaatcaatctgttaactggtcctcaaatcctctccctctcttactcacctgtgttgttgagctcgaccagaatcagtttagctgctgaagcatatggattttttttacacttactggtttattataaagggtattgtaaaggatacagatgaagcgtgtagggcaaagtatgggccaagagggcgcagcgctttggtgccctccctgggcgaaacctcttcgtgtttagctatccagaaatcttattaaaaataggtaaatatgtctagcaagttttctatatgtagtacatgggacttttctaacttccaaataggttcagctcttaaacttatcatttgaaacaagatgtttagaatctagagcattttttgtcattgaaacaatggcaaagtaggtttaagtttacaaagtaggtttaagtttctatgatagcccctgccccaaatctatttaaccctaccactgaaattctgtttttgcaatagtaggaaagaaacattacagtaccaataaatatactaaagattaataatagctaggaacagcttttaatttatctagcatgctagtgcttgaagaaatccagatttaattagagagatttttttttcttctggaaatctaaaagagtcttctgggggacttcagaggtcagttgtattgagtttttattacatataatataacattaagtatatgaacttccttttccttcataccagcatgatattactattactctgaacatttagcacataaatttagggcatttggaggcttaggggaaaaaatagattgaagagagaaattttagcatcaagagttgaatgaaaagaatgtaaaagggtatgtgcagagagatttttaagaagaatttttttcagaagataggcagggagataacatcggtgtatgtgaagttgcaagaaaaaaatgtgatttaaaaagatgatcctgtcagactttctttcaaatttgacaccaagccaggtggcatgactagctcaggactatttaattgctgcctgccaggttgggggccatgtcacagggtgaggagattgcaatgagtttgttgtagttggttacagtaagagaagaaatgtgtacaattgaccacccatgaatatacagtatcctgtacatagcaagtgtttaaatatttgttgaatgaatatgtgagtgaatgagtaaatgaacacaggtgcttataaaaatcagagtgctcacatacctttcttgataggctctaaaaatgaaaagcttgaggatgtggagtatgtcattaaaaggcctttcattgaagtcatgtgacatattaatacagccagattatttggctcatctataaaatttggttgagtgacttggaatgtttttcagtgtgtatgcaattaaaatcccaatgaggtttttttttttttttttatgagaaaagggtattccaagtaagtttaaaaacacactactggtcattggaaataccgtaagatgattagtgagtgattccaaaagcaaatgacaatttcaagagaaatggctgctccatagaaaaaaatttgaacaacctgttcataatagcttgggttttttgtttatttgtttgtttttgagatggagtctcacttaatcgcccaggctggagtgcagtggcgcgatctcggctcactgcaacctccactttccgggttcaagcaattctcccgcctcagcttcccgagtagctgcgattacaggcacgcaccaccatgtgcagctaatttttgtatttttagtagagatgaggtttcaccatgttggccaggctggtctcaaactcccaacctcaggcaatctgcccacctcagcctcccaaagtgctgggattacagtgtgagccactgtgcctggcccataattgttttcgcatgctaggaagctatattcactgtttatatattactctctcctgtgtcactttatgtgtttggtcccttttctatcatgtttgagtaaaaagcctagcttaaatcagtatctgcatcatcttttgaaatcctagtcatttgggatggatcgtaagactccgtactatttcatgaaggaaaattgctaacctaaaaccttgttttgaggtcttatttttaagtgaaaagttagtagtatttaataatttaacatattatatatataagattaatctgaatcttaattttaagaagtacaagctcattgtattctttcctattaattccttattctacaattccttggatttatttgcttaaatgataggattttaaagaaataactctgtttttcagctgtattttgggaacgttgcaatgaattacaggacattgagaaaattatggctcaaattgaacgtggagaagcaagaattcaacgaaggatcagtatcaagaaagccctggatgccaaagtactatgttttatgtcaaattattattagatcgttttaattgaaatagtggtcagctttgacttcttactgcacattcaattaaaagcactattttgtttaaatacacagattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggtatgtattcctttcttaccgatttcctccaactttttattttgaaaaatttcagatgccatatatccttcacctagattctccaattaacattttgacacattggcgctctctctttctctctctctgtgtgtatgtgtatacatacgtagcacctatatatacgtgcagaatctatattttgtattaaaaaatacggggacatctatattctatattctgaaatgcgtatctatattttataagtatacttaactatatttatgaaccatttgaaaattacagacaatgtgagtgttcatctctaaatacttaagcatgtatctcctaagaataatgacattttcttacataaccacaatcccacctgaaaacattgattcagtaatgtcatttagtatacagtctatgtataagcttttccagttgcccccaaaatgccccctttatagctgttttttttaaaattgatgatcctgcaagtttcacacattacatttcgttgttgggtctctttaatctcttttaatccacaaccttttggttttcgtgatcatgactttttaaaggtgtccaggctagttgtcttgtagaatgtcccacattgtggatttacctcattactcattgtaagattcaggttcaacgtatttggcaagagtgctgtggaagtgatgttatgtattttttattgcatcccatcagaaggcacattatgtcatgttgtcacactgttggtgatgctaagtttggtcacttgttaatgtgatgatcttcagagctctccgctttagagttatgttttcccctttgtaattaagcaggttatgcttgagactatgcgaatgacttaaagatggacttttaatgaaaaggagttgttgcctaagttgagttttttattaggaaacagaatatttaagttgaagagatattttattttagcttatgtgatttcctccattactttctaatgtgaattgtgttcctattctagtcctacttagcagtggtgttcatgatgattttgaaatacatgcaacacatttttaatgttggcattgttaatcttttgtcagccaaggtaattaagacaaaatagatttatgcagcctaaaaattaaaagcaaccagaaactaacaatgcaaacaatgtttttgtgactagtcataaaataggatacatttttcttagctgctacctatcataaatatctttttgtccaaaagttgactgagtgtgaaacaatgcttaatattttgcttgactcactttatattttcagttcaagttgaataaaaggaaaggaaaaatctgggttactgtagtgaagacattaattttggcagatgctttagaagatcacatatttgttaaaactttaacacaaatttagagtgtgtggagtatgtccatcaaatttatgaatggcgtatgcttggagagctagcaaatattttagaccaagccatgatccagaaggagctagagtagttggaatgatggatcagttgaatccagcaacacaacatttatttattttatttatttttgtatgtatgtaggtatttatttattttgagatggagtttcactctttgtcacccaggctggagtgcagtggtgcagtcttggctcactgcaacctccacctcccgggttcaagcaattctcatgtctcagcctcccgagtagctggtattacaggcacctgcaccacgcccggctaacttttgtatttttagtagagatggggtttcaccatgttggccaggctggtctcgaactcctgatctcatgtgatccacctgcctcagcctcccaaagtgctgggattataggcgtgaaccaccgcgcccagcaaacatgacatttaatagggataaatgtaaagtgctatacttgtacaaaagaatatgaaaagatatatatgttagcaaggtacagtaggaagaattaagaaaagaataaaaaagataaagaggtaatctgtagcttgaaggactgaggttggatatagggaagagttgttttatagagttctttggatcattgaaatagattattgaagaacaatgtagaatagcttttcattagcctttgaaagtggaattctattttgactctctgaagacattggcagtaagttacttggccttttaaggtcccctttagcacagtgaatctatgactatgtttagcagagaactccttttaaaagccatgcaggataaatcttttagccatttggggttttatacatgtaatgatttaatttagagcaccactaacagcttgtagaagacaaatgcctacctgcatttgtcagttaatcatgttttagaatatacatacccttttctgtgatagaacagttattgaattttgagtttttatttcagtgatattttgctaattttttaaaaggttgagagcttaatgctgttttcagtttctggaatcattaaaccagtaggacgaaacacattcaaagtgcaaggaaaatcttaacactatttataatatgaacacgactgtggaactacataaccttattttattttctaagaaaaaaatccagtataatattatcaaccactagatgtctctgaactcccttgtaaaaaatctgtttttcttccatcttctttttacaaaacatttacctctgtactctttctttaccgagaaatgtaaatctcaattatgttttccaaaaagcacatattaactatttaaatgatcataaaatgaaatctttttctgttaaaaatgaagacatttctgtcttcaattaccttctagaaagtggaatttattatttctgaacaatcttcagaaacatgcagtagtttattttatatttaaatattttaattgaaaagttttatttattactttttctatcgtattaaatttttatttcccttctagttaatggataatttttgcttataataatttttgcttataattctggatttagagtataaataatgtattttaaaacacacatacatttggaactttttagaatatttcatgataatttcaacaattaggaaattatagaaatggattgatggttcttgatgatcttctttccccctttcatttttagtaactcttctgtatagtgaatcacattcacaatctaggaagagaaactgccccatttgaaagaggcacttgtgatttctgaaatacaaagaagttgtttcattgaaaaatcccatcttagaactacagagaatgtaatttgattcattatgtgagtgtgtcactgtgttcaaatgaaaatcttactaatgattgaacttagcttactaaagatacctttaaaaacgatctggcttaaagatgactcttttctttctcagagacatgaatagtgtgaaatgcatcttataaaaagtagaaaccttaatagttatatttgattcagagatctcaaagtactgaattcatggctcctgacttaactaacagtcataaaggcacgaacttccgcttctaaatatgcctcactttgaaagccttcagctaaaggttgcagatttctttgaggctctttttcattaaaaaatgctagctatacaaaagagaaaatgagtttcagttcaatttctctgtgctaaaaggattgtgatttctttctctgagaatttgtgtggtctttaagtaagtaatcagtctctattgaactacataaacaagtaggaaggatatgatcaacttagctttttaagctcagagcatatgaattgccctaccattttctttctaagaaaaccatcttagaatgaggtcatagtcttaggatagtcaaaaacttatcagagttaaaaggacccttatcaaataaccataagaggaagtaatactttgtatttatgtagtaccttttatataatgcttgccaatccctttaccaacattagcttaattttcttgccactccttttaggaaatgaatgtcaggagagtatctctgttcattgagtgacgactaaatgtgactgggagattctggaagaatctaagaagtccaaaagatctagcacattagtcagtttactgcaaaggacatgtggaaagagtacccaaaattcaatcagtaattccttgtaccttcttaggtccttctaagtacttaaagtagaaaaagcagaatttaactctctgaaataaggaacatttcttgatagaaccatttattgcattatttgcagggctgctttgactcttaattttagttaaaaaaaaaattcttaccttttaacctctggggagatttttccttttccagccagctcaagagcctgtgtgtgcattgcttgtggccttgtatatattagagttgaatccgagtattagtaattagtcattacaattaccatatcttttgtagtagtttcaatgcatttttctgatagcatctcagaaagagaatcacatactgtggtatacaatgtaatgaaaattgtgttattactgcttgttttcaaatcacagctttattataaatgaaagtgttttctatttaaaaggtaagaaaatgacattctccattagaattgtaggaaaaaaatactttttagaaaatattgctttagctctttattaacttccctgtttttggcttatcaggaggtattaaatgttaattagtattggttcagcacaggatattttataaattatcagtccagtcagaaatggattttctttacagatactttagaaaaatgacagtcaaattaaaaaattgccaacttgttctatagtcacagtaacacttctatttgctgcttatggagtgtagtctaggaaatttcataaggaaagacagctactcatgatttttaatttccatgttagtacttaattgtgtgataacagctaattttttttttcttggctcactgcaacctccgcctcccaggttcaagtgattctcgtgcctcaacctcccgagtagcagggattacagttgcgcatcactacgaccggctaatttttaatatttttggtagagatgggatttcaccatattggccaggctggtcttgaactcctgacctcaagtgatcctcccacctcgcggtctcccaaagtgctgggataacaggcatgagacaccgtgcccggcctaatattgatattttagagcattacattcttagtagaatatgaaaaatatgaattaatacatcattggtaaaattaataaactgtaaaatgtactgatgggttcttcttgactatagaattaaaatatttaaaaccacgtatttatgcacttaggagtttattacctcctcatgcacttaaaagactaaaatgttcttttcttattaaattttttttttgaaacagggtctttttcttgcccagctggagtgcagtggcatgatcatgggtcactgaagcctcaaattcctggactcaagcgaacctcccacctcagcctcctgagtagctaggactacaggtgcgtgccactgcacgcagctggcttttttagtttttgtgaagacggggtctcactgtgttgcccaggctggtcttgaacacctgggctcaagcaatcctcctgcctcggcctcccaaagtatcaggatcacaggcatgagccactgtgcccggccacaattattaatagttgtatttaaagagaccagcatagcacgtgacccagagtaggcgttcagtgaataaatgggcatagaactgttgtatttaagtttgcttctatcccatagactcctacagttggaccagatttggatagaatgcgagcaaattatgccagtgggttggagttcattttacttttcctttaatctacctttttctaaggttagactttatttggctatcatccctgcagcttttatttattcataagcttgaatagccagttataaatgtcatatgttttattatgcagcaatagtgttcgatttggtaccttgaactgttgtaacaatctgacatgaaatacaattaatgcactaacaggagttcatttaaggtatttattcttatgcgttatcttgtgaggaagtgataacaacattttctttttttctttttttgagacggagtcttgctctgttgccaggctggagtgcagtggcataatctcggttcactgcaacctctgcctcctgggatcaagtgattctcctgcctcagcctccccagtaggtgggactacaggcatgtgtcaccacgcccagctgatttttgtattattagtagagatgaggtttcaccatgttggcccggatgatctcgatttcttgacctcatgatctgcccgcctcagcctcctaaagtgctgggattacaggtgtgagccactgtgcccagtgatacagtattttctaaatagcaatgcttaagcagcagcagttacgtaaaagcatcataacatttaatacttgtttgtgaaatgtaggatatgtttatttgaatattaactctcatataactgcctgtgtgcattctagtatagactgccattgcttttcgttagtatgatagagattcaaaagtgactaggaacctgggaaatatactgcagaatgtataggtgaagacatcgattaaaaaagagcaaaggtgaagcaatgtccattttgttttactaagagctgtagaagaaaattctgacctcatagaactttacctacaaattcagaggcacaaatgcggagtggagttttttgtgtgcccttgctcattcagctgcttttgactttcaaccataacaggcgcagacctgtcattcagacttaggtaggcttagtgtctaggattttagtacataggaaatgtaatgtggagtctctttaatctctttcaataagtcacttcaagtctactgatgctttctctgccttttgaattgaagctttgaagctgagtattggagcaaaggatatttgaacttagtgcccaggatgattgatattcaccacacactaaggggcagtgctgctcactgcaaacattacatcatttattaaaggtagagatacatatcctagtattcaaaaattgaaacttgagtgactttgcattgaatagaatcataaaccattaaaaaagtatggagaaccaaggcaacacaattttgtttaaagtgaagctaagtctgtagcttaaaacaggacttggaaactgtggccccccacctgtttttgtgtggcctgaaagcaaagaatgacttttatattttttagtggctaaaaacatcaaaagaagaaggatattttgcaacatgtgaaaatgatacaaaattcacattctagggttcataagtaacattttcttggaaaatggacacacatttgtttatgtattgtctttggctgttttcgtgctacaatggcagagctaaatagttgtgacagagattgtgtggtctgcaaaagtcaaaaatatttgctatcaggctctttattgaaacaatataccaacacctggcttaaaagtatgtgtaagaaaggtggaaagaattataaccaagggttgatataagtgttatgcaattctttaagaaaagggttaagtgaaggatgggtgtataaagggagaggatatttagccttaaagaggggtatttggggacctaggggtgactgtgattgaggcatgggaacttccttgaaacatgtgaaagattgtcatatggaataggaaatcagcttgttctctaatgtctacaaaagttagacctacaaccaatttttggaaaccatgaggtagcaaattgtagctttgcatagaggaacatttttaacttgtctgaagttggaatagccagccttgtgaggtagtgggtactccatcattggaagaattcagacaggctgtacaactaattagcaaggacctagtagtagggattcaagcatcaacctgaatgacttaaaagttcctttctcatcttgcgagtttatgattttatgaactctgtgtcaagaaaagatttctgagtacaaagtacacttttgattacatcactcctcctgctcaaaaattgtttataagatccttttgtcaatggaattaagtaaaatttttaagttctttgttgttagttcccagtttctttacacagtcacacactggacatatttcaggttcagttccagaacactacaataaagcaaatatcacaataaagcaagtcacatgaatttgttggtttctcagtgcatataaaagttttgtctataaggcgagcaatagcattatgtctgaaaaagtacttactttaattaaaaaatactttattgcttaaaaaggttaacagtcatctgagcctttagcaagttgtaatctttttgctggtggatggtcttgcctcagtgtgaattgctgctgactgatcagggtggttgttgctgaaggttggggtggctgtggcaatttcttcagagaagacaacaatgaagtgtgccacattgattgactcctcctttcacaaaagatttatctttggcatgtgatgctgtttgatagcatgttacagtagagcttctttcaaaattggagtcagtcccctcaaatcttgccaaagctttattaactaattttatgtataattctgaatcctttgttgtcatctcaacaatgttcacagcatcttcaccaggagtagatgccttcccaagtaaccactttctttgttcatccataagaagcaactcctcatccactcaagttttatcatgaaattgcagcatttcagtcacatcttcaggctccacttctaattctagttctcttgctatttccaccacatctgcagtgacttcctccactaaagtcttgaatccctcaaagtcatccatgaggactggaatcaccttcttctaaactcttgttaatattggcattttgacttccttccataaatcacgaatgttcttaatggcatctagaacgatgaatcctttccagaaggttttcaattgactttgcccagatccatcagagtaatcactatttatggcagctatagtcttatgaaatgtatttcttaaataatatgacttgaaagtcagaattactctttgatccatgggctgtaaatgaatgttgtgttaacaggcatgaaaaacctcaatatccttatacattatctccatcagaactcttgggtggccaggtgcattgtcaaagagcaataatattttaaaaggaatctttttttgaggagtagggtctcaacatgggcttaaagtataaatacttcatactataaatagtgctgtcaccccagcctttgttgttccagttctagagctaaggtagagtggatttagcataatttttaagagccctaggattttcagaataataaatgagcgttggtttcaatttaaagtcaccagctgctttagcccctaatgaataaacctgtcatttgaagctttgaagctgggcatccgcttttcctctctagttatgaaagtcctagatggcatcttcttctaatattagggtattttgtctccattgaaaattcgttggttagtgtggccaccctcatcaattatcttagctagatttttctggataacttgctgcagcttctccatcagcacttgctgtttcaccttgcacttttatgttatggaaacagcatctttctataaacttcatgaaccaacctccaccaactttaaacttttcttctgcaccttccttacctctctcagccttcatagaattgaagagttaggatcttgctctggatgaggctttggcttaagggaatgttgtggctggtttgatctgtccagaccactaaaactttctccatatcagcaataaggctgtttggctttcttatcacttgtgtgttcagtggagtagcactttttttttttaaattatactttaagttctgggatacatgtgcagaatgtgcaggtttgttacataggtatacacgtgccatggtggtttgctgcacccatcaatccagcatctacattaggtatttctcctaatgctatccctcccctagtcccccacccccccaacaggccccagtgtgtgatgttcccttccttgtgtccatgtgttctcattgttcaactcccacttatgagtgagaacatgcagtgtttggttttctgttcctgtgttagtttgctgagaatgatggtttccagcttcatctatgtccctgcaaaggccatgaactcatcctttttatgactgcgtagtattccatgggggtatatgtgccacattttctttatccagtctatcattgatgggcatttgggttggttccaagtctttgctattgtgaaaagtgctgcaataaacatacatgtgcatgtgtctttagagtagaatgatttataatcctttgggtacatactcagtaatgggattgctgggttcaatggtatttctggttctagatctttgaggaattgccacactgtcttccacaatggttgaactaatttacactcccaccaacagtgtaaaagcgttcctatttctccacatcctctccagcatctgttgtttcctgactttttaatgatcgccaccctaactggtgtgagatggtgtttcattgtggttttgatttgcatttctgtaatgaccagtgatgatgagctctttttcattatgtttgttagccgcataaatgtcttcttttgaaaagtgtctgttcatggggggagggatagcattaggagatatacctaatgtaaatgacgagttaatgggtgcagcacaccaacatggcacatgtatacatatgtaacaaatctgcatgttgtgcacatgtaccctagaacttaaagtataataataataataaaaagtgtctgttcatatccttcgcccactttttaatggggttgtttgggtttttttcttgtaaatttgtttaagttgtagattctggatattagccctttgtcagatggatagattgcaaagattttctcccattctgtaggttgcctgtttactctgatgatagtttcttttgctgtgtagaagctctttagtttaattagatctcatttgtcaattttggcttttgttgccattgcttttggtgttttactcacgaagtctttgcccaagcctgtgtcctgaatggtattgcctaggttttcttgtaaggtttttatggttttaggtcttacgtgtaagtctttaatccatcttgaattaatttttgtataaggtgtaaggaaggggtccagtttcagttttctgcatatggctagccagttttcccagcaccatttattaaatagggaatcctttccccattgcttgtttttgtcaggtttgtcaaagatcagatggttgtagatgtgtggtgttatttctgaggcttctgttctgttccattggtctatatatctgttttggtaccaatatcatgctgttttggttactgtagccttgtagtatagtttgaagtcaggtagcgtgatgcctccagctttgttctttttgtttaggattgtcttggctatacgggctcttttttggttccatatgaaatttaaagtagttttttctaattctgtgaagaaagtcaatggtagcttgatggggatagcatttaatctataaattactttgggcagtatggccattttcacgatatagattcttcctatccatgagcatggaatgtttttctatttgtttgtgtcctctcttattttcttgaggagtggtttgtagttcttcttgaagaggtccttcacatcccttgtaagttgcattcctaggtgttttattctcctggtagcaattgtgagttggagttcactcatgatttggctctctgtctattattggtttataggaatgcttgtgatttttgcacatagattttgtatcctgagactttgctgaagttgcttatcagcttaaggagattttgggctgagacgatggagttttataaatgtacaatcatgtcatctgcaaacagacaatttgacttcctttcttcctatttgaataccgtttatttctttctcttgcctgattgccctggccagaacttccaatactgtgttgaataggagtggggagagagggcatccttgtctctctcttgtgctggttttcatagggaatgcttccagtggagtagcagttttaacttcctccaagagtgtttcctttgcattcacaacttggctagttgtttagctcaagaggcctagcttttggcctgtctcaacttcctcactaagcttaatcatttctagcttttgatttaaagtaagtcgtttccttttatttgaacacctaggggccattttagagttataattagcccaatttctatatcattttgtctcagggaatagaagcgtgagggagggagagagttgggggaatggctggttggtagagtggtcagaatacacacaacatttataaataaagttagccatctaatatggttgtgattcgtggtacctcacaatgattatgatagtaacataaaagctcactgaccacaggtcaccgtaacagatataataataatgatctttgaaatattgtgagaattaccaacatgtgacacagagacatgaagtaaacatatcctcttggaaaaatggcaccaatagacttgttcaatgtaggattgctacagacgtgcaatttgtaaaagcacaatatctatgaagctcagtaaagtgaagtgcagtaaaacgagatacgcctgtactttgatcctaacttagctgtattcatcactcatgctgtgcaacatttcccaagttgatttctaccaaacgttgttccagggtgtgcaaatcgatgatatgcagaacaagagttctgtgttcagatagagttgggacgtgctgattatactgaatcctgccattcacatttccactctgcattagaatgctaaaagctctgagaagtcctatcataaagaaatttgtgtaacattttaaaaaaccaacatttcccatacacatttgaacataggaattttttgccacagctattaacactacagagcagttttccgtttgttattttcctattctcttctgttgtctttattgtttttgcatctcctcttttcctcttgtgtgctgtttttctccaacttcatttttaaatccagtgtggggaaatggtgagagaaagagataactagactatacaattgtggaaacagtttgaggtcctatgaacaattccctgtaatcccccacaaaataggaagataaagatgtacaagaatctaggagaatatatgaaaggagaaattatagaaaaagaatgtgcttttgacatcatgaaatttctcatagtcatttcatagtcacttattcaataaatgagtcattttttattggtaatctagcctttctccttttaacttctagttttagctagtgttctgtttgtgataacttatgttgcgttaggcagtcatgaagcatgagaataaaaaaatggaggctgggcgtggtggctcacgcctgtaatcccagcactttgggaggccaaggtgggtggatcacaagatcaggagatcgagaccatcctggctaacatggtgaaaccctgtctctactaaaaatacaaaaaattagccgggtgtggtggcgggcgcctgtagtcccagctactcgggaggctgaggcaggagaatggtgtgaacccgggagatggagcttgcagtgagccgagatcgtgccactgcactccagcctgggtgacagagtgagactccgtctcaaaaaaaaaaaaaaaaaaaaatggagctggtatctatagagaacatgacatgacctgtgtgataggaaggtaacacccatacttgtccattccttgatgtctttctgtagcgtcttagattatttttctgtctggagtagttattgacaggttaaaaggaatgaaggtatgaactaattacacagtccatttatactcattttgaggtattctacttccctgcttaggaggctgtctcaaaagtattagtttttttttctgaatcacccacatgaaccatgaatatatatctaaagatatctccagtcacaagcaactattacttattgagaataataatagccagaggatatagcttaatgattcacgagtcagctttacataaagactctatttagtctccctagaaaccaacgatcaaatctcatcagggtcaacttagccttttctataataggtaaattgaataacatgctgtttaatttgtatgtgtgttattgaatgaagctatggagaatatttggtctgcatactaaagatatcactattgttttggtaagtaaggaaaatttcagagttattgtttctaaattatttaaccctgggtgattgaagatacacaagaaacttgaacatgccagtgttacattagagtatttttaataggtaaacaataattcattaatgagcaatttttttctggctagactctggttttctgcctccttttgggtttcatttagagcctaaaattcatttgcctggatagttgatcttattttgtatcttacatttcctatgttgtatgccattttttttggattttatttggaaagataaaactgaattttaaacaattttccattcttaaaaagttacagattgcccaacacttaaatgttcattgcagaaaatttggagaattcaggctagtatcaagagaaaaataaaagttatcagtagtcctactcttagggatagccgatgttaaccactagtaacattattgttaatattcttttagctatttctgtgtatatatataataataataatacgtgtctgtgtattctgtttccagattaccaaaattttagttagttcccagtttaacactgctctaaacattgttttgtaaatatttgtatacatcttatttccttacaatacatttctggaaatggaattgctaggtcaaagggtgtgaaaattttaagatccgtcgttgaaatgtcaaatttgctttcaagaaaggtagtgtattagtcagcttgggctgccataacagaatgccacagactgagtggcttaagcaacaggaatttattttctcaccattatggagactgaaagttcaagatcaaggtgccagcagggctggtttctggtgtggcttctcctcctggcttgcagatggccaccttctgcacgtggcattctcatatggcccattgttggagtgcgtgcagagaaagggagagctttgatgtctcttccacttcttacaaggacaccagtcctattggattagggctccatccataggacctcatttaaccttaattacctccttaaagtccccatcttcaaatacagtcacaagtccccatcttcaaatacagtcacattgaaggttagggcttcagatgaattttgcggagacatacctcagtccatagcagatagtagcattgacatttcatcatcagtgaatgaaagttcccgtttcagcatcttattgtcaatgtcagatatgtataccatatatgtgcacatgcacacaagcatgtacatattgctaatttgatgaagatggcattgttttactttgcatttctttggtcattagttgcagtgaaacttgattataatgtttggacttttttttttttggtgagttttctattcctgtactttgaccatttgtgtgtgtgtgtgttggggttgttcttaattgccagtaaacctacattttcacttgagtgtttagctattctggcaggcatttttgcttatacagaaaaggaatcatattttaaaatattatttatcctttgatattaaaccattatttacctttaaaatatagcaaagtatacagggttaataatatatgatattccgtattaatgaatcatgtttaatgttcaccatacattcgtaaaaagtatttatagtttgcatgcattgatttgctgacagtgaaatataggtagtggcaaggttaatgtagaaatcttttcagatattatttgctctgaattaacaaatacagcagtgtttcctgtgatgtggtccccagaactctgatcccacaagatgtccggtgagaagaaagtctgttggttaaatatttttgacaactgctgcatcctgtacgccccacctagtggttcacagtgcacatagggaactgaaaggctctgagaagccatgtaataagtaaatctgtttaacttttgtaaactgggtacttccaaaacttattttgaccatagaacatccccttatttttttttgtttatgtgatttatgttaactttttattttgaaataagaaaattcacaaaaagttgtaaagaaaatgtacagggaggtctcatgcacccttcacccagttttccccaatagtaacattttgcaaaactatagtaaaatatcacaaccaggaaattgacattcgtgtaatctatagagcttgttcagatttcatcagttatacatgcgctcgtgtgtgtgtgtgtgtgtgtgtgtgcagttcaatgcagttttgtcatgtgtagagttgtgtaacctccaccaccataagactccattgtgctatctctttacagtcacacctaccctctctcctctccctagctcccggcaaccattgatctgttctctctttctataattttgtcatttaaggatgttatataaatggaataatatggtatgtaacctttcgaaattagctttttttttttacttagcataattcccttgaggttcattcagattgttaactgtattaatagttctttcctttttattgctgagtaatattatatgatatggatgtatcatggtttgtttaaccagtcatccataaatgacatttacccccactcctaattctggtggaatctattaataccctgtgtgaatattgtcctgaaaaatagcagttttggaaattctataccacagaaatcatacagttaaatagttgtcagcgttttaaagataatgattgggttgcagaaattaaaaatctttattacttcatttaggaattccagagacgctgtaacactctgatttcattgattgagaaagaaaatatggaaattgaggaaagagagagagcagaaaagaagaaacgggcaactaaaactccaatggtaaaattttcagcattttcctaacttttaggtagatcccatttttttacataattaaaatgcctatattatgtttaatgccatagtgatagctattaataaaagctggttttatgaaatgctaatttgttttggacagaagaagaattgcttcacaaccatgtttcttatttgtttgtagaacatatggttaggaactccctagtaactaggctcagtattttaaaaaattcctcatgaatctaaacagaagtataatgcaagtgaaatcttttgaattgagactagagctatcatgggggtagcagaggggtaggggtgggatgggatggggctgaagttgaaactaggagttctgatttgatcaagtaagttttctgatgtttgtggaattatgagtacaaatgggaactctgagcagacaacaaagctttgcttggtaataagtgaactgttgaattgataggataacttgattttaatccagtcaggttgctttgtacagctgtaatttaaaatattctttaatagatcgtattatttgagtgtggttaagtaaactgccatatttcatcgaatctaagatgccttccattgtaagacacagcattattttatgtaccactgagggaaaatgctgccaggtgtaatttgtcatcagttgtaagttgcatcctgatttcagagatgctaaaatgtgaaagaaatgtgtatcatagaagatatgaaatatggtatgttaaaacctatcataagttttttaaaaaatatatactcataaacaaaattttgcccagaaaacattaagtagttctttaagataagagtacatttataataccatgtgtaagtagatacttgatgactatttttgatgggtattttatgtcttttcataaaaagaaacatctttgaaggttattttacattgggttatatagtttgttgggctatatagaacattaactgtgaatataacatttaagtgaatattcatgttaaaatttttttttaatgcatttacatcctagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaatttaattatttcctgtttttttgtgcagtagaaagtagttgtgtttactgaattgtattgcttactactgtgtatttggttcaaagttaaagctttgcttgctgacttgtgtgtgatcttctgtcccatagagccagttcagaagggcctgggtgtaacatgtagaattattaacaattaagtttagagtatgaaataagcactatgtatgcagaagaaggggggctgtgtttgtcaggaatacagttatgctcaggtaacaatctcaaagtgtcagaggttttacacaccaagagtttttttttcttgctcacactacatatctcatgcaggtcagagggatgtgggaatgggaagggatctgctccacacggtaactcaaggttccaggatgactaaggctctgctattttgtggctgcaacatctggaacatgtggcacttaggctctttactgcctcggcctagaagtgacacatgtcacatccacttatatttcattgccaccaaagtagtcatgtggtcctatatacctgaaagagggctggcagatgtaggggaataaatggaacgtcttacattactgcctctgtcacagagactgtcagttcaggaacgaaactgggtctattacatgaaacttttagtgtggaattaatcagaatctgggtcaggttgtaagacagcagggaaaatggatcaaaatctagtgtgaaatacacaaccaataagtaaagctgagaatgcaggataatgatgttagttaccaaaacaaggtctggaccactaaagagttgtctcttcccccttccaagatcttttgcatttcctatcagactctttttagtgcactactagcaaattctgggtagcccctgagtgttagtcagcattcttcacatcctcaatcttttcatagaagttctccaacagaggaatagatcttctagaacaacaacccactgtctgttggactcttctaagtctccattcattgtccagattttatatctcttactgccatgtttctggttggattattttttctgtttccactattagcacttagactcttgtaccctgttgggggttggggtaaaattggggttctattaagagacaaggttgggacgatattatatcaggggacccagggatacccaaatctgtccttggcttagctgccttttctgtaagaaagggaggctaaggtgagcaaagtaatacttcactagctggtgctttggctgcaaactccagagctcttcagcccaaaatctaaccttggaattttccactccaatgatatgaatagctatagttagtcatctgcgctggagaaaatgataccagggagttttactgataaccccaagttctgtgcagtagaaaacagcctaatgagggtctggactctgatcagtcaattcagcctttcttttcctagggagcagagaagatggcaggtgggagtgggcacagttacggtctttgaaccccagcatggacatttaacaatctctacttctcattctttctctggtaatccaaagggttcagtagctgagctaatatgtgattctctaccttaggggagaaaatctgcaggtaagttcttgtagccttttcatggagtcatttccctgttccatatcatggctgttatgagtctttcttggaccaaagtgatgtgaaattcagctccccaaggccttcaatggatgcttctgatgtcatccttagaaacttgtgaaatagttttattcaggacttaacttaaagaccacactatatatttagtgaaaaattcacctattctacttctcatcttaaagtatgtatagctacactgttgaacctagcctaccaaacagacccatacagtgaataccagatgatagcttagtccaaataatagcatcttggaagtacaaaaatgcctcaagtctgaatatgaaacccctcttattgttaaatttctacagagaaattaaactcccattgaaa

SEQ ID NO: 14267 - DNA, 38657 bp, Human
catctccacatggcttcagcaggaacagtcacgtttgtagaaaagagccctgtccctcattcccaggtgatttagaattaagactgtggtggtgtgatagatttcccatgttaacacaagcagcattgatttctataacccaaaagtaataaaagagccagtcaaagttctaagtgaaaaatggtgagatggcattcaaggcatagagccaaagtaaaatttgtaagggaaggaagattgatcacatacccacaccatggtgtcacctctaatcctgcatccatgcttctctccatgctcccctccatgctcatcatgactcatgattacctctctgattttatttcctatcactctctcttccttattctgatccagccatctaggctgcctttccgtccctcaattgtgaagactcttgattttcttgtaaatgaactagaaagccaatgcagcaatctaagcagaggcctgagatcagacctataagatctctctgactgtaagtggagtatagactgattgtaggggaacaaaaatggagaaaagaacgccggttaaaagctgttacattaaatagtagtccaggcaagagatgatagaggtgtggactacgatggtctcagaattagtgctgagaaatgtctggataacaggatttactgatgggctggatataggatgaggaaagggaggaattaaagttaagccccaggttttgggttagagcagctggtgactttaggggccatttatagaaatggtgacgattaagagaggggcatgaattattatacaaattctgctttggacaagttaaggctgaggtatctatttaaacattcagtaggctgaaggatcattcagtcctaattgtttactaaacaaataataagtacctatattgccaggcactacggtaggacctagtctgaagaaaggaacacagttctatgagactatgaaaccaaagatttacccacgacttggtcagctgccccaggagccagaaaatacagcctagctgagatctgaagaaggaagggaaaactgcaggataaagaagagcatttgaaaaggcttctacggtagaacgcggcaagagccttcaagaaactgagggcccaagtgagtgccgcccgcagagtgaagaggaggacagctgctgccccgaggggagagggccccctctgcgagcccggggtggccgattcaggatctgaggcttcagcctgagaactaaagaggacgagaagaacacacctgttgtggcgggctttttcggggaggacgcgggttgggagattaactggaccggactagacctttaaaaaataactactatggctgcagtgtgttaaagaccgaggagaaacctgagaaagaacttatctccagtttctcctcacagaccctcagggtcagggaagaccctacactatttttacacagcctgggcttgccaaaaagtttttctcaggtataaaccaactaggggagcgtgtccttctcacctcgtcaatgacctcgtcctcttcatccttttccttgtcactgtcatcatcgtcttcatcctcattttcgacttctttttcctcttcctcgtcgcgctggactgggggatccggcggctgcggaaccccactttccacggcacgccgcttagacctggacgccatgttgccgctcacactgcgcctgcgcagcttccccttgcctgaccttccggaccagcccatagtagccaagggggtgaggaactacgaagaagctcggcgctgagtgcacgtcaaccccaatgcccctgctggattccgcagccatgaccccttacagtcacgtccagcttgcggtcccatcttgcttttttcttccgctttccaccctccatcactcctcccaaagcttcccctccccttcccgtagtggttcaacccatctaacctctggcctcattccgtggcctggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgaggtaggtgtcgccgcccgctgtaccggtacggacgccgaagcccgcgggcgtgcaggggcccggccccgggcggtgtgtgacacagtggggccagggccccgaggcttccgcggacctgggcctgcccaggcggggatgtccgctgccgctaccgctgcgccggtgacggaaggcgcctgcccagcctaccctcgccgagcttctggagcgcatttcttgacctaaaagtttttttaaagccggcaccgcagttaaaaatgcttcggcggggggccgggcccggtgtctcgcgcctgtaatcccagcacttagggaggtcaaagcgggtggatcaccagaggtcaggagttcgagaccagcctggccaacatggcaaaacctcatctctgctaaaagtacaaaaattagccgggcgtggtggcggacacctgtaatcccagcactttgggaggccgagatgggtggatcacttgaggtcaggagttcgagaccagcctgcccaacatggcgaaatcccatctctactaaaaatacaaaaactagccaggtgtggtggtgcgcgcctgtagtcccagctactcaggaggctaaggcaggagaatcgcatgcccccaggagacggaggttgcagtgagccgagatcgcgccaccgcactccacactccagcctgggcgacagaggtagaccctatctaaaaaaaaaaaaaaatgcttcggggccagtggggtagtctaggttaaagacccgagcctatttggagagaagagtggaggggactgcggccaactgcagagcgagcgccagcccctgtggcaggtggggatgcagcctggggcagccaggtcttcccattgcgagagaaacagggttcatcagctttctaggaataagatctgcggttctcaattgatttttctctgtaaaatgaggggggtgggttggatatgtttgattctaggaatggtgtgagctgcgctaataggctgcttctgtttaagcagggtaacatctgataaatcagtgatccttcatcagtacgagatggcgtgccctaaaggtccccaggagcccagattgcccataatcgtgttctgtgatttcggtctttcctgggagtctcttgtctacccagccatgtcatggatattaaagtaatacttacacatcagcgctccacatctgatggggcagcttgaaatggcctctttgggtcgcacaactgcaaaaacatgttcctgtaatggagaagagaggaagctgtcaaaaaagacccatcaaaaggctaagattagaaaaaagactcagaaagaccatgtgaacatatcaacagagttgcactgagataccatagccaattttttttcctgtttctttatactttttttatggtggtaaaagatacataacatacattttaccatcttaactatttttaaagatacagttcagtggcatgaagtgcattcacattgtgcaaccatcaccaccactatccattggcagaactcttttcatctagcaaaattgaaactgtagttaaacaactcccttattttccctccatgacctttctactttccatctttattaatttgactattctagaaacctcatgtaagtggagtaacacaatattcttccttttgtgactatttcattcagcatgatgtcttcaaagtttatcccatgctgtagcatgcattaggatttccttccttgttaaggctgaataatactccattgcatgtatagaccacattttgtttatctacttatctgtcggtaaacattttggttacttctacattttagctgttgtaaataatgttgctatgaacatgagtatcaaatatctgttcgagtccctgctttcaattctttggggtatatatgtagcaggggaattgctagatcatatggtaattctatgtttatttttttgaggaactatacttttttgtagtttgcaaatctttcacagtaaacaggatcacttttgtaagacaagtaggggaaaaagccttactttatgccctcagattagttcccagtgttgagctcatggtcaaagtgtgaattagaatagtgaatgtgaaagtaaatacagtactgaccctagggaactgaactcagcaggtagtagattgcttaccactcgttcagtgttcatctttagctcagaatttatcttaatgaggcagagggatggtagcaagtggttaggagactgagcatgggcttcagaccaggatccaaattccatctctcccacttactgtgctgtgtgacctgggacaagttactcaaacctcccagggacttggtttcacctcctgcaaataaggctaacaccacctaccttgcaggtttaagtgaggattgcagtcttgcatgtaaaatgcttagcccagtgtgatagttacttttacatgtcatcttgactggatcacggatgcccagatatctggttaaacattatttcttggtgtgtctgtgaagttgttttcagaaaagatgagcatttgaatggatagactgagtaaagtggattgccctccccaaagtaggtgggcagcatccagtctgttgagggcctaaatagaacaaaaagccaaagaaggaagaatgtgtcctgtctcctcctgcatgcttgatctgggatatcttctgcccttggtgctcctggtgctgaggccttcacactcaggctggaacctacacccttggctctcaggccttcaggctacaacaccagccttcctgctaacaagtctccagcttgcagacagcagatcatgggacttctcagcctccataactgcatgagctaataccttataacaaatccctttctagatgtaaatatatgccattggttctgtttctctgaagaactctaatacacccagtaattaacatgagtaaatgctcagtaaaagggtgactgttgttattgctgatacccagaacaccatgacatagaaggtacgggtttgaggtttggttctttcttaccagtaaggtgcccttattccagtcattttttttttcttttctttttcatcaatgattgatgaacataagtatgagggtaaaatggcagagcaagcattagactgtaaatctagagacaggttgagccctctttttaccagtgccgaggtgagtttcatgttggaagcttcaggagcagcttcatttctgctggggcttctcccgcctttttccccctcaatgggaaataacaggtttcgttattttcattggaaaaaaaggcagaggaaaccccagacactgcacggtttttaggccctagcctcaccagtctcaagcctcctatcaaggagggccatatagtgcctctgatctgcttgatgcagaccctagggtccttcccactcccatgagccacccaccagagtgagctaagaaatcaactggcagagagcagagtcacgtatggccaagaggaattgttctgggggttgtttagtaagcaggagagagggaggagaagaaaaactgcacagggatcagatgcctccagcagaagaaagcgaggcatagagatcccttaccatctgagtcacgtggcaccaaatatgttaccagtggcaaatcagtagacacctgcagcaacctcaatcttgtctcctcagaagaaaattcaactgggggcataaggcagaaaaagtgaccgaggcaagcttcagagcaggagtggaagtttattttaaaaaactttaggccgggtgcagtggctcacacctgtaatctcaacactttgggaagccaaggcagccggatcacgaggttaagagatggagaccatcctggccaacatgctgaaaccccatctctactaaaatacaaaaattagctgggcatggtggcgcatgcctgtagtcccagctactcaggaggctgaggcaggagaatcgcttgaacccgggaggcggaggttgcagtgagttgagattgcaccactgcactccagcctgggcgacagagcaggactgcatctcaaaaaacaacaacaaaaaactttagaacaggaaagaaagtagagtatgcttgggagagacctaagcaggcaacttgaaggacaagtgctccattttactttaaggaaaattaatcattctttctgtttcaaagatgctgggtaaaattgaaattgttgttttcccacaaggtgagcaaataatgagcatctactacaggaaagaaagtccatcaaaaaagccaacaatggagaggctcacagcccctttccaatgtacaggaatctgaaactgagactgaggcaagagcagcctagaccagaacccagacactggccctcctgtgcaaacaccctctactccaccaagcctcttcctaaagcccaaggtggcgacatgttaacctatctgtgcacgcttctcaattgatttctttcccaatcagcctgataatatgtgactctagcacagcaaagaatcatcaacaacagaaccttttaattttatattattattattattattattattatttagacaagatccttctctgtcacccaggctggagtgcagtggcacgattatagcccacagcaaccttgaactcctgggctcaagtgattctcccacctcagcctcctgcgtagttaggactacagggatgcgccactatgcccggctccttgttaacaacttttaaaatttttgtagaaatggggtctcgctatgttgtccaggctgatcttggactcctgctctcaagcaatcctcctgcctcagcctgccaaagtgctgagattaccaggtatgaaccactgtcctggcctaattttatattagaaatgctttcagtgtttgggaatgattgtatacaggattaaaaaagaagacaaatgctttcagtgacgtcagataaaggataagggtagtagttggatttttatttgcaacacatctcagggagctctttattatccagaagcctaaacttcatgccagcatcggttttattacctaagagaaccacagattagaacccaggagaaatattttctctgtttacaatgggtagattgatttttctttggggtgtttgcataactaaactaagcactttgtactacagtgatactttatatttttatacctctatttttcccaaacattttcgtattcaaagtgtatgtgaggcataatatagcgtagggggttaaaagcacagactttggagccagactggttgggtgtgaatcccagctctgccacgtagcaattctgagactttggatgagtgtcatcctctgtacacctcagcttcttcctaagcctcgtaggtggacttaatgcatgtgaagctcttagaatagtgcctgggaggcagtaagttcaatagatctgttcgctgtttttatcttctttgagtcactcagcaaccctaaggcttggtagggcagaggttattcccatttaacatgggaaaaaacaagatcacaccatggttaagtcataaagctgagaccagagctcaggtccgttggcccttagtcctgtgcttattctgtgacaccatacttccttccttatattatcaccttagagaagggagaaggtaaaagggcaagcagaaatgaggaaaagagaggagaaatacatctataaggctgggtgcagtggctcactcctgtaatcccagcattttgggaggccgaggcaggtagatcacctgagctcaggagttcgagactagcctgggcaacatggtgaaaccctgcctctaaaaaaaaaaaaaaaaaaaaaaaaaatacatctataaacaagaagcttcccgttgctattaagataagagccacattccctaatatgacccaacgagacccaaaagaattctagtgtgagcatctttatgttaatctttggacacatttatcagtattgctttagtattcttagaagtgaaattacaggaagaaagaagatgaagtatataaagcttttgatgtcaacaaatcgttttccatgttgttagactctcttatgatacttgacgtttagaaaacatcatttaataagtagaagagtcaatataattatttcccaaagtgcttatgagctacttagcatatttatcttgaaatggaaaagctatttatctccttaaaacataagataccaatttctctgtttgttgttgatacaaccctaaatttacatcagttctctttccggaaccataaacgtttggcataggacacttggctttcactaatggtttcatctgtctttccaagtgatatcaactgctaacatgctctttcttggccttatcagtgacaggggtcttcagaaagaacaagcccattagtgctaagtcatggtgtaggagggataggtctcttccacaagcatttgattgccttcttcttgtgtaccgtccccatcggaaattgcttaggaagagtctttgagatctaattaagatctgtttccttgctctgtcgcagtgccctataaggactgccaggcaataatgaaggttcttttactgaaggatgcgaaggaagatgactgtggccaggatccgtatatcagggtaagtggcctgagactccttatcccacagtgtcctttctactgagtcaaggggcctggagcaggcagggatgggttttgcaaaacctcagaggaactgacgcagaataaattgttaatgttcccttattttaaaaacagccctagccaatccagaactatattctttcatttcaggaattaggattatatggacttgaagccactttgatccctgttttatcgtttgagtttttgtctcttcccagtttctctgagaaggtaaggcctgttgtgactgagcaccatgttagtgtttgatttctcccttgccagctgaagccagagagggactattttactgtctccttattttattcccaaactttaaaacatggcagcataacttcacctggctccaggaggctgctgctgttgggaggttctgactgagcctctatcagcccctccagaaagccacccagactcagagattggggcccaggagagcaggtcatggtgagagcagcaaacctgcattgctctcagcagtcctagaaccctttcactcatcctctcatttaatctacccctcacccccaacttctgcaaagcaggccagggaggtattattttcccgttttagagattggggtctcaaattaggcaactcagctaagacctctagcaagtaagagacagggctgggactcaaacccagggcttctgcccacaacttcagttcttcttccagtgaggagtgataaaaattgcaggagacaagtccagtaaagccttccaaatgcttcagagtgaaaattcagtgcccacagcttcagtgaagtcagatatgtacagcagcctagtgcctggctcagagtaaatgttcggtagatgatatcaccattatcctctttgaaaatcaggacttcagcattgatatcaccccctgaatattcccatttttattacagattcgggtcaagtcttcccccactacctgcaccccactctaatcccaggctgcgtcaggcttcccctctgtgctgcagtgcacttatcaccctgtgtttcactgtctctgccctagactctgagcttcctgagggaaatactgggaataaggaattcacctgtgtaccctaaaagtcctagaataaatagttccaggcacatagtaagcactcagtaagtgttggggggatgggtggaaggaattagtttgcctactactattgtgaagcatttggaattctgagtcttagctccttggaagatgttgaacatagccatcgtataaaatgtctttattgctttttggtgtgcagctttctcatcctgaagattacgggggactcatttttaccagccccagagcagtggaagcagcagagttatgtttggagcaaaacaataaaactgaaggtgagggtgggtctgctgtggattccactggacatttatttactcttatttctcctgctgggagactaaattccagaagcagctgcacttctaagagaagtgagtgcttagtggtatcaggtcacagactctgccttgggaaacaggagaacagggctatctcctaaactcccagacagatgaccctgaggaggactttcccctgtctattcgttgttcacctcctagggactgatatatccccttagaaggtatcatctgaaaataggataaatactactttcctgaaagagagatgatgaaaaaatctaactatgagaaaatggtcagtgccaccatgtcaggcacttagtgacccagtcacctctttgacttgtcttcccacctccgtccctcactattagaacagtatgaaaatggcagtgcccattaacagaaccctgggtttcagcctgagcaaacaccttaataaatgcaattgaacagcttcctagctaacaattatggagtgcctgttgtatgtcagaccctgtgtaatgaatacttcacgttcattaccccacttaaccctagataacaatccagaggcacacattgctatgatcttatgtcttatgttaccattgagaaaactgaggccaggatagtaagcacagaacaagtcagtgcagagccaggcctcacactcgggccacccacctccacagttacactgatgagcggaggcagcgggcagagtggttatgcaagggctttggagtgagttagtcctgggtttatgcagccatttggacattaatgagttccttgacctctcatcatgggattactactaatagtaatgggattatctactaacagtagactattagttaggtagaacttactgaatgctcactctgtgcgagactctgtcctgaatactttttcctgtgagatagatgtgcttagtattttcacttggcagatgaggaccctggagaacaaagggtatggaactttccaggcccccacaatgtgtaaagcacaagtgcaggattcaagctgcagagtctgagtcccaaaggaaagcatccaggacattacctggagcagagtgggcatggagtaagtgacagtggtgagttttggttattctgtctccacatttaaccaggcttcgctgtagcctaaacatcccaccttcttggtgatttcatacacacattcacctcttgttgaaaagaaagcgtgagaacctaagaaactcagagccagccaggcgcagtggctcatgcctgtaatcccagcactttgggaggccaaggtgggcagatcacttgaggtcaggagttccagaccagcctggccaacatggtgaaaccccatctctaccaaaaaatacgaaagttagctgggcgtggtggcacatgcctggagtcccagctactcaggaggctgaggcacgagaaccacttgaactcaggaggcagaggttgtatgagccgcgattgtgccattatacgctagatggggaagcatgtgtactctttcccagtggtgctctgggtgctttttcttgcagttgtattttttctttttgtgtatgttttgaggatgaagataatgaaaaagaggaaaaccctagaaaggtcactataactctttctggtgctttataataaagtttaaaatgcattttcccatgtattttcttattttgattctcacaacaaccatagggaataagcagtaggagtgtagttaatcccagttaccttgatgaagaaacagacgaggtgcgttaactgacttacctgggacacacacgttaaggggcagagctggctctgtggaaggctttctgactccacccagtgctcactccagttgttctgctgtgaggcttggaaagtagtttgtttacatgctatggataacttttgaataaatactattgatatttatggggtaggaagcaaagtggaactcaatctttggttaccatttcaaagggaatttcccttaatgtaaagggtagaggaatgctcttgaatttaagggaaagttatgttcataaccagattttggaaaggaagaaccattatttccctgttttctaaaaatgtaatgaatgcccagtagctttatgatatatttatacaatccattttctctttgtgtttctttaatctatatttaaagattttgtttgatcataaaatgataatattctgtatcaaattgtgtttgttaattgacctgaaatttattatttttactttggtgtaatggataaatgaaccctctcctctgagattacagtttgttgactgctttcagatttatgtcccaaataaaccaattggatttccttgttagacatttaagttgctttttttaaatgaccagtgtctttttctttaaaagtctagatttaaatttttgatttcactatgcagattaattcttcaagttatgttgatttcgtggttcccattaaaattcttctagtaccaactgtggagataggctaatatttcaagcaaggagtactaaaacatttatgaaagcaattttttaaaaattgcctataaaacatgaacaaagtgaaaatggaattttagtttgagatgctgttttttacatttggttgctaatagtttgctttgctcacagtttcttagggtgaacaagcagccttgggcaacagtccaaatggccactttggtatttgcaattcacatatcatttcatgttttacagtctgggaaaggtctctgaaagaaaaatggaatgccaagtcagtgtatgtggttggaaatgctactgcttctctaggtaaggagtcaaggtaaaaataaaacaacaaaaaatggcttagccttttcagttttaaaaaacagtttaactcagtttaaaaatattattttttgcttattaaatttgcaaaaattaattaagtatacgatactactgataagaatgcagtgaaacaaatataatcaaacatttccaaatggcattaaaaattggtttacatcttttgagaaccacttggtcagtatgtatgcaaaagctttattaaaatgtttgtaccctttggctgactaattccattgtgaatgtacataatgccactgaattatgcacttagtgattaaaatgacaaattttatgttatatttttactataatttttttaaaagcctaaatctccagatagtgatatcatagttgtttttttttggttttcttaatattttgtgcatttttccagtcttgagtctatttattcttcttaaagcataaaatgtaaatagtaatcattaaaaattaacattgagcattttaaatacttaaaacaatgcttagcaattgtcataaattagcctgtaactttgtttcagaacagttcaatttgtccagtgaatttgaaaatattagaggaatgtataatatgagtgaaaatagtttaagaattaaaagcacattttccagagaacaaaatgaggctggggaagaaaccagttgggagttgctaagctaattaaaagatgattcctagatcttctgagcagcatgacttttaccacaagctcagcagatcagccagggaaagggaattagtggcttggttgccaaggaaaccatcttccctcccgcacatctctctccaaaaataagttaagaatttgcttgttactttcttttatcattttttcctgaatgagaagaggaaagaaaatagccagtttctttcattctctatatttcctaccaaaaactcaactatcaaatatacagtatatttatacattttccaaactttcacacattcactgataagcaaacattttgagcatcacatccccttcagtttgatttcggtagcatcactatgcattttgctgtcactgtcctgtcatatgagaagaaaatgagaaaaaagactatggtgatacaatgaatgatgagcatctatgtcttgagacttagagtggctgagagtggaccatatcaagtgcagcacaagcagcagggccttggtctcagttaggcactcactggactcagtctggtccctgtttattcagttgtgaaggaaaaggacatgttctaaatgcagggaacatattatcaaaggagagaggaaattagaagtgttgtaacttttaaaaatgtctttgaaaggaaaccacatttttccttgacatgaaagtcaatcacccaactttgaacattctattttagctcaccttttcagatataataatgtacaaaggagctcttttgagtaggtacagggacaaggcattgcttgaactctctgaggtttctgttcaactagaatctcagcaggagcctggagagttatcagaagttgagcaccaacagctgggaggagaccaggcccaatgtattatctttgctgcgtaacaaattacccccaaattaccccaaaacttactagctagaaacaggcatttatcatctcaatgtttctgtgggccagaatctgggcatgatttagtgggcttctctgtaaccaggccatggtcaagctggtggtcagggctacagacattttgaggcttgacttaggggagggtctgcttccaaaatcactcacatagctgtcagtggcctcagaagatctgcttcccagctcactcacatgggcctcccgagagggctacctaagacatggcagctggcgtcccctgtcgcaaggcaatccaagagagagcaaaagagagcacctaccactgaagccacagtctttttataacctaatcttggaagtggcatccatttcttctgccatttcttttggcttgaatcaagtaagtccagcccacactcaagcggagggatgacacaggggcatggatcacagggatcattaggagccactttccactgcccacaagccctctagtcaagagccacccctggctccctagagcctgggaatcaggttaggaaagttggacatttgaagcaaagagaagacaaggtagacatttttcttgaagtagaaatgaaaacaagggtccagtgaatagcaagggatttcggtgtggaagtccagtgagagaagatgccagtatttctttataaatgttgcacgctgacataattttacaggtattattgattaataatagatggcaaaaagtacatgctggctgggtgcagtggctcacacctgtaatcctaacactttgggaggcagaagcaggcagatcacttgaacttaagagttcaagatcagcctgggcaacatggtgaaaccctgtctctatttatttgaaaataaatttttttcaaaagtacatgctatgtaacattatacagaaagtcctcacttaacattgttgataggttcttggaaactgccacttcaagtgaaatgatatataatgaaacaaatttttttttccttatcaatgttgtaatgaaaacatgttgaatgaaacgatgttattcaaggacctgctgtatgtcgtttcacttacagtggcaatttccaagaatctattgttgacattaagtgaggacttactgtacttggtctacataaaatctcctgagaacattatttggttcaataatatatgcatattttaataacattttaatttttattgaaaaagcaaagatggttggcttgtggtttgataccttgcaactcagccagccatatcctaggaaagccttccatttggctgcccaaaggtcaggtgccccaactttcccatctgattgcaaagttggacctgggcgccatttagtaggcactgttgcttggccttgtaaacccagaccagtgatgtcacagaagatagcttagcaattaacaacttggaattcataacacagaaagactgtaccagcctgggcaacatggtgaaatctcttctctaccagaaataacaaaaattagccaaacttggtagtacattcttatagtccctttaactgtggcagtcagtgtcttaacctctcaaatataaaaaatactctctggcaggtttatttaacacagttggagacaatttgaagtttcactgtcagcttttacttgggcagggcccttaagatgggcttacccagccagagtgttggttgaaatgttgtactgacttgaagcagagtcagtcttgccacatgcagggactgagaccttagaccaaatatgcattccccaaacatttcttgagagccatctgtggactgtggggtggaccgggtagccccagtctctgccctcacaaatagagctggccactgcttaatagcttccttccctctcaagtacagtagtaattgttctgttcacagggttgtggtgtgaggatcaaatgagcaagtgcttactttgtgatcagcaaagctatatatgagagttaatgttctggttatggttattattgtttcattacttgggaaaaatgcatatttatgtcaatattgattaccagcgtcactgctaagttcttatgtctcagttcagttcctgtgggatttttacaggtttttttgtttacttttgtttttgatgcgtttagctcttctaagctcagacaggaggtccagcctcggttgccactgtagcataagcaagggcttagttcctgaactgagttacagctttatttttcttttgattcagcatgtttttaatgatccataagttaaaagctgctggtgtttttattaaagctgccatttgttactaaccaggctctgtgtgactcctaagtggaaagcccacagcacttccttcctcagaggcattccacattcctgtgagcaggtagcagtgttgactgagccagtcccttaggcctcccttcatcagcacgctttgtggagtggccaagtgtttgctgtctggaaaagtgcagggggagcctgagtctgttagcttcttacttggttcatgaatagggatctcacaaaagtgctggtatagcccctcatcctaaatgacttgtatttgtagcgctgtgggtccctgttagcagattattatgaaacctttcctccccttccttccattttagtctggccatgtcaagccataacacctttctggatgtggtctggccacatcctcccaaaaaaatgaaggctctgtaatgccgattcctgcaaaaagtaccaaatgcccatcatctccttcctgactgaagagaaaacagcctttgttgagcaccttctagatggcaagcactttgctcttattatctgacacgatccttaaaacagttccatgtggttggtttttccccctcttgtagatgagctatgtggggctcagggaagctagttaaggccttacttacccagcctacacaactggggtgcaggtaccaggacctgatgctttctcttctgaacagacacttgtgatcttccctcagtagctttcaagaaaagacatcctctatgtgatttgtaaactgcatacctgtgtatttgcacgttaaaaaataacgctggaacaaaaggacttcaataaccgtgttaagaaatacatttctttgtggttttccagtgagtaaaattggcctggatacagaaggagaaacctgtggaaatgcagaaaagcttgcagaatatatttgttccagtaagtagaaaaacatcactccaaatgaagccatttattttttgttgacctcacaaccactacctagggaaaagaatatttcctcagtgcattcttggtggtgagattgattggtgagcatcgtataacccactctgggagcatagcctgtttgtatttgtgtatgtctatactttgtgaggtttagcccacttccttctaccccctgtaccaaagaacttgacttgaacataacacaaaataaaacatttgggagataaaaacagtggagagatcacttgagggattccaaagagagcagaggcaggaggtgtgagtgggtactctccccttactgaggactgtcctttcccttctcaggagctacttctgtctctgaattccctctcccagcttgctcccaggtaaagaactgactcatgattgggctgcctgtggacttggatttaaagtggcacttgttctaggggtgttagcatttaaatggggacttagtcttaaactaattatggaattgtaggcttcagaagatacataggcaaaaattcttggagcaagagggatgggaaggctgaccgtctacttgtagggcagccccacctctaaggtgcatctcccttcctctctgttccctgaatgtccagtacaaccgcaagctcttacacccttgtcatttgactcctctgctgtaggtgtaagatcatacacccccatgagagcatgaagtagaactatcttatcttagattgctgaagaggaggaaatccaggctttcctagagatcatgagctggcaaacttcatctgttaaggatattttgggctttgcaggcaaatggtctgtcagaactactaatctctgcaacagaagcatgagagcagccataggaaataaacaaacaatgggcttggctttgaccccaggctagagttttctgacccctttctaaaattgcttgagtgtctgctgagctgggaggccagggtcagatgaactgctgacagctgagagtttcctctaaggtggtcccaggagaggggtatatgccttggcccttgggtggtgagatcaggatgagtggtatagggagagagtataccttaaataggtctctttatggcttctgaaacagtgatagatggttttgtttctggtaaaacaaagtatttatgttatttaaaaaaaatactcctaaaggtgatgttggcctttcttgacgtgcaaacttgtacactaacgtcttataaggcattacttacaagtcttcctgccgtaagtcattgctgttgcctgaaggttctctagcttatatttttctttgtgttactgggagcttgttctagagaaagtcctgcgtctttttctacactgtggtctgaggatccctggagcttaattaggcccctgacagagtcgtctgggttgggggcggcagtgagcagtcagggaacagcagagatactgctgggctcagtggatcctttccaagttctccaattctccttttttctcttttctaatttcttttaaaaataacttcgttgtacctttcctgagtcactacatgctcggtgttaacgttgaagactagcatttactgagtgcccagcgtgtctcgggtacatagacacgtggcctgtatgatgtcatttaatcttcaccatcaccccatgaagtcagaatcgtgtccactgcaagctgtgctggccagtacagtagccactagccacatacggctatttaaatgtaaatgtaaattaattgaaattaaatacaattgaaaatttagttcttcagtcacactgggcacatttcacaagctcacttgtcactgtggccagtggcaccaaattggaccacacagaacattcccatcatcaccaaaagttctttctgactgtgctgctatagagactcttgggggtccaaggcccagatcttgtccaaggtcacaagctatgaagtggcaggctggaattcacactcagcacagcaaggccactgctcatcccatggcctgtcacattcagaggcctgactggcatctgctccatgccgacctgctctcaaggagatgctggccaagcacctccatccactctgatttacagtgactggggctcctgcagggatgaagacgtaagtgtgcttgactctgtgtttgaatctggtgggcagaggcttaaggagcctccggtttagaggaactacacgggccttttctggccactcagatgaataagctgtagtcccagagtgtttcggccacttggcaatcctgagcctgtgcactccttagttcagtggatgtgcgttcatcggctcggacatggctttcaggtattaatgcattgactgacgcctctcttgccccaccccccatattgcttcccacatcacaggagaacaagtcagttcaatatggttcggcagatgtttacccaggagcacctgtgtgccaggccctttgcagggcgttgggactgaagaggagtttaactccattcctgtcttctggaagttcccagcctagctggggctggaggtggggtagggtggggaacatatacatcagtaaccgtgataaggcagggtggattaagtgaccagaagaggtatgaacagtttttgtatggtgggcctgctattaagatacctgtttctacctgtaaaacactcaggataccaaataggtggggtttttcctcatatcaatgaccaattctccaatgctccagataacagctgggtgtcctacaacttaattttgacattacccagaattaacccagaccccacagctttaagggctcagtcttagcaaactgtcccccactttagatacaagtattggatgctgagggacctctgtccaagttggctacaagtcaggagttctcacgactccctactcaggttcagtaatttgctagaatggctcacagaactcagggaaacacttatgtgtactgatttttataaaggagataacaaggacacagataaacagccagatgaagaggtctggaagggtcctgagtacacaggagcttcttcccccatggagttggggtgcgccaccctcctggcacatggatgtgttcaccaacccagaagctctataaactcatagttgaggggttttatggaggttccattatgtaggcaccattgattaaatcattgacccctggtgactagctccatctccaaccctttgatcacatggttgtgatcctctgtgtggccttcagcccccatcctgaagctttctaggggccaccaccagtcacctcattagcataaactccagtatggttaaaaggggtttatcatgaataacaaaagatgctcctctcacctctaatgggaagttccaagagtttcagaagctctgtgcctggaacagggaggaaaacgaaatatttcctcttgtatcacagtgtcatgtcagggtgtccaaaagaaggcagaggtcttcaggaaagtctgtacaaaaggcatggcctcctctccacagagaagggcaggccctccctcaggcagtagccatggccaagccctcccactcagagggagccactgagcagagacgtggaaggagagggttttcctggagagtacagcatggcaggggcagtgggtggcaagctggggagcactgagtagcctctgagagttgaccggagccctgaggcacggggccttacatcagcccctgcgggtcagactcaggctggattggtcctccccaggcctagacgggaacacaacactgcctgctccctcttagcgggcatcactaggtacagccaggattgggcccaaaaggcagtcactggattaggacccagttctcttgttcctgggactttttaggagtgtctctgaaatttatcccttaagtaaaaagagcattctttaaaacctacagagccatcgcagtctaagagcagggcctggggtgctgtggcaggtcttgccttgaaggagccgtcttcccacagctcagtgtgctccagggcttgctggcaggcagcttccacggggtcctggaggctctgggggcataacagaaatgctatcagggagtttgagggcccgttatgagtctgacatacattggcattttgtgcatgcctttaattgtctgacatattgtggtactgagctgtgacatgggaacgattactagacctgcttttgctcatgaagaaactgagctcagagagggaaaacttgtccataaggaacagagctaatagtggtaggctggggctcaagcctaggactggctgactccaaagctcttcctgtctcccttgctctgtgtgcttctaaaagatacttagtccaagtccaaaatatgctcatttctcttccctcaggtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttgacattgcttgtgggattaagttctacaaagaatagtaattatttctatgggtggctgacaattagctctttaatagaataggtggctcctgcctgttttcagtgaagacattgagctgtacccacagtttgtttgtaaggagacagaagtgaacctctgagtcgttgttcattagaagacccagaaccatcaggctggtgtccctgctttgcaaacacaagacagaagagatcaatgtcacttctgagtgatcacattggtgtttcagttaactgactcaaggcttggttggatagatattaacatattctgaccttatctgggagaatactggtctgcattctttgcaaacttctgccatttcctctaatttattaccagcatatctatgggtcctaataaatcttccatttgcaattagaatatccaaataaaaatccatgttgactgctaataaggaccttcaccttggctttaccaaggcattaatgatttttctttctcagtaaactttgatgcctgattttaaaagctaaaaatctacctctaatgcttgtagtaaacaggccaattcatagctatgcctatttattttagttaacacttaactactttgtgacaggcactattgtaagtgcttaaagctattaatccatttaatctgataactcattgttctgatagattctccttctttcccagatatctcctctaatgggaaagtaattacacactaaatggtaaaaggtagaatacagtataacttttgaaaagagagagaaactgtgtgggcagaaagattgcactgcagtttatttgaaatgtcctcctggattgggaaaatctctgcagcctggcacacttactgggcttttcttccattcctccgatcagcctcctcatccttattatcagcactcaggcgcccactgtctgctcgaactgattctcatggcagtgcccgagagggggaagtcattgttaacttggaagttgttactgttctacagatgtgtgcacgtccttcagtaagatgacattttaaaaagtcagtgtcattgatgcaggactttttgctccttaattcagctaaatctgggttcttgtctcatgaccaggaaaaattaggcatgtggacacattgaagggtgagaagggcagaacttattaagtgaaaggaaagccctcagctgggcgcagtggctcactcctgtaatcccagcactttgggaggccgaggcaggtggatcacctgaagtcaggagtttgagaccaggtcaggagttctggccaacatggtgaaaccccatctctactaaaaatacaaaaattacctgggcttggtggccgcgtctgtaatcccagctactcaggaggctgaggcaggagaattgcatgagcccaggaggcagaggttgtagtgagctgagattgcaccactgcactccagcctgggtgaaagagtgagactccgtcacaaaaaaaaaaaaaagaaagaaagaaagaaaagctctcaacaaagagagggattctccaagcaggtttctccctcattattgaataccaggggtaccacacatgagctgatgaggccaggctcctcccctgcgtaaggtgcgaatcctagtgactccgccccgttcccccagcacgcacacgaggatgcccaggtaaaccataggtagtatcggaaaaggcaacatttgattggttaaaaggcattattcggaaagaatcaattgggaaagggcagacaaacgggcagacgttctgcccctgggtcgctggtttcatctgggaccagcaatctggtctttcagacttcaggctgttctgggcttgaaggtgaggtctcaccggggacccttccctatctgcctaggcatttgtctgcctcctgcttgtatcatcattttcttaattgcctgcagtgactttatcaagccccgtcctgagctgcgtaataataatactgtgttaggattttcagtgttattactcatcatcagcccggacagcccagaattccaggccttcttcctgttaaacgaacggagagcagagcctttgagctccacagttcactatctctgtgtcagccttaaccatcccattggcctgttggggctgaagataaatccccaggcattaagcatattccaaaagggaataactcctttgtctttggctttttgaagtgggctagttttcaggacatgtagttgtagatctctcctcaccagcaaaggaggactcagccaggacattttcaattttctcctttctgctgacagggtggtgccttttcagtgaagtcagctgagctggttggacatttgtgggccctgtgtgcctgcagagccaagctctctgcaaggcacaggtggtggagagatagagacaagcagctgccctcagggagccgcgtaccccttcggcccagccttgtgagtcagagataagaatgagcagctcaggactccactggaccctcacaagaggtgctgccaagggaagattcctgactctttccaaggcccctcgcacacctgtggggctgggcttgctgaaaaactggactgtagttctcttactggatccccaggaagagctttggcccctaacatcttccaccctgcattccccaacacacacatagacacacagaaacggggaagaaaattgcctctgaacatggctttgaaaatatgtctctagggatgcagagcatgaaaacatttcctcgcactggaagagagaaatcagcaggcatctattaacgaatttaacaatctcccaattcattattttattttatgttggtacagatatttacagagcagtttaaataaagaaaacattcaccagtatgtagcctttatacacttgaaattaagtggcctgcagttattcctgttgtttggctgctgcttgctagaggtggtactggatggaaaggggttgttttgctccttcctctcgttgtagtcaccagagaagatgtgatcagagagatcataaggatgtgagaaaatatacaatgtgtatgaataacgcccattaaaatttcttatgtcttacggatggatgtggggggtaatggctggttctactaaaatgctgtgttttcacatttggggaagattctggcatttgacaacttatcagcttttttggacagtattgttgcaaattggcattcaaatcctatgctgtcctcactattctgcaaagagttaagggctgaaaatgcccttaagtcttcccagagtggagatgctgggagcagaggttgtggtgaaaggagaggcaggccgttcttagcaggcttctctctctaaggcctgtgcattcgccttttggcacttggcctagtggctgttggtgtggctagaagaggagtgggcagtgagcttgtctttgttgggggtggctgcagagccactcctggctgccggttaccggctgcctcctgagcatgagccctggctcatctggagcctctttaaaggtagaaaatgtttgccccagtgccagtcagcaccaggcctgatcttcaccttcctgacttagttaaggtgcaaagtctgccttctaaatagtgactgcaggctagggagtcacttcaggatcagaaggagttaaaagaatgtggctaacttgtttgtgtggatgttcattttctgagcacctccacacacattacctcttatgatcttcatataacaacccttcaagttcggcaaggtagcaggtgctcttcctgtttacagatgctgaaactgagtcctagaagcagagccaggcctggagcccagggctgcttcccccttcccaaagctgcccctccccattcccctgtgcacaggcactggccctgagttttcacaaagcctggttatttattcacaggggagtcctcagcactgcctcttctatttccctgtggaaacctcaaaagagaaatcctgccaaaagcgctcaaggacaaaggcgagtagaatgctttgactgcatcccttaccactttgggatccaccaggagcctttgcagtgatagaagtgggtggccctgcagagagcacacaagggagagcagggctgggttggataagccaggccaggagacacagagaccatgctcatgggaagagtggacgtgcagtctgcactttcctttctttggatccactcttcccagcttgttagctcaagctaggagcacacagtgtgtctccagtccttcaccaagaggacaggagatcgagatgtggaggtggcccctgggcagataactgaggtgacaaaccatagaattggttccacatgtagaagaaagtctacaaatgtagccgatcttataatagcatgcagcaccctccagccgagccacacaagctccacctgcccctccagctccacctgccgtggctcccaagactgtcagcacctagaaaccagttcttgcctctgaagcatgctgccgtcctcgatgcagatgtcttagctgtcacctgcgcaccttttgctgtcacatagttagtctgggagcaaagtctatcagtggtttggagtaccagctttcggatgagataaaaacagatttgaattctccctcttgctgtttattagctatgtgaatgaaggtaagtgatgtaatctctctgtgcatcagtatccttatctgtgaaatatggttatctgtacataaccatggtacctgcctcatagaggtgttcagagatcatgtagcatgacaccttgttctccaaaggcaagctctccatggaactatgactgttactgtctctcccagggttttgaagctctaatagtccacatgagcagtgtgacccaggatgaccttagaccttgtaactttccccccgtattaaaatggagctagatcgtatcccttctacccatatcatctgtcttctaaagctaccaggaataaaggcagaggacattaggtaataagatcagcaaaatcattagcttttcgggaacaagaaaataccaggataaaataagagaaagcttggtctcagttacccttaaagaaataatatataaatcagaggtttgatacttcagtttatttctttagttttcagggatatgaaatggcaataggttgctgttttatgctgaagttatcatttcttctgagagagtttcccattttattttcagaagcctgagttttcactacttttcacctaccatctggctgcccctcataagtcaatatctgactgaaattgcgtgagtcccttcagtgcctagcgcctcatcaccagccctgaaaacccctgggaatattcagagtcgctgaatggcacagggaggaatgtgggaaagtccacggcttaatcagttcttgtacaagtggacacactgaggcccagagaggggacgcgtggccatgtggaggcacagctggagtgcagccggggatctggactccaggcctctcccaagagctgcccttcctacacttgctggtgtcatgcaaccagtctgtgtgggatccatggagtgactagggacggccttgtgtggacaaacctacataagcctgggaacaaaaggcattctgggtacaaatgaaggctttggtttctgggcctttgttctttttctgccgtctcagcctcctcttccacaggaccactccacagcgtttagcaggctgcagaggactgttcaaggcctctctgctgagtctggcctctcagcttccaagcagctcgttccaggagggtggtgctgtattgggaggtttcaccaactgtgctgtgaagtggtggaggccccattgtgtgcccagtgcggtaaagtctttcctgcttttgattgtgcccagggattgccatggaaagcataactgtgtatcagacagttgcacacccaggaatccaagggaacctgaacagctactattcccagcaggtacgtggcgtttgggggcggttctggcagggtgggtgcccaggtggggaagcagagggtgaagggcacgagctgatagatgttggttctatatgtggtttcactgtccccagctgtcacctgcatgccttttcctgtcacatagttggtctgggattctagaattaggaatggaaacaattttgtggttgtttcatgaaatgtctattgcaagctggtttgaaatcagtgatttcggtaagaggtgcttgtagtaggtggtctatgaaatctccctctttggagagattaatgtggtgactttgaggaagtggtaagtttttataggggttaaaggagataatttacgcaaagctttttgtacagcatcgaagatacatacaaccctgaggtaaatagtggccttgatgttatcattgctattcatcatacggggatgctggtggagctggaggggcagacactggagagggaggctgagcccatagtgggaagagctgacagtggccaccaaggagtctggattgaatttgggagtccgtggggactgttggaggactcaggcaggagaatggatagctcttgcttgagttccttgatgtcttcagcatttatatgcagtaaaacacctccctttcctctcccagggcaagcttctgaatgtcttgcctggtattgggagggcctgataggacaaaccaaatgcaaaaaggccaggcaggcttgtctgcttgctctgcttccagagggagggagcattgacagggagccagcactgcctcacaccactgcctcatgtgatcagtgccgtatgaccacaggagctagaggcattgtctaggctgctgggcacatgagctccgggatgcccatgtcctctggccaggcagacacagacctggggcagcaccagctttctgatggcagcctgctctttccaacagttccctaccagaatcctgcctcactggagcagaggatgccagcatcagccgggaaccactcctgtgctaaaaccgccttggtggcctgtggcttgaggtcttgatgcggatgaagccggaggaatgttgtctctcctcagtctcatggcaaggactgatcttgttttctgttccccacagggggttccagccagcatcacattttttagtccctctggcctcacatacagtctcaagcacattcaggagttatctggtgacaatatcgatcaaattaaggtaagttattcaatgagcttttggtctttttcagattcttttttttttttttaatctttatgaattatcctagggcttcaatgtcaagtgagacacccctggcctagcaggtgccttagaattggaagggcagctctacctcctgctgggctgttgcacagattgctcaccttctcccagcccgtttcctcacttgcagcatggggataattgtctctctgtggctttcatagacatgtgtatggtcttccctgcttaggatgagtctcaggattacatgagggaatttgagtaaagtcctgaattagctcagggcttggtacaggtgttaacatcctttccttcctttcccccatcttatgtttgccattattgtctattctaaaagcagtcacctttttcatatcttttaaagggtttacattctcacttactagggactgtatttattatgagtctacaaataaccacaactcttgtgtctgtaatagaaacacccttgaactggctccagagggactgaggagagggtgcaggatgtgacccagagcccaaggacagacactgccactcactgcagtcaggaagagcaaaaggcttcacctgccttctcacaggtgcatctcatgtggggagtatgcaccgctctcccagttttaaagatggagcacggggctcagagacatcatatggcctgtctgtaggtcacactgctgagaaggaagagctgcagttgaacctgggaagactgattccacattgtcagccatggtgatgccttgccatggtctcaggagctgctgagcagttgatgcacttctgggcagtaactgatacaattctcacaccagtccagtggtgggtatccagaaaaagaggtcagtgttcctcattacaggtgaggacactgagggctagagaggtgaaacaacttgccaaagtcatgttttgagttcctagaaggcccaggactcacacaggtcaccgaggaagaaaaacaatatctgaatcttgtggttagaaagattagagagaggccgggcgctgtggctcccacctggaatcccagcactttgggaggcctcaggcggatcacctgaggtcaggtgttccagaccagcctgtccaatatgatgaaaaccccgtctttactaaaaatataaaaattagctgggcatggtggcatgcgcctataatcccagctacatgggaggctgagacaggagaatcgcttgaaccctggagactgaggttgcagtgagccgagatcgcgccacggcactccagcctgggtgacaagagtgaaactccgtacctgccccataaaagaaaaaaagaaagaaaaagaaaaattaaagagataggacccataaagtgcttagcatggcaactggtccatatgaccagcgcttacgtcatattgcaggtcaggatgggtcacggtgctggtcctgctctggttcttgtccctctgtgccctgctgcctctcccctgggcctgtaggaggagtccccacctccaccccacccacccacccccaagtcacacaatgctgtgagatgcctggtggtataagcctaacacagttttccccaagcttcttagtgtttgcctagaggaagaacaaaagatttatactctatcttctttcaaagtgagcatatttaaaagcacaaatggatactcagcatctgaaccaagaactcaggcctttctgaatagactgctgcctgcattgtccacacccatggcagctgggggctgagtgcgtgttcctatcctgtatctgtcacacccatttctgcagccctccagacactctgaggagctctcagtagccccctcgcctcttactacagtgattgattaccctgcctgccagtagttaacacctctgccattgctgaggaggagaaagtgacagagctggccttgctcacagtgactatggactgcttgggggccacgaaggcactgtgtgtgggttgtgagttgtccctcgacactgggacttggcgctggatagtgaggtgctttcaaggttcacagaggacacagtcctagcccgtgagttggtagttaggcttttctgtctcagctcagcctcagatttgctactgtcctccctccccaggagtccctgtagggcccactgtttgtacagcattgcacaacatgcaggcgcaccacaaaagatcaaagggggtgacttccgacctgaacttgctacttatccattgacttgggaagaccacgcacttgtctataaatgccacagagatgtcactgcaaagcagtaggtaagcagattcgtaatcaccaccaccacactaatggcagcagctgaatttcctgtgtacagcaaaatgcccttgcagcctgtgaggtgggtatcttcacacctagtgctcactagccacagtggcagagccaggctgtgaacgtggctgctgcccccaaagccaggctggtgcactcacgtccagtttgtgccagggatggagaaagaacgttgatgctgggccccctcgcctggcctggggaagactgctgctctgtggggcagcatcatgtgagcattcattgacacaggagtgaaaggctcctgtgaaaaagctgctgtttcaccaaactgttgatacccctgctctaggactacagtcatgtttgccatttgctggttcccagtcccagggagtttctttttttcaaatttttaaatagctttattgagatgtaattcacaaaccataaaatttactttttatgattttaatatgtaaacttaaaaattttttttttatttttttagagatggggtctcactgtgttgcctaggctgatctcaaactcctggcctcaagtaatcttcccaccttggcctcccaaaatgtagggattacaggtgtgagccaccacgcccagcccaatatgtaaactttaacatgatttttatgagagtcacagatttgtgcaaccatcaccactgtctagttccaggacatatcatcaccccaaagagaaacccggtacccattcgcagccacccctcattccctcattcctcccactccttggcaaccactcaactgtttttcatctccatggatttacctattccggacatctcatattaatagaatcatacagtatgtggtcttttgtaactgactcttttcactagcatagtgttttcaaggttcatccatgctgtagctggtaccagtacttcatccctttttagtgccaaataatagtacatgctgaggaccgttttatttacccattcactagttgatggatatttggattgttttccactttcaggctattaaataatgctaaacattcaaatacaattttctgtgtggacatacattttcatttctcttgggtgtatatctaggagtagatttactagatctaaggtaactttaacgttcggtcgaattactgctattttccaaagtggttgtgccattttgcattgtcactagcaatgtgtaagggttccagtttctccatatcctccatgtccttatttttctgtctctgattatggccatccttgtgggtctgaagtggtttctcagcatgtatttgatttcgatttccctaatgactaacagtgttgagcatctttttatgtgtttgttagtcatttttatatcttctttaaagagatatctattcaaatcctttgcctacttttaacccaggttatttgtcgttttattgttgaattgccagaattccttattctgaatacaattttttttttttttttgagatggtgtctcgctctgttgcccaggctggagtgcagtgacacaattgtggctcactgcaacctccgcctctggggttcaagctattctcctgcctcagcctcctgagtagctgggattacaggtgcacgccaccatgcctggctaatttttgtatttttagtagagatgggggtttcaccatgttggccaggctggtcttgaactcctgacctcaggtgatctgcccacctcggcctgccaaagtgttggtattacaggcatgagccacggcgcctggcctctgaatacatttttttttttttttgagatggagttttgctctcgttgcccaggttggagtgcagtggcacgatctcagctcactgcaacctccgcctcccgggttcaagcaattctcctgcctcagcctcccaagtagctgggattactatatgcatttttagtacagagggggtttcaccatgttggccaggctggtctcgaactcctgacctcaggtgatctgcccacctcggcctcccaaagtactgggattacaggcatgagctaccatgcctggcctctaaatacaaactttttatcagacatacgatttgtaaaaattttctcccattctgcgagttgtctttttacttttttgataaagttcaatttattgtttttttcttttgtttcttgtgcttcgggtgttgtatccaagaaaccattaatttagtgttgctttaattcagtgttttgaagatttactcctatgtttccttctacgagttgtgtagttttagctctgaacttaggtatttgatctgttttgaattgatttttgtgtgttgtgtgaggtaggggtccaactttattttttcctcagggagtttcctaagcaatgggtgcttagcaaggcagtactgtgggcggggtgggagcggggcctctgcaggacagtggcctccctcccctcgttctgactcagccggaggaaggagcctcagtcccgcagcatccgaggttatgcagaggtacaggtggcttgttacctccactaccacctggcctgctgctcacttgctgggagggaggatgaagcggagtgctgggcaggggctgccaatgttggatgctcacttgctcccaaacaggtttggggtccacagtctcaatgcagaggagagtgggggatgaggaccttctctcatttaacccccacactagccctctgaggccagggtaactgtgccccttttataggtgaggatcagagaggctaagggacttgcactaataacagctagcagggggcagagccgggacagaagcagtgctccatcccaggcgaggctctgcacagaaccatcgagcctgtggtgcttgttcagagagagatgtcctgtggatgaggccagtgccccggattggctgattggaagtatcacgacaacataggcagcagcccatgacggtcattgagcttatctctgggccaggccaagtggttcacacctgtcacctcatttgatccccacagcagcccagtgaagagtcctgttatcttttcggtttgacagatgaggagatggaggccagagaggatgggccacgggccaaggtcattgtcctgtggagctgggatttaaatcccaaccctgtgcccacagagccctgaccttgatggctctactttcttggggattcagtcactgcccctgccacaccatcctccccttgatcagacccagggcccccaacacccgaagaagaactgtctgcagctagagcctctgaggaaggactgcactgacacagccgtgatggtgagcaccagcctggggccttcaagtccctgcccctcacctgagcctggcgacagtcgctcagggtggcagactgatgagagcgtggatgcagaggtattttgcacgctcagaagctgggctagaatcgggcagtgttgtcatttttataaacacgtcacatgagcagtaacgtccaaccgcaaagctggctgacggcccctgcacacatccagctgcctgctgccccagcccctcctggtgtgctgaagccctgttttctcttctgtctttatagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgcttactgagtgtatggttgctgtgtgtcattttaagtgcaaagctgtgttcagggaggagacaggtatgcccacctctgataacccacaaacctgctatgaatcagaaaatttgctctatataaagtaggtttattcattctataaaaaggaccgtgaagttcctgcttgtgagccatggacaactgtggttcaaatatagaaagacttgctttccctcaaagatgcagctgcagcattagacagtcaaaccatctgatctcccaggaatctgaggggctagagaggccggtatttactgagaagaggttcatgtgcaaatgcagtgccctgcagaaaggctttggaaatctgttcccaaacttcattcccaaagttcccaaacttcattcccaactcagcctgaagtttaggctaagttgactgaaacccagacttgtctcttagtagcatgtgggctggtggtgggaaggctctgcccacacacctctgtctccttgaaagatctggctgaaaggcatttgggctccccgtctctgatctccattcctcataaccctgaggagtggacattcctattgttccatttttctggtgaggaaacagactctggtgaggtgaaatgatttgtcagggtcacatgctagtgagtggcagaaccagaacaaaattaaaaggcatggacgagcataagcactgaggcctagactaatgaaattcatcagccacctcgtaggagattcacactagttgagaggttagaatttggtgatgattgttctccaaatcttgatgtgagtatacagaaattctttgagaactgttctaaaacgggattatggtgatggttccatgaagtgaccacttgtgtcaagattaaggaaaataattgggcaagcactgtttcatacacgttttcaccatagtaccaaagtgaaatagatttgcccaggaactaagaacctggctatacatcagaaccacgtaatgtgcttctaaaatgaagtagctcaggccccacccccagagagtcccctgaattggtttctagaataaagcccaagcagcaggaggtgttagacgctctccaggtgcctccagtgtgcacccgtgtttggaaactgctggattgcaggaatggggtcccccatagctggagtgtgatcaggaatgccctcatgcatggtgaagaggctggagaagcaagacaagcccggaagtgaggaaggaggaggagaagtccaagctgtaggcagacaagagcgggagggatgtgtgggcttcggaagcacacattgaaggaggaggaaaaacaccctgttgcagggcagggaaaataggttccttttcagagcctcggggtaggggacagaatcggggacaaaggttcactaaatgtctacatgctagtaaacaccacacgtgtgtcctttcatccccacacaacccgaagccaccttttgaagagatgtgaggctattaacagttctggcgaagccttgtttcagatggagtgcgccagggcatggttaaagatggttctgtttgggatcaggaaggcagggagctcatacggggcgggagatgagcaaagcagcaggcgcagtgtcctcgacgattgcgtgagtcgggagcctgggcttgctttggcaattgggctggagattcctgagaacgtgaaggctgagtaggcaaaagccagtttgaaagggactgtggagaaaccctggttctgaaggtattggtgggacagaaggtaagatctgtaattactcagctcaagaaagtgaagcccagggatgtcacacctcatttcttctgctcaccctcccacgggactgcagtttctgttaagggcaataattatgttaatcattctatggctcagtggctagatgggagtgaacagaagctggcataaggcttttcttcaaagatacaactgcagcattaaacagaccatctgatctcccaggaatctgagggtctgggaggtcagtattt

SEQ ID NO: 14268 - DNA, 24663 bp, Human
  misc_feature (1)...(24663): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaatttcgctcttgttgcccaggctgtagtgcagtggcacgatcttagctcactgcaacctccgcctcccgggttccagtgattctcctgcctcagcctcccaagtagctgggattacagacatgcgccaccatgcctggctaattttgtattttgagtggagacggggtttctccatattggtcaggctggtctcaaactcccgacctcaggtgctctgcccgcctcagccttccaaagtgctgggattgcaagcgtgagccaccgtacccagccgggagtgtttttttcaacaatcccagtgggacccgagtaagcagtttgtgtttgtttgtttgtttgtttgtttgtttgtttttgagacagtctctctttgttgccaggctggagtgcagtgacgtgatctgggttcactgcagcctccacctctgggtttaagtgattctcctgcctcagcctcccaagtagctgggaatacaggcggtgccaggacacccagctaatttttgtatttttagtagagacggggtttcactgtgttcgccaggatggtctctgtctcttgacctcgtgatctgcttgcctcggcctcccaaaatgctgggattacaggtgtgagccactgcacctggccaagtaactgtatttatttatttgtttgtttgtttgtttgtttatttatttatttatttattttgagacggagtctcgctctgtcacccaggctggagtgcagtggtgggatcttggctcacggcagcctccacctcccaggttcaagtgattctccggcctcagcctgctgagtagctgggactacaggtgcatgccaccacacctggctaaatttttgtatttttagtagagatggggtttcaccatgttagccaggttggtctcaatctcttgacctcgtgatccgcctgcctcagctttccaaagtgctgggattacaggcgtgagccactgcacccggccgagtaactgtatttttaaatatttttactgatggctggacatgctggctggcacctgtaatcccagcactttgggaggctgaggtgggaggattgcgtgagcctaggagttcaagaccagcctgggcaatatagcaagaccctatctctacaaaaagttaaaaattagctaggtgtggtggtgtgccctgtagtcccagctacttgggaggctgaagttggaggatcacttgagcccaggatgtcgaggccgcagtaagttatgatcatgctactatattccaacctgggagacagagtgagaccctgtctcaaaaacagaaaagttataaagaagtgtttttcagctcatggtaaagctgctcttctgtatgatctccaagagctttgcaatcatccttattgatttcctgatttgaggaatagaatggcaatactagataccatttatttagtgcttactatgtaccaggtagttgactgaagtacttttcagcctttttgttatttaaccttagcaacaataggagatgtgtggattgtcttcattttatagaagagaaagtagagatttagaatgttttaagtaactcgccccaaatccaccagctagtagtaagtggtgagtcaagatttgaactcaggtctacctgctcttcaaatctggactctaaacgactaccactcataaatctagatcatctgatggatgccaccagcactagagataggttagtggacacctcaggaagagtgaaagctggaactggggaagggagaactaaagttgtcacctcctgccattgcttttcagaatggaatccagacaaataagccagctttgcgtgctgtccgacaacgcagtgaattcaccctcatggccaagtgagttgagagaagctttctggtggggtgatacagtgtctgaagaaaagtagacttgcaatcagtggccttggctgtgaagtctgggattggttatgctggagcttatgtgggaaaaggcgtcctgccctttcccacagtctgactagtggtcatttgcaggcgcattgggaaagaccttagcaacacatttgccaagctggagaagctgacaatctgtgagtgttcttggggtctttcagaagtggggcagtaaatcaaagagggttgaggactatattccctgagctttgtccttgacctcacccattgtggcttcttgtttgtctctgtagtggcaaagcgcaagtccctctttgatgataaagcagtggaaattgaagagctaacatatatcatcaaacaggtgagctactagccatcaggagagcccagcattccaatcagatcacttctgtcttcctgtcattttccattgccatggggacccagagcaagtttctttttttagagaggggggtctcactgtgttgaccagtctggagtgtagtggtgtgacctagctcactgcagcccttaactcctggcctcaagctttcctccagcctgagcctcctgagtggtagagactacagggacatgccctcattcctggataattttttttttttttttttttttgaggcagagttttgctctttcacccaggccggagtgcagtggtgcgatcttggctcactgcaacctccacctcccaggtgcaagcgattctcctgcctcagcctccccagtagctgggactataggcacccgctaccaatgactggctaattgttttatctttagtagagacggggtatgccaggctggtctcgaactcctgacctcaagtgagccgcccaccttggcctcccaaagtgctgggattacaggtgtgagccactgcactcgactgtaataataacttttattttatttatttatttatttattattattttttgagacagagtttcactcttgttgctcaggctggagcacagtggcgcgatctcagctcactgcaacctctgtctcctgggttcaagtgactcccctgcctcagcctcccgaatagctgggattacaggcacgtgccaccgcgcccggctaattttgtatttttagtagagacagggtttctccacgttggtcaggctggtctcaaactcctgacctcaggtgatccgcccacctcagcctcccaaagtgatgggattacaggcgtgagccaccgcgccaggccaataataactttttttttttttaagacggagtctcactctgtcgccaggctggagtgcagtggcgcgatctaggctcactgcaacctccacctcccaggttcaaaacgattcttttgcctcagcatcccaagtagctgggattataggcgcgcgccaccacacccagctaatttttggtatttttagtagagatggcatttcaccatgttggccaggatggtctcaatctcttgacctcatgatctgcctgccttggcctctcaaagtggtgggtttacagacattagccattgaggaattgtgtgtatgaaaatagttctgttgatgcctctcgaaactacagtgcctttgactcttcccttttcctgagtactgtccgggggctttgttggtcatgccctagacccgagattttggcctttgaaagggttctgtggccaagagcatggcctcacagaatggagcagggcagtaggctggaggagtaaacaagttatttacaatggatgaaggcctattttgcctctttgtagctcttctctgcagggactgagccagagcaaacactagaccttggaaaatcctagcaggcccatctggtctgactgtctgagatactctcactctggctagtaacttccaccttgtccttcctaccagagatggccatcgtgagagatgctgactaaggactccttggctaatactttgtttttccttggactcttttaccaggacatcaatagcctcaacaaacaaattgctcagctccaggatttcgtgagagccaagggcagccagagtggccggcacctgcagacccactccaacaccattgtggtctccttgcaggtgggacctggggaggaagggagggaggcaaagaggaagaatgtggagccttctttggttgaccctctctccttttcttctagtcgaaactggcttctatgtccaatgacttcaaatcggttttagaagtgaggacagaggtgagaacaatctgcgtaggaggggtaggaatatgggagtaaagatccaagagggaaatgaagaagggacaagttctacagggtcatggggccaatggtgggagtctctttaacatgcctgctttctagtggcttcaggtcctttgcgtttttccccaaccccagaacctgaagcagcagaggagccggagagagcagttctcccgggcacctgtgtcagccctgccccttgcccctaaccacctgggtaagtcacaggtaaaacggggagccctgggaggtaaggttacttactctggttgtgatggcatcctctaaaggcacgggttgggtaggagagtggaaggtcaaggaattttctaggctttatctctcagaggccaaaccagatggttgagattcgtgatccacatttagactcccacattctcactgttggggtgaattcagttatattcagaataatgataatttctaattttttttcgtacactttattcacattctctcatttaattttcacaaccaccctttgagaaagcaactattattatcccccattttacaggtgaggaaactgaggctcagagaggttaaatgacctgtccagggtcacaaggctagtaagtgctagagctgggattcaaacccagagcatgtgggctttgaacctgcttttaactgttaaggtgtgccacatcctgttttctcccccaggcggtggtgctgtggttctgggggcagagtcccatgcctccaaggatgtcgccatcgacatgatggactctcggaccagccagcagctgcagctcattgacgagcaggtacccaggctctgaactaggtagaatcagcttctccattatcctctgtggttcccgagagagtgtttggagtgtgccatgggcagaatggcaagctgggagggttgtaaaaatgcaggtctgaccctgaagaagctgttggtgctcatgtgctctctccctctcctgaaggattcctacatccagagtcgggcagacaccatgcagaacattgagtcgacaattgttgagttgggctccatctttcagcagttggcacacatggttaaggaacaggaggaaaccattcagaggtgagatacactctctcgccccaaacagaggagctttctcttccccgtggattggcatcttaaagtccccagggactgcttgatgccttttggaagatagagtgaattctgcccacccatgggacccagttcacctgcttccatccacccaacaagtttttattgagcacctgttcatgtgaggcactgttccaggtgcgggagatacagtggcaagtagaacagtaaagtctgtctggagctgctttgtagcatgtgtaagtgtatggaatttgatagggcagatgaggacagctgtggaaaagaactgacaaggctggcacagtgactcacacctgtaatcccataggcagcactttgggaggccgagcaatgcagatcgcttgagttcaggaattcaagaccagtttgggcaacaaagcaagaccctgtctctacaaaaaaatacaaaaactagctgggcatggtggcatgggcctgtagtcccagctactcgagaggctgaggtgggaggatggcttgagcctgggaggcagaggttgcagtgagccaagatcgtgccactgcactccagcctgggtgacagagccagattctgtgtcaaaaaaataaaaataaaaaattgaccaacaaaatttcagggagtaataaaggctgtatacagagttaaaataggatgatgtgttaagaaagtaatggatgggtacggtggcttacacctgtaattccagcactttgggaggcccacacagtcagttgaactcaggagttcaagaccagcctgggcaacatggtgaaaccccatctctacaaaaataaaaaaattagctggacatggttgcgtgtgcctgtggttccagctactcgggaggctgaggcgggaggatgacttaagcatgggaggttgaggctgcagtgagccatgatggaaccactgcgctccagtctgagtgacagagcaagaccccatctcaaaaaaaaaaaagaaagtgactaagtaggtatatcagattgtgtggtagggaatgctgctctgaagacatgacatttaagcagagacttgaatgacaagagggatccaaccaggcaaagaacagagagtgttctaggccgaggagacagctagagcaaagccttgtgatgggacagtctcaccatagcaagaatcaagaaggcctgcgtggctagaaagtaatgaacagggatagagaagtacagggtgtactggagggatgtaggcagaggcccaacaatgggctggcctctctgttcctctggtgcctcctgctactacaagagtttttatctgctcctcctctgtggtgcttagcattcagtcagtcagttatgggaatatagcagtggacaaaagagacaaaatccttgcccttgtggaacgtgtatcctaatagggagatagatgtgaaaaagtcataataaatagtatgttaaaaaaaaaaaaggtcgtaaatgccaaaaaaaaaaaaaaagatagtcaacacaggataaactaatcaggagtgccaggtttggagggaggtaggccctattaagaaggtggcatcacacttgggagaaggtgaggaaattagctacatagaccctggcaaaggcccgcaggtgacaatatgtttgatgagttaaaggacagcagagactactgcagctgggatcaatgaggaagagagttgtacaaggtgtggtcagaggggaactgtgagacctcttgggaccattggtaggctttagcttttactctgagtgacatagggagccattgcaggggttagtttttctgtgtttgagacagagccttgctgtgtcgcccaggctggagtgcagtggcatgatcttggctcactgcaacctccacctcctaggttcaagtgattctcatgcctcagtctcccgagtacctgggaccacaggtgtgcaccgccatgcccggctactttttgtatttttagtagagacagagttttgccacattggccaggctggtcttggactcctggcctccagtaacctgtccaccttggcctcccaaagtgccgggattacaggtgtgagccatcacaactggccaaatacatttaactttatttatttatgcatgtatttatttatttatttttatttttgagatggagtctcactctgtcgctaggctggagtgcagtggcagaatctcggcccactgcaacctctgcctcctaggtccaagtgattctcctgcctcagcctcctgagtagctgggactgcaagtgcgtgagaccacgcccagctaatttttgtatttttagtggagacagggtttcaccatgttggccaggatggtcttaatctcttgatgtcatgatccgcccacttcagcttcccaaagtgctgggattacaggcatgagccaccatgcccggtgttaattttatttttatttatttatttacttttgaggtggagtttcactgttgtccaggctggagtgcaatggcacctctcgcctcactgcaccctccgagttcaagcaattctcctgcctcagcctcccgagtagctgggattacatgcacccacaccactcccagctaatttttgtatttttagcagagatggggtttcagcatgttggccaggctggtctcgacctcctgacctcaggcaatccgcccacttcggcctcccaaagtgctgggattacagatgtgagccactgcgcctggccacatttaactttaaaacaaaaagtataatagtgtatactctgggatttgtaaagtacatagatacaacaaatttaactgtagaataaaggatgaagcaagagggtttcaagattttgacaggtttttcttttttttgaaatggagtttcgctctgttgccaggctagagtacagtggctcgatctcaggtcactgcagcctccaccttccaggttcaagtaattctcctgcctgagcctcccgagtagttgggattataggtgcccaccaccatgcccaggtaatttttgtatttttagtagagacagggtttcaccatgttggccaggatggtctcgatttcttgaccttgtgatctgcctgcctcggcctcccagggtgctaggattacaggtgtgagccaccgcacctggcctattttgacagtttttatgaagtaggctgtgaaaagttaataaggtgtattttgtaatccctagagcaaccattgaaataaaacagaaactcaacaatgacatatagcaagaagagcagcaaccaaattgaaatggaaatagaattttaatcaaaatttcaattaattcaaaagaaggacaagagaggataaacagaggaacgaaaaatagaaaatagtgccgggtgcagtggctcacgcctgtaatcccaacactttgggaggccgaggcaggcggatcatgaggtcaggagatcgagaccatcctggctaacatggtgaaaccccgtctctactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaattttttccccattttttttttttttttttttttttttttttcagacagagtctcactctgttgcccaggctggagtacagtggcacgatctcggcttactgcaagctctgtctcctgggttcacaccattctcctgcctcagcctcctgagtagctgggactacaggcgcccaccaccatgcccggctaattttttttgtatttttagtagagacggggtttcaccgtgttagccaggatggtctcgatctcctgacctcgtgatccacctgcctcggcctcccaaagtgctgggattacaggcacgagccaccgcacccggcctcaccttcatttttgaaggatgttttctctggatatagaattctggatatacagttgttttttcttttttttaactttttatttattttttcctgagacagggtctcactctcttgcccatgctggagtgcagtggcacgatcatggctcactgcagccttgacctcccacctcagcctcctgagtagctggagctacaggcatacaccaccacaccaggctgattttttttttttttttttttttttcgggtaaaaacggggaatctcactttttgcccaggcaggtttcaaaatcccggggccaaaaaattttccaacttaaaccccccaagggcccgggttaaaaaaaattatttttttttttttttttttttttttctgagacagagtttttgctcttgttgcccaggctggagtgcagtggtgcgatctcggctcattgcagtctccacttcctggattcaagtgattcttgtgcctcagcttaccgagtagctgggattacaggcaaccactagcatacccagctaattttttttttgtatttttagtagaaatggggtttcactatgttggccaggctggttttgaactcctgacctcaagtgatcctcccacttccgcctcccaaaatgctgggatcacaggcatgagccacagcacctggccctatcatgtctttttttttttttttttttgagatggagtttcactcttgtcacccaggccagcatgcagtggtgcgatcttggctcactgcaacctctgcctcctggattcaagtgattctcctgcctcagcctcctgagtagctgggattacaggtgcccgccaccacgcctggctaattttttgtatttttaggagagatggggttttgccatgttgggcagtctggtctcgaactactgacctcaggtgatccgcccaccacgtgagccaccacacccagcctctgagtttcttttatgtgtaaatttgtctttaaatttaggaagtatttggctattattactttaaacatttttctgcctctttctgtccttaccatctggaaatatatacatatatatgtttccaggtacatgtcttatataataagtttatatttattttatgtatattttcaggtcaatctgctgttaagcccatttggtgaatttttttagataattttcagtttcaaatttacacttggttcttttttagagattatgtttctctgctgtgatttactaccttcttagtgagtacaagcatattttccctcagttataatagctgccttaaaatttaattctcatcatctggattatcctagggatggggccattcattgccttttctcttctgtatgggtcacagttccctgtttcattgtatatctactaattgaggattttatcgtacatgttattgatatgaagagtctggattatgttatgtttctataaagaatgttgacttttttgttttcgcaggcagttaacttggctgaactaagatcattgttttttatatttcctctgtggtttatgtaatttatggaatgattggtataataggaggtacccaggcattactggaagcagaacctcgaggattgagaaatagtcattggattcagcaatgtagatattgttggtgactttgagtcagattcaatagagggatggaagcaaaagctcgaatgcagtggcgtttaagagagaatgaagctagccatggtggctcttgcctgtaatcctagcactttgggaggctgaggcaggtggatcacttgaggccaggagttcaagaccaccctgggcaacatggtgaaaccccgtctccactaaaaatacaaaaaaattagctgggcatggtggcgtgtgcctgttatccccaggaggctgaggttgcagtgagccgagatcccgccactgcactccagcctgagtgacagagcaagactctgtctcaaaacagaaaaacaaacaaacaagaatgagagagagcaattagaaagagtaggaatagatgaatagacagctctttctttcttttttttgagacagagtcttgctgtgttgccaggctggagtgtagtggcgcaatctcggctcactgcaaccttcgcctcccaggttcaagcgattctctttcctcagcctcccgagtacagtcacgtaccagcacacccatacccagctaattcttcttttttttttttttttttttcagtaaaggcgggtttcaccatgttagccagggtggagaatggacagctctaagagttttgcttcaaaatggagaaaggaaatggagtaatagctgataggaggaagttattcagaagttttcttttttcgtttttttactatgaaaatttgggggttaggcaaagttaatcctagtgctctgggagttcaaggcgggaggattgcttgaggccagaagctcaggaccagcctaggcaacatagcaagaccctatctctccaagaaaatgaaaaattagcctggcatggtgacatgcctgtagtcctagctatttaggaggctcagcggagaagatcacttgagtctaggagtaggaggttacaataggctatgatggtgccattgtactacagcctgggcaatagagtgagaccgtatctctaaaaaattttttaaaataaaaattttaagtttaccagtaagttgaaagaaccataataaacactaatatagctgcaacctacattcaacagttaacagttggccagattagctttatctttatttttctgaaccatttcacagtaggttgccgatatcgtgacacttaatccttaaatattttaacatgcgtctcctaagaatacacaaattctttttaaaaaccacatccagtactcacttcagcaggacatatattaaaatttgaataatacagaggttagcatggcctctgcacatggatggcacaaatttgtgaagctttctgtattttttattacctgggtgatgagataatatgtataccaagccccaagacacgcaatttatttatagaaccaacctacacatgtacccctgaaactagaataaaatttaaaaattaaataaaaaaataaaaaccagactgggcgcggtggctcacacctgtaatcctagcacttcgggaggccaaagcgggcggatcacctgaggtcaggagtttgagaccagcctggccaacatggagaaaccccatctctactaaaaatacaaaaatcagctgggcatagtggtgcatgcctgtggtcccagctacttgggaggctgaggcaggagcagtgcttgaacctgggaggcagaggttgcagtgagccgagattgtgccactgcactccagcctgggcgacagagcgagactctgtctcaaaaaataaaaaaaaaaaaaccacgccgttatcctatctatgaaaattagcgatttcctaatattatgtattattcagtgagtgtcacaacagagtgatactctgtctcaaaaaataaaaaccacacccagttatgtctgtgaaaattaatgatttcctaatattatgtattatccagtgagtgttacgacagagcgatactctgtcctaaaaaataaaaaataaataaaataaaaaccacacccggttggctgggcatggtggctcatgcctgtaatcccagtactttgggaggccaaggcgggcggatcacaagctcaagagatcaagaccatcttggccaacatggtgaaaccccatctctactgaaaacagaaaaattaactgggcgtggtgctgcgtgcctgtagtcccagctactcgggaggctgaggcaggagaatcgcttgaacctgggaggtgtaggtttcagtgagccgagatcgtaccactgcactgcagcctggcaagagagcaagactccatctcaaaaaaaaaaaagacacccagttatcctatctgttagaattaactatttcctaatatgtgatatccagtgagggtttacattttcccagttgtccccaaactgtttaatagctttttaaatattaaatcagaaagccaggcatagtggctcacacctgtaatcccagcactctgggaggccgaggcaggcggatcacctgaggtcgggagctggagaccagcctgaccaacatggagcaaccccgtttctactaaaaacacaaaatttgctgagcgtggtggcgcatgcaggaaaatcacctgaacccgggaggcagcggttgcggtgagccaagattgcgccattacactccagcctgggcaacgagcgaaactccatctcaaaaaaaaaaaaaaaattagctgagcgtggtggcacctgcctgtaatcccaactatttggcatgctgaggcaggagaatctcttgaacctgggaggcggaagttgggtgagccgagatcacgccgttgcactccagcctgggcaacagagtgagactcttatctaaaaaaaaaaaaaggaagagtcccgggtgcggtggctcacacctgtaatcccagcactttgggaggcagaagtgggtggatcacctaaggtcgggagttcgagaccaggctgatcaacatggtgaaacccatctctgccaaaaatacaaaattagggcgtggtggtgcatgcctgtaatgctagctacttgggaggctgaggcactaaaatcacttgaacccaggaggtggaggttgcaatgagccaaggttgtgccattgcacttcatcctgagcaacaagagcgaaactccatctcaagtaaattaattaaattcttcctcttttctgagcatcgctataggctttaattataggttttaatgtattggttgtcttattattagttagggcaatgattattgtgagtgctcaagttgttccaaatatgtctggtgggagcctagagggtttaaaaggctgagagaaaataaaggtatgttagcatgccaatggaaatgatgcaacggataaatttaaaaatgataatataggagaaagatgggagaattcttgaaatgatgtccttgagaaggtgaaaggaagtgggctccggggcataaatcaaggcttggctctaagaggagctggcgataggtgggaagacagaggctattgtagcaatgctcggggtggagcggcatttatcttcagaccacttcagtcttctcagctcattaagaagaaaagccagtagaggagaggaggtgtaggaggttttaggaatccactcctgcccacttgatcttatccctttagcagggtccaaccctgattgatctttattccccacggtatctagcagagtgcttttactctacgttgttgatcatgtgaaactgagtgaacacctacatttgtataaagccggtttctgaacatcaatccactaagcagcctcacacatttaactggccaaggtaaaagaaaacacttggagattctgattcgagagatgtgaatggagtgggcttttcagggagcttcatttttacaaattccatagggggttctgatgagcatccaggtttgggaactactgattaaaagaaagtttgtttattcaactactatatgttgagcaccagccatttataaggtaccgtgagtacagctgtcttgatcctagagtcaggagaattgactgattttttttgttgttgtttgtttgagacagtctcactctgtcacccaggctgcagtgcagtggcattatcttggctcactgcaaccccttcctcccaggttcaagtgattctcctgcctcagcctcccgagtagctgggattacaggcatgcgccaccatgcccgggtaataattggccgattttttttttttttttttttgagacggagtctcactctgccacccaggctggagtgcagtggcaacctccgcctcctgggttcaaatgattcttctgcctcagcctcccaagtagctgggactacaggcacgagccaccatgtccggataatttttgtatttttagtagagatggggtgtcaccatattggccaggctggtcttgaactcctagacctcgtgatccgcccacctcggcctcccaaagtgctgggattacaggcgtgagccaccgcacccggcctaattgatttttatctatttcagctgagacctagggaaccccttgcagaattatgccataaacaccatagctccctgagctatgttgtattttgaatattagaatattaagtctgggcgtggtggctcacgcctgtaatctcagctctttgggaggcgagacaggcgaatcacgaggtcaggagatcgagaccatcctggctaacacggtgaaaccccatctctactaaaaaaaatacaaaaaaattagccgggtgtggtgaccggcgcctgtagtcccagctactagggaggctgaggcaggagaatggcgtgaacccaggaggcggagcttgcagtgagcccagatcacgccacacgccactgcactccaacctgggcaacagagtgagacaccgtttccaaaaaaaagaatattatagagtcagtgaaacagaattataaaagatatggagggccaggcgcagtggctcatgcctgtaatcccagcactttgggaggccgaggcgggcggaccacctgaggtccagagtttgaaaccagcctgaccaacatggagaaaccctgtctctactaaaaatacaaaattagccaggcatggtggcgcatgcctgtaatcccagctactctggaggctgaggcaggagaatggtttgaacccgggaggcggaggttgctgtgagctgagatcgcaccattgcactccagcctgggcaacaagagcaaaactccatctcaaaaaaaaaaaaaaaaaaaaaggtatttgagttctttcctcaatccatatacatctaaaataaagttatagcatataggcaactttacattctagtcttccttgaaacagtgtcataagtatttttcactgttagcatgtgtttgctcattggtttagcaaacatttgttgctgctgtgagctaatcctgctgggtctgaggataaaagggtgaaagaccattctggtcctcctggagctcactagtaggagagacataagttgacagtgacagctcagtatgatagggcaagaagagaaggggatgaggctgggtgtggtggctcatccctgtaatcctagcactttgggaggccgaggcagattacttgaggccagcagttcaagaaagcctgtgcaacacagagaccccgtgtctattaaaaaaaaaaaaaaagggatgagagaactcagagtaggtactgctcctagatggggccaaggggccttcccagaagtgataccaagctaagacttggagggaatgccagcccaaaaaggggaaaggagaagctgttccatgtgaggaaaaaacagcacagaaatgagaaagaacttggtagatacaggagtgcagaattattcagcatggctgggggagtggtgagaggcaaggccaggtcacagataacctgtgtgtcacagcaagaaatttggtgtcagggagagaacataagaagaagcaagcggattgatgctgggtgagaattaggtttgttctgggtgtgctgagtgcctcagacttcatgggacagctaaatgacagagtttagtaggcatttcatgttctgatgtttggaagagaaggcagtgctagaggtaaggacttaggacagtggcctcttggtgaaaccctgggcatagaccacccagagactgggtaaagtgaaaaaaaggtcaggacagatcccccatggagtcagggggtatgtagagaagggaagaatctggccagactgaggaggaaggttgaggaagatgagagaagaaagcagagagagaaatgtgtccttagaacttgggatagaagaattttaaggagtggttatttctccttgctcctgagaaagaaagttcgaggtaaggatgtgtttgagtcaggaggggcttgaattaattggatcagtgccagtattttcagtggaatggctcagtagcaattttacagtatgttggagcataaaagaaataaggaagtagaatttatgggcaaccatatacaaaataaatttatgaaaggatgccatctttaaaataggtgtagacattcatatgcttcctccctgcatgccagtggatctgggtttcagcacttgctctagaaaccactgattaagtctgaagttttttgggatgcagattcttgggccccaacctagaatttctggttgtgacacttgagaatttttatatttgagaattcaacaggtgattcttatttttcctaaggtgtgaaaaccactgatctaatgttgctcagtcattttccttttcacctcataaaatattcaaactacagaaaagttgggaggatagcacaataaacactcatattcccttcacctgtagtcactaactttttttgttttcatatttgtttttttcttttcttttgagacaaggtgacactctgtcactcaggctatagtgcagtagcgcaataatggctcactgcagcctcaaactcctgggcacaagtgatccccccacctcagcctccccagtagctgggataacaggtacatgccaccatgtccagctaatttttaaatttttttgtagagacagagtctcctatattccccaggctgttcttgaactcctgaactcaagcaatccagccaccttggcttcccaaagtgctgggattacaggcgttggccagatctggccaccaattgttaacattttgtcactttttttctttttctttcttttttttttttttttttgagatggagtcttgctctgtcacccaggttggagtgcagtggtgcgagatctcagctcactgcaatctccgcctcccgggttcaagtggttctcctgcctcagcctcctgagtagctggggttacaggtgcacgtcaccacatccagctaatttttgtatttttagtagagacaggttttcactatgttggtcaggcgggtctcaaacccctgaacttgtgatccgcccacctcagcctcccagagtgctgggattatcggcgtgagccaccacattcagcctttcccctctttcttttgccgaattatttgaaagtaggtgcaaatttcatgctgttttatccctagatactacagcatgctaataataaggcattctcctgaacagccataatgtctttttttttttttttttttttgagacagagtcttgctctgtttcccaggctggagtgcaatggtgcgatctccactcactgcaagctctgcctcccaggttcacaccattctcctgcctcagcctcctgagtagctgggactacaggcgcccgccaccacgcctggctaattttttgtatttttagtagagacggggtttcaccgtgttagtcaggatggtctccatctcctgacctcgtgatgcacccacctcggcctcccaaagtgctgggattacaggtgtgagccaccacgccctgcccataatgtcattttcaaactaagaaaattaacagttctccaacatgatccagtaatcagcccatgttcaagtttccccatctgatttttttttttttttttttttgagacggagtctcgctctgtcacccaggctggagtgcagtggcacgatctcggctcactgcaagctccacctcctgggttcaagccattctcctgcctcagcctcccgaatagccgggactacaggtgcccgccaccatgcccggctaattttttgtatttttagtagagacagtgtttcaccatgttagcctgaatggtctcaatctcctgacttcgtgatcggcctgcctcggcctcccaaagtgctgggattacaggtgtgagccaccatgtccggcccccatttgatatttaaaacaaaagtttttatcttttttctttcaatttaagacccaggaagattcacattttgtatttgatgtgtgtcttcagtgggccttttgttttatttttcatgacatcaacttgttttgttcaatgttaaattaaatctaacactgattaaattagtgctgcgatgattacattagtaggcacttgatgaggttatcccttttattgctgatgtcaatttaatcacttgttcaaggtgctaactatcagattaagcacactcatcccttggtattgtggggcattggctccaagagccccagaggaaaccaaaatccatgcatccgcaagtcccataaaatcttgtcatatttgcatgtaatctactcacatcctccaatatacttatttattattatttttttagtagagacaagtgtcttaccatgttgttcaagctggtctccaactcctaggctcaagtgatcctcctgcctgggcctaccaaagtgctgggattacagcctggccaaaactagggtccatatacctttttttttggtgtttttttttttttttccccctgaggcagtcttgctatgtcacccatgctggagtgcagtggcacaatctcactgcagcatcaagctcctcaacctcctgggttcaagctatcctcccacctcagcctcccgagtagctgggactgtagggtcacaccagcacacccagctaatttttgtattttttgcagagatggggttttgccatgttgcctaggctggtctcaaactcgtgagctcaagccatctgcccacctcagcctcccaaagtgctgggattactggcctgagccaccatggttggccatagagctttttttatcccctgatttcctgtccgtgtcattatgttttcctttttcactcagaaccatgatttcctgactgcaatggtctgtgaacatttttccccttacaataaatataatacatactcaccagataaaaatgtaaatactgatgaggaaaaattgtaactaacattttcggggctcttgtgggttagggactttatactaactcattgaagacagacagtagcctgagagaaggtagggtttgggttatcctcattttgccggtgaggaaaatgaagcttgaagttagactaacttagagtcttaagctaataaatggcagagttggttttcaaaccagaaataacttgtttatagtacccttccaaagccttttctatacacaaatatatataagaatgggatcatattgtgaccatctttccatgtcaataaatggacttcaacagcattctttttaatccagtgtccttttgtttcctcttctcccggccttgtccccaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcactagccatgtcatcatttctgggtgggagcgtcgaagggcctaggcagcgagtggagagagcccactgcccagtaccagaactgaaagggttgggctaatggctctgccaggtatcactgctgacacaggctattttgggctctgacacacagctgcctctaggcaggggagaaccaagtgttgcaacacttcattagcgtggaaacttcctttcacacaggggagcaggatcccagagggggtccctgattgggggcaacttccaggactatctcaagcagtgtttggacctgtttcatctgtatcctccaactatttggccgtaattcttccttgagctaagcgaggcagaagctctgcctgcttccaggagtggaaggtgaagaatttgttcccaactccagttgaggcttttgattccctccaagcacttcaccaaatcaaagccagtcacagagaatggagacacctgcccagaatacccaccgtccagggagattagtgtgctttgttcttcctgaccgagactcacaaccacattctgaggtcactcgagtgcccctgtctcatacattccaaaggaagttgaagctatagagacaacagtcaggggctggtggtggtgcttttgggggtctaggagagcccaaggccctgatattttaaaatgtcctcctcggcatctccagcaagttgccactgctggtgagcttcactgtctgccccgttgacacgatgggtttctagtaggggacgccattgatggaaggtctgtgaagacaatgctcgccaaacccctgacagatgtcgtatcatttgactcagcaactcagggcggggcggggtgggggaaattcataacacaaattcatttatttcacaaatacatgttgagtttttaccatgtgccaggcatagtacctgccgagtcaagccctcgaggaaaaaaagcccttaattagtcaacgttcgagctcacattctaattctcaacttcgtgatttgttaatccatcttataggcgaagaaagcgaggtatagacaaggagccgagctgaaacactggctagattccggtaggggtctgagccatcactcccacctggaggcgcggtctccattcctctgaagccctttgtgcggcccccttcctcactgagttctgggctgcggcggcagcactgtgctctagcactaactctgaagctgccagggcagcgtcagcggacagatgaaaaggtgcggggacatgctggctgccagccggggttccgcaagttcaggtcttgggcggggcgtggagggccaggccccgcccctcgaacgacggccttaagtgtgcgcacgcgcagggggccgcgctttctccgggcggcggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcggtaagtgctggtcttcgggtcgggaactggctatctggggcgcgggtgggcggcgccggcctaggcctcagcccccggggcgtgaggccgctaggggcccggcgtccgcggggagcggcgcgcggggggccgggcactcgaggtggacacccgagttgttgactcctggattcctgctggcatcctggtgttgggggacctgcggctcggagcggatggctcgggggtagggtgacgggattcctttgaactttgtgggtggttgatgcctgtcagttaggtttggcggcctgactcttcctttaatgtgagtgagtgccctgctcgtgggctgccctgatgccctattttttactgcgtccagtcggtcttgaactctcgggcctgggctttggcttaatattcgagacttacacatcaactggatattcta

SEQ ID NO: 14269 - DNA, 10106 bp, Human
gcaacagagtgagaccctgtctctaacaaaccaaccaaccaaccgacaaaacaacaaagaggccaggcacagcagctcacacctgtaatctcagcactttgggaggtagaggtgggtggatcacctgaggtcaggagttcaagaccagcctggccaacatggcaaaaccccatctctactaaaaatacaaaaaacattagccgggcatggtggcgcgcacctgtaatcccagctacttgggaggctgaggcaggagaatcgcttgaacccaggaggcagaggttgcagtaaaccaagatcacaccactgcactccagcctggggaacagtgcaagactgtctcaaaaacaaaaacaaaaacaacaaaaaacaaagaacaaaacaaaacaaaaaatatatgatggaaatggtatattcaaggctgagcaaaggggtctaaaaggcttgagtaaattaaataaacagggagctcagagtcctgtggcgcccaactctgttcctctgggttttctctttgacccatatatatggcctcatggagtgttcccagcaaccaacagataatggaggaaaggagtcaaactcaattcacagataagtcagtataatattttggtatcagctggaaacggaccactctattacagccccatttgggggtggcactgaataatagtgaatcctcccagggggcagaactaggagcagtataccgtgttgttccctctgtatgcagagagagagagagagagagatggactgaagtacagacatacaccaattcctaataagaggcaaatggcttggctggttggtcaaaggcatggatggaacaagattggaagattgggaataagcaggtgtgggttaggggcataagaatgaactctgaatgggcataaagcacctggatctctatgtctcatgttaatgctgaccagagatcatctgctgcagaggaggctctacagcccaatggccaggatgtcccatcctgtggatgtcagccagcctctaaacttagcctcactattgccttgcaatagacctatgagtgtccaaggtggtaaggatgggggttagaaatgagtccaacaacttgggctccctctcaccaaaactgatctggcaattgccaaaatatagccaatctgccagcagcaggtagcaatatggcaaaatttctcaatgagaatagccagccatctggtggcaggtcaattatttcagaccccttccacttgggagaaggcaatgattcatccttactggaatttctatgttctccaaatagaggttgcatttctgacccatagcacttcaagcatcaccatccaaaggctttaaagaatgctcagttcattacctagggccaggggacccatcttgaaactcaagatctatcatgatggccacatgaacacaggcttcactggtcttaccatatgcccatgacccagaagcagccagcctgagagaacaatggaacaaagtgacttaatttccaaagttctgggggtttataaacagcatatggtatgtcacatgactactgtgggattggaaaaagatcatgtaaatagagcactttgcacagaccctggcatgcagcaagtgctcaataaatgataggtgttgtttactaattggactgaatggtgaaaggcctgtgtgccccagggggagctggtgatcaggcttcactaagcccagtatggccgtggctctcatcatagtgtgacatgctttgaatacccttagcggctccaaaagtcctcagcttgaagtgcatttttctgccagcaggcagcacacaaatgttcccgctgggcggagctgggagagaggggaaaatgaaactctgcagagtgcaggagctgggagagaggggaaaatgaaactgcagagtgcagaaatagaaactccgacagggattggctgcctagggtgagacgtgggaggatccacaagtgatgataaaaagccagccttcagccggagaaccgtttactcgctgctgtgcccatctatcagcaggctccgggctgaagattgcttctcttctctcctccaaggtaaactcaggagctatgaagtgtgggcatcaagctgccaccctctgccaggctgcctgtctgcctgtaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagttaagttgcctttgctgctcaaaggactggatgattttagaatcccctttattataggatccaatgtgacagtgagttcatctttaaggatagatgaagccatctggagtggttgttaaaaatgtgggcttggtggccaggcgtggtggttcacgcctgtaatcccagcactttgggaggccgagacccacggatcacgaggtcaggagatcgagaccatcctggctaacacagtgaaaccctgtctctactaaaaatacaaaaaaaattagccgggcttggtggtgggcgcctgtagtctcagctactcgggaggctgaggcaggcaggagaatggcatgaacctgggaggtggagcttgcagtgagatgagattgcgccactgcactccagcctgggcgacagagaaagactccatctcaaaaaaaaaaaaaaaaaaatgtgggcttgggtattagccaattgtgggtttaaaccctgactttgccatgacctggctaggcagccttgggaatattacttaacctctctgagcttcagtttccttatctataacatgtggttgataacaatggtacctacttcgtggtgttgttataggtacaagtggactgcgtgccataaagtgctaagtactcaatacatgagaggagtttcttgtttttctttttaacttaagaaaatagcattgatctgacaaagatcatattagaggtgagtctgagggcatatgcattttccagttttgtggtataaaggaaagagcataggttcatgaattctgactgtcttgaatgtgtacccatgttgcacaatttgctgtgtgacctttatcccttgtgatattgtaaaatatattttttcatcccccagttcctggcatacaactcctaaaatccttggaatcttcaaagtgataaatatcttttgagtgataactgtctaataagttgactgatggctggcatttcctctggggaggggagaggggctgaaggttaagctgattaccaatgggcagtgatttaatcagtcatgcctatgtaatgaagcctccataaaaacacaaaaggacagggtttgacaagcttccagatagccgaatacaaggaggtctccagtgggtggtgcttctggagaggaatggaaactccatgccctttctcccataccttgccctatgcatctcttcatctggagcatttgtaatatccataaggaaccagtaaatgtagctgggtatggtggctgatgcctgtaatctcagcactttgggaggctgaggcaggcagattgcgtgagttcaggagttcaagatcagcctgggcaacatggtgaaaccccatctcaaaaaaaaaaaaaaaaattagttgggcgtggtggtgcatacctgtagtcccagctatgctggaggctgaggtgggaggatcacttgagcctgggaggcgaaggtctcagtgagctgagatggggccactgcactccagcctgagcaatagagtgagaccctgtctcaaaacaacaacaagatcaattttttttttttaaagaaagaaaccagtatatgtaagtaaagtgtttccctgagttctgtgagctgctctagcaaattagtaaaactgcaggagggaattgtgggaaccccagtttatagtcagtcagaaacacaggtaaaacaacctagggctttcgattggcagtctgggggactgaaccctcaacatgtgggatcggccactatctacccatagtggtgtcagaattgaatttggggaccctcagctggtgttcaccagaggactgattgtttgcttgctggtggggagaaacccccacacttctgctgtcagaagcctctcgtacggtgagggaaactgagtttctttttccacacacccttctgtgctttctttctgaaaaaaaaattaagttgatgtgaggccaacgtttggtgccagtagatattcaatgcattgtaagaatgagtttgtcttaaaaatttttttaaagcaaattctatgcgtcaggcactgttcaaagtgccggggatacagcgtggaacagttattaaattaacaagtaccctctgaaatagactctattaataccccaattttagaaataaacaaactgaagcccagagaagcaaagtaccctagtatcctgcccaaggtcacttgggtacaaggccaagaacaaccacagtcatgatattgacatctgcggagcttaccacgtgccaaacaccgtgcgaatccgcacagaatccgcacacccaccggttggggcagggacatctctgccactgatgcggagaggaaacggattcccgaggctcctgagagggatcctgggttccattcaccacacctcgctgctttttactgattcagttggaactggaagggaaaacaacggagctgatgagctccaaaaatgctccggggaccatctccctctcgcccgttcgcaggtctagtgacggagcccgcgcgcggcgccaccatgcggcagaaggcggtatcgcttttcttgtgctacctgctgctcttcacttgcagtggggtggaggcaggtgagaatgcgggtaaggatgcaggtaaggggacaggtaagggtgcaggtaaggatgcaagtaagggtgcaggtaaggatgcgggtaaggatgcaggtaaagatgcgggtaaggatgcaggtaaggatgcgggtaaggatgcaggtaagggtgcaggtaaggatgcgggtaaggatgcaggtaaggatgcaggtaagggtgcaggtaaggatgcaggtaaggatgtgggtaaggatgcaggtaagggtgcaggtaagggaacagataagggtgcaggtaaggggacaagtaaggaggcatataagggtgctgggggatgggaggagtgtgggataaaggagagagtttcagggtccggggtgtagagggtctggcgtgcttctgtagagaccctggcgtccattccaatggacagcgcagggttggtgtcgccagagtcccagattcaaatcccactactctgttcattcctccatcctaccgaaatttactcgatgctagttctgtgccaggctcggcgcctaggggaaagtcccttcccctctgtgaggctctctgagtaggagagtggtggcccccgcctccaggagtggtcctgagcatcagacacagagtaggggacccctgtgtcccaccccaacaaccccactacgctttgtctgctctcctgcaggtaagaaaaagtgctcggagagctcggacagcggctccgggttctggaaggccctgaccttcatggccgtcggaggaggtgggtctggagggcgaggatctcgggcaggcggggcgggcctctgccgcggacgctccctcacctgctcctgttcctccaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggtgagtgcggggcctgggcccctggtgggacgttctttactattattttcatcatacatctggggaaactgaggcactcaggaattaagtaatttactcaagtaattaagtagtttaccaggaattaagtgattctttatttatttattttgagacagagtctggctgtgtcacccaggcaggctgaagtgcagtggtgtgatcttggctcactgcaacctctgcctccctggctcaagcgattttcctgccacagcctcccaagtagctgggattacaggcacacgccaccacgcccggctaatttttgtatttttagtagagatggggtttcaccatgttggccaggctggcctcaaactcctgacctcagctgatccgcccgcctcggcgtcccatagtgctaggattacaggcgtgagtcaccgcgtccggccagaaattaagtaacttactcaagtctccctgctagtttagaccagagcctagattctgacccagtcagtacaatgcgagaagccccattctcagcctcaaaggctgggtgcctcactgatgctttggccaaatcacaagcctcagttccctcagcggtgcgtggggatgatcatcctcagtttaacattttttgaatctgctcaatctcagagaccacagtagcaaagaaacatagtagagtaactcaaatcaatctcacaccaaactggtcttgacttgcactttttgaacaccatggagggaacagataacagagctcacagtgactcttctatcgattgatcaatctattgatctatttattatagataaaggtcaaaacaaggtctcacactgccaggttggaatgcagtgcatgatcacagctcacagcagcctcgaactcccaggttcaagctatcttcctgcctcagattcccaagtagctgggactataggcgcataccgccacacactggcttttttttttttttttttttttttttttgtagagacggggtctcattgtgttgcccaggatggtcttgaattcctgggctcaagcaatcctcccactttggcctcccaaagtgttgagactgcaagcatgagccactgtgctggcccagagtgactcataaaaaatggccttacttccctctctctcctctctccccacccacccccacctctctctcgcgctctgaggcctccaaaatcctggagaaaacctgcccctgacaaacttccctctctgcctttctgaacctcgcatcttctcttctctcaattctgaatggcaaaagcccaaagaaccagcccaaaagaagagagccctgctcagacggggccacacccctgcaatgggaggggaagagtgtgggcgagcccagggacacctctgggctatcagctagttgtcctctcacatggcacatagctgtgacaagatgaaatgatccctggcttgtgaaccccccacacccacacagggctccatgaaggtggctgttagcatgattaataacatggcgtttccatggcagacatcaggtgaaggagccattatttttgcctttttcatcactgaaacacatctctgatttgggatgtcaaggcaaggtaaaaatgggactcactttgtagtagtgccatcccctctcagggcctctgtttctccatctagacataaggggttggactcaaccaatggtttccagacatttggattcccaggcctggcacttgggccccagtgactcatctgtgtttgctttacaggggctggtggcagcagcgtcgtcataggtaatattggtgccctgatgggctacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactttgtcctgctgtcaatcatgtttgcagtgagaagcccaaaacaatctggctctggcctgcaccatccacacacccccattcccattttcccctcgagtcaaccacagctcctggaacacaaccagttgattttgtttctgggccttagcacatgttggtctctacctggatgccttcagaagctcatctgcctgaaaaactcccttccatccttccagactcagttcagacatcccctcctctggactcctgcctagcaggtcctcctgtataaatggacaggctcgattccacagggtgcttggggaggcagaactcagtttgttctcactgagagaagcttccaggtacttctctgattaggcagagatggagaagccaggtctccgttctctcaagaagcgctagtgatcaccctcagatggagaataaaggccagcccttcgctctggggaaagggcgtaacagcagcttttcgagggctcggcaaggtccccctttcctcataggactctggggatagggagaacagtttgcatatggaattcacagcccttctgaataggaaggagaagacaacccaagcacataggaagcattccgtaaatgtcagttatgattgatgaaggacttgcataaaacaaagagggaacagccaagtgacaaccaggaattagctcatctgactttggagtcagggtttactctctggggctcacagaccatattcttcctttcttccaaagttggcaccaaactagggtctctgcccttagaagaagccccctccacttattcccttggacaacatcaaggccagagagatgggcagccctgccccaggattttagatctgaggcctcagcagtcctcaggctgaatgacactggaaatgaccagttctttatgggagactccaccttccccaggatcccttgggaccggcctgcgcaggataactccttgccttcattctgtaagtgatggcaggggcaaaggacaccacagcggatgggacccagttcctacctacttgaggctcacgatgcacaaatgaggaccccaccttttccttccctgtcaccacctccccgcccccatctcctttcacccaccctcacccttgccagggaccacaatccttgccagggaccacaatcatcctatctgcaaagcctgtggcagaagggtgaacacacaccagaattcaccatcgcgagtcgagagatgctcaacacacttttaattaattatttttcttgagacagagtctcactctgctgcgcaggctggagtgcagtggcgtgatcttggctcactgcagcttctgcctcccaggttcaagcgattctcctgcctcagtctcccaagtagctgggattacagacacctgccaccgcccccagctaatttttgtagttttagtacagaaggggtttcgccacattggccaagttagttttgaactcctgacctcaggtgatccgcctgaggatcactcccaaagtgctgggattacagacgtgagccaccgcacctggcctcaatgcacttttagatgcctccctggcagcaaccttcagagagacacatggctgtgtccccgcccagctccagggctgagtcacctcagacaagttaagtactctcttggggtcccagcttccttgtttttgttgttgttgtttgagacgaagaatcttgctctgtcgcccaggctggagtgcagtggtgagatctcagctcactgcaacctccacctcctgggttcaagcaattcttgtgcctcggcctctcaagtagctgggattataggtgtgtgccaccacgcccggctaatttttgtatttttagtagagacggggtttcaccatgttggctaggctggtctcgaactcctgacctcaagtgatctgcccacctcgacctccaaaagtgcagggattacaggcgtgatccgctgcactcggccttctttgttttcaaaactagggct

SEQ ID NO: 14270 - DNA, 10106 bp, Human; identical to SEQ ID NO: 14269

SEQ ID NO: 14271 - DNA, 10106 bp, Human; identical to SEQ ID NO: 14269

SEQ ID NO: 14272 - DNA, 4487 bp, Human
aatgaaccataggttcccttctacccataccattttataattgagtgatgactgaatttattttgatgcgactttttctccacatatgttttaaactcacacttactgctattgtttatgttcttagaatagttttaaatgaattttacccaaagataggaaattgctaatttagtcatgtttttttttctcagcatactttcttaatttcagttttgtttgtttgttttgtttttgagacggagttttgctcttgttgcccaggctggagtgcagagtgcaatggtgcaatctcggctcactgcaacccccacctccctggttcaagcgattctcctgcctcagcctcccaagtagctgggattacaggcatgcaccaccacgtctggctaatctgttgaatttttagtagagacagggtttcttcatgttggtcaggcaggtgtcgaactcccgaactcaggtgatctgcccggctcagccttccaaagtgctgtgattacaggcatgagccaccgtgccaggccagtttttattttcgagtatgttttggttcataataaaaattatgaatttaccagatttctttaaaagattgatgatacacaatccttactaaatcttttgtgtgacaatctatagatacctacaataatgccttgcacttaaactgtgcccaactaggcagctctctcccacccctacaacactgctctcacccccctgacatgctctcacccctccaacgtatgccttcttgagaaaataaggaagacaatgacgaactaaggcactgtatccactcaattattaagtgtatccttggcactagctagctaagtgagttgggtccttccccaagttaggtaagtgcttgctaccatacacaggaaagaacacgcctctcttggcaatttaattcgtctgaggcagggcctaagtatccattttttaaagctcccccagtgattctaatgagcaataagggttgagaaatggaaaagcttgaggtatgtggcttttctaagcattcaatcttcccagcaatctggatatgggagagatgtgagattgggatgtttctcactggatcctggccccatcacaagtctactgcattttgggtattcaaatcccaaagtactcctatctcctgtactagcttgtaagctgctttcagagtaggttccttgcctcatacctcactgaatcccttacagcatctagcacatggcttaacaccttcatgcttcattaatcatcttcaggttaaaatagaaatgaatattgggaattctgatcttttcagcccaacttctgtaggtgttgggattaagtcaacagggaaaagatcaagttattttctgtatgaaataaattatattttgacccctggccacaaaagatcaatcacattttaaaaagtactgatgaatcttcagaaacaaggcaaaagttatcagttctcaggtgtctagaatatattatcttaaaaacaattacatcattacaggcccatttttctttttcaaatagttgtgtgaatgtttgcaaaggtataggcatttttagaataatactagcggtatttccatattattcagctattactatgttcctaaatggagaaagtcatgcaataaatattgaatgccaactatgtgcaaggcactctgctaggtggtacgtatacagcagtgacaggacagcttttatggaacctgcattctaacacacaacataactaattattcaattacattttaaatgagtgctatgaaagagaagtagagtgatttgaatatataacagatccaatttagccatggggtcaagaaagtgatatttgagctgactgttgaagaattcataagaattaactatgggaagagaagggacaacattctggcatagggacagcaagtgagaagatgccacagtcaaaaggaatgtgaagcctgcaagaaaagaaaagaagatcgatcaccgaagcgggagcggccaaaatgaagtttaatccctttgtgacttccgaccgaagcaagaatcgcaaaaggcatttcaacgcaccttcccacattcgaaggaagattatgtcttcccttctttccaaagagctgagacagaagtacaacgagcgatccatgcccatccgaaaggacgatgaagttcaggttgtacgaggacactatgaaggtcagcaaattggcaaagtggtccaggtttacaggaagaaatatgttatctacattgaatgggtgcagcgggaaaaggctaatggcacaactgtccacgtaggcattcactccagcaaggtggttatcactaggctaaaactggacaaagacagcaaaaagatccttgaacggaaagccaaatctcgccaagtaggaaaggaaaagggcaaatacaaggaagaaacaattgagaagatgcaggaataatcttatatacaagctttgattaaaacttgaaacaaaggagaaaaaaaagaagagccttatgactagagctccgagagtaaagagttggtaagagacaactctgggaaactagtccatccatcagtaggactttattaaagttttaggatatacctcaagaaataacaggaaaccttaaaagctaaggaagaacacagtctgacatatttttcaaacaccctgactacagtgagggggatagatacaattgggagtgggggaaaattgaagggaagagaccatcaggaaggatgtttaagtaatcaagataaagagattgtatctacaactagaggggtgacagtggagatgtagagaagtagccggttcaagaaatacttaaagctaaaatcaacgggacttggtaatcaagtggacataggagtgaaggaggaaaaggaataaaagctgatgcccagtcccctggcttggactactaggcaattgcatgctggtgcagttcatacaaggaacacatgaaaaggtctaccattgagggaaaagccacaaggacatttaattgatgataatatatagcaatggctctgttcctggcactgttctaggtgcaatggatatatcaacggtaagtaagatagatagataaataagctgattgatagatcgtagcaagtatgtgagatagattctatacattccctagtttacttagggtcccagggagttaagtaagttgctcagtcacacagttagtaagtgcacagtccctcaaccactgcattctgcatcctacttgtattgagtttgagtggatttatcaactagtggattcataggtctggaattaatagaagcctggattggaaaaattgttgcataagagaacataaggttacatttcagaattaagaacatttcttgattcaattgatccttggagaccaaacactctttctccggaataaaaaatgtgaaatggaacagattaatattggagctcttcccaaagtattttccgtttaattacaatgaggacatcaataccacaacacttcacctacagcaatttcccccctttacaggtatggtgtgggctcaagtaaacagatcccaatctcaagtttctcttataattagttctgtgcccttggaaaagttgctttagcagtgtgagactcagtttcttcatctattaaatgaggatttttttaaaaaaaactgcttttacacttactgtgatgattatatgatataacatagatactggactaggcactatatttaaaaactgttccctattatgctattgctctacatgatgaatatgttataacaaggctatcatataattatttgtcttattttacattaattgaattataatgcagttgtgatagaacataggctgaaaagagataaaacagtctccactcaaccttccatttttggcacctatccaagagccataaagccagaaaggaggatgttcaggagaatgaggaagtgtgtgtgactaccttaattcttacactcaaatattaagagcatttaaaattctttgtactaaaaaactggatacatattccacccacttaccaccacaaaaagaacttagagccatgaggcctgtactaacttgtaccacaccattgtatttgaactcttgcggaaacatcaacctttcacgtaggaggagcaagcaggatttgttaaagagaaaaagcaagagattctgcaggaacatcttaagtgcttttaaagcaaacatttgaatcacagcaacagaagctcacttttttaaattgaggcttttcattttacctttcattgcatggttattcaccagcatgctggaattacaaaattttcaagttcttatttaaatgcttgatcagtactatgaacccagtgctataagaatacaggcttttaaaaaatagaataaattccttaatatactaagccttgacaactgcaaagaattttgttaaaatgtactagcattttctccatttgaaatgggaaacacatgggaaaaaaaaa

SEQ ID NO: 14273 - DNA, 237510 bp, Human
  misc_feature (1)...(237510): n = A,T,C or G
cctttaggattatattggtagctagtaatggaaaattaaaaacttaaaaaagagaacaaggccaggtgcggtggctcacacctgtaatccaaatacttgagaaggctgaaaccagtaggatcatgcgagcccaggagctcaaggctgcaatgagctatgatctcgccactgctctccagcctaacaacagagcaagaccctatctcataaaagagagagagagaaatagtcaattataaaataaaaattcgtatctatgtatatgtgttagcctcagccatgatctcctggaagtagatccaaaatctctggattttgattaagattttaataagaatcttatgcatctgagattattctattttcaattgtactttcactaaatatgtaactatgcataaccaactcacaaatcgtttgcatttctttcttttttttttttttttttttttttttgagacagagtttcgctcttgtagcccaggctggagtgcagtagcacaatcttggctcactgcaacctctgcctcccgggttcaagctattctcctgcctcagcctcccgactatctgggattacaggtgcctgccaccacacctgactaatttttatattttagtagagatgaggtttcttcatgttggccaggctggtctcgaactcctgacctcaagtgatccgcctgcctcggcctcccaaagtgctgggattacaggagtgggccaccacgcccagactaaatttcatttttaaaaaaatcttgtttgctggttatctccacgtctttgcaaattaaaaggtttttataagttcgtctactttcctgttaagaacgtgaagtgaatcctgtccaggcctctttacttatctatttctgccccaaatcatgcccattctttcctcagaaagcctgaaatcttaagttgtgcaggaaaattacaaagtctggaatatttttagaatggagaatattcgttcatttctactcctttagaataccttccttacatttgtaccttcacgtgttctaagaaaaatccaggaagggcaggttttagttcttcatatttcagaaggtggataaattaggatgtcaaatgccctgttaaagtttatttaactagtgaagaggatgagaactgatgtcttctgaattcacagctgtttgtattgattactttattaattattttggcatattttggaggtaaacaaatacttaaaataattgaatacattaataaaataaaatattctaattaaataagctaaataaagtaaaatatctaaacttataagttatgtttcattagcagcaccttgatatatatagtcaaccatgccacatttatagtgacttaaataattacccagcaagacaagtaaattattgatcagagtattgtttacaataaatgtgaaaaaagtgactggggtgaaaacttaccatcaataaataagattcaagaacaaattactgtaatatattcataacatcttagagtatcaatattatgaataatattacttataaccatttttaaagtcactagcattttgagtacatgttatcatttatcaacatttccaatacaaatattttatctctttcttccttttagaaaatacaaaatatttaaagtataaagcatgtatttcatcaagaattgtttcatacacgttttggtaagatatgggttaaaagttaaatctacacagcaaataattggctgtataaataactaatagatttgacagtatacatagtattgctggaatagaatgctattcagtaactatgtctggtcttaccttctggggaagaactcttcactcgctgtggttccataaatatttcatttaccaacacaaagcaatatgctaatgatggactatttacccagtgagcaggtgccacctctgatgttgtttcatctctgggatacctttgatgtgggagcagttaagccattttgaattgttctgtctttgcttccctcccctcacagcttcacctgaacctaaaatggtgagcgagagtcaccatgaggccctggcagccccgcctgtcaccactgtcgcgactgttctgccaagcaatgccacagagccagccagtcctggagaaggaaaggaagatgcattttctaagctgaaggagaagtttatgaatgagttgcataaaattccatgtgagtattctatattagtacttgagtaaaaataagtggttgaaaaataccccatccattggaaagaaagcagaactccgtttgatatactataaatttacatttaatttattactatgggaatgatagtatcccaatataaaatgaaatattcttggaaatggaatattcttcttgtctttaaatatacttcataaatgaaaatccagtttacaaaaaaaaaagtctgcagcttgtatttaatacaggtaggttgttttctttggtgtctgtttctctcaagaatattaatgtttatgggttctgttatatttattttggatttgcatttatgaaattatttcattgcaaagattgtttctgaacaatagctaaggtttgctttcccaatatcgcaggtttgattttctgtcattcatttgtcatcatttaaaaatcttattgttattttttaaagtttccttattgtcattaaaaaaaactgcacctaagtttatttggataagtatagcactaagtctaatcagtgacatttaagtttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaacttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtccattcatccactgataagacacttgggttgattccatgtcttggctattgtgaaaatttctgcaacaaacatgggagtgcagatatctgtttgtcatattgatttcatttctttggatacataccgggtagtaggattgctggatcatatggtagttctagttttaatttttaaagaaatctccatactgttttccatagtggttgtagtaatttacattcccaccaacagtgtgcaagggttcccttttctccacatcctcgccaacacttatatttgattttttgataatagccattctaacaggtttgaggtggtatttcattgtggctttaatttgcattgccttgataattagtggtattaagcattttttcatatttctgttgaccatttaaatgtcttcttttgagaaatgtctagtcaggtcgtttgcccttcttttgattggtttatttgttttcttgctgtttgaggtccttatatattttggatattaaccccttatcagatgtatagtttgcaaatattttctccccttctgtagattgcccctttattttgttgattgtttcctctcctgtgcagaagctatttagtttgatataatcccattcgtctatttgcttttattacctgtgctttttgggtcatatccaaaaagttattgtcaagaccatgtcataaaatttttatcctgcattttattctagattcataattttgaatcttatatttaaatctttaattcattttagttgatttttgtacatgttgtgagatagagtatagtttcattcttatgcatgtggatatccagttttcccaacaccatttactaaagaggctgttctttctccattgtgggttcttggctcttttgttgaaagtgagttggcagtaaatgtatggatttctttctgggttctctttctgtttcatcgtctatgtgtgtgtttttatgcttgtaccatgctgttttgattactatagctctatagtataaaactataactctgtactatatttcgaagtcaggtagtgtgttacctccagcaatgttctttttgctcaagattactttggctatttagggatttgtgtggttccatacaaatttttattttgtgaagaatgtaattggtattttgtagtgtctttgtctggcatttctatcagggcttttctggctttgtaaaatgagtttggaagtattccttcttccatttttggaagagtttgagaagaaacggtattagttcttcaaatgtttcatagagattagcaatgaagatataaggtcttcacttatgggagattttttattactgattcaatcttttgttcattactgatctattaagatactctatttcttcataattcaaccttggtaggttgtatgtatcaaggaacgtatccatgttttcttggttatccaatttgttggtatataattgttcataagagtcccatgagcctttgcatttctattgtatcagttgcaatatctccttttttgtttcttattttatttatttgagtcttctctcttttttctcttagctaggcttgctaaaggtttgtcaattttgtttaactttcaaaaatgcagttttgttgatcttttctgttgtttctgtagtctctatttcatttctttctgctctgatttttgttgtttccttcctttactaaatttgagcttagtttgtctttgtttttctaatttcttgaggttcaacattaggctatttatttaagatttttcttcctttgatggaatagacatttatttctataaaattccctcttagaactgcttttgctgtattgcataggttttgctatattgtgttttctttttcatttgtcttaagaaattttttgtcttcaagaaatgtttgtttcctttttcatttcttcagtgacccattatttattcaagagtatgttgtttaatttccatgtatttgtgcattttttctaaagtcccttctgtttttgatttctagttttatatcatggtcagaaaaaaataacttgatatagttttaatcttcttaagtttattaagacttattttgtggcctcacatacgatctattctgaggaatgtttcatgtgcagttgagaagaatgtgtattgtgtagctgttggacagaataatctgtatgtctgttgggctgattagatgcagattgtagtttaggtgatgtttccctactgatttcctgtctggatgatctgtccattactgaaaatggggtgttaagtcattattattgtattacagttgatctctcccttcaggtctattaatatttgctttacatatttaggtgctccaatgttaggtgcatatatgtttgcaattattatattctcttgctgaattttgaccatttttatcattatataatgacctttttatttctttttgcaacttttgcttttattttatttgatctgatacacatatatagttattcctgctctcttttggtttccatttgcattagatatcttttttcattcctttattctgtatgtccttacagatgaactgtagacagcatgtagctggatctttttaaaatccattcagtcattctatgccttttgattggagaatttaacctatttacatttaaagtaattatcaatacttactactgccatattattaattgttttgtagttattttgtacattgtttatttctctcttttctcccatgctgtcttcccttgtggctaaatgatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaatttttttgccttttagccttcatactgaagttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagtttttttcttcagcatgttttataatattccactctctcctggcctataaaatttctgttgagaagttggctgctggatgtattggaacttccttatatattatttgcttcttttctcttgctgctctcaggatcctcttttttgtctttgatccttgacaacttgagtatatgtcttggggtagtcttatttggaatgaatttaattggaggcctttgatttttctgtatctggatacttacatctttctccaggtttaagaaattttctgctactatttatttatttatttactttttttttcttttttcttttttcttttttttgatggagttttgcttgttacctagactgaggtgcagtggcacgatcttgcctcactgcaacctccacctcccaggttcaagcgattctcctgcctcagcctcccaagtagctaggattacaggtgtccaccaccatgcccagctaattttttgtatttttagtagagacagggtttcaccatgttggcccagctggtctcgaactcctgacctcgggtgatccacccaccttggcatcctaaagtgctgggattccaggcgtgagccactgcacctggcctgctttaaataagctccccactctttgtctctgtcttcttttttatctcctatggcttgattgtttgctctgttgatgctgtcccataaatcccatgagctttcttcatttcctctcattcttttttcttctctgactatttttaaataggctgtcttcaaaatcaaagattctttcttctgtttgaccagttctgctgttaataccctctactgcattttttttctttcattatatttttcttgactccacttttcatttcattcattgtatttcttagctccaagaatacttttttattatttaaacctctattaaatgtcttattctggtctcatattattttctcattttgttttcttgaagttcactgagcttccttagttatttggaattatttgtcaggcattttatacctctccatttatttacagtcagtcacttgcaccttagttttttcctttggtgatttgtttccctgattcttcttgatctttatgatcatgtatcaatgtctgtgcatttgaagaaataggcacttacttcagtcttcacagtcttcatagacaggctttgtctgtgaaagccctgcagtagggtgtggtgctagagtgcatcagaagcccaggacagttgcagccagcatggcatcgccagagcctggggcccactgtggcaggtgaagcactggagtgggcaagaagcctgaggcagatgcaaatggaaagacactaaggtgctctaacagctggatgcagctgaagccagtgcagtgctgccagaagcctagggcccactacagcaggtatggcactggggcagaccaaagcctgggacagctgtggccagcatggcacttccagaatctcagggcaactgtggccataagagtggtgccagaagcctgaggtccacaacagcaagcacagtactgggacagctgaagccaagggccactaatgctgcctgctgctgagggtgacctgaagcccaagacaactgataccaacccagtggcgatacataccagagatcgagtttgccatacgagcctgaagcctggggctttatggtccctcctggcaccagggcaagtttagaggctcagtcaccagtataggtcttgaatataaggccgtggtagtctgcctggtactgagttttactgtgcagttgcaatgctaggctccaaagcaaagtcctgtgctcgcttccctctctttcccccaagttgacagtatctctttctgcacctgtgctgcctggggctagggaaagagtgatgcaggtgttgtagaactgtccttcctatctcttcaatgcattttttcttagtattatgctactaccagttactgtgagctttcatgtggtttccttagctcttgtgaagttattttcatgcatggatagctgttcaaacttatgattttgtgggagatggtatctggagagtcctactcctccatcttactctgcctcagtccagttgcatataatttgaatcttaaactacaacttagtcttttttcttcaagtatgaatacttactatgtactaggcactttcccaaatgctgagaacaaatatttagcactcacagagcttatattctagtgaagaaaagaagttagaaattaataaagaggaaaatatatattaataaatgatgtaaggaaaaatataatagtgtaaatgtaatagggaaggggaaaagcataaaaggttgttattttggggatgaccagggctggtttccttcataaggagatctgaaggaagtggaggagaagctatcacaaaacctggcaaatagaaccaaggcccttaggtaagaatctacctggaagagcaagaagcccagtgtgccttaagtagattgaacgaggtggagactggcagaagataaatttgaatgtagcagaagccatgtcatgtggggccttgtcaattgttctaaagaacttagattttacactgagtgaaataaaatgcctttttgagcagaggtgtcccatgatctgacgggtggtttttttgttttgtttcattttttatttatttattattattattattattattattattagagacagagtttcactcttgttacccaggctggaatgcaatggcgtgatctcagctcactgcaacctccatctcctgggttcaagcgattcttctgcctcagcctcccaagtagctgggattacaggcatacaccaccacgcctggctaattttttgtatttttagtagagacgggatttctccatgttggtcaggctggtctcgaactcccgacctcaggtgatctgcctgccttggcctcccaaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttcaagttgatctaagacacacacttagcacagttgtcagtaattaccattcttagcaggaagacttgtaagccagtagagatgaagatggtccaatacatcgaacactagaatgggaaacacaaaatctcagttcttgtccttgctctgctgctgagttaatggactgatacacaaactccgggtacttttgatataactttgaggtcataactaccaggcataaaccaaatacatatattatgggtgcaaactttcacttaaggaatattttatcaaaatgtttacataggagaaatgtgttctagagaagcagagaaagcaatgaacaacataaatcaaattcatatcttggcttttaacaccatcttcctctctggaagaataaacaacatgagacacatggcaaggctgataagtataggattgaaatgctccccatatacgagcctaactcatttacccatttccttttggtctttgcccaatgttagcacctccccaaccacactatttaaaattgcaatccattcatctcaccccatctttgccagtatttcctgtcccccatccttgctttatttcccaccatattacttagcaatatctgaaatatcatgtattttattattttgttttaaattgctctagcttcttccaaaataatgtaagctctatgaaggcaatatgttgggtctgtttatgctcatgcctggcacatatgaggcactaaatacatatttgatgaatgagtggattaatgacaaccaatttaacttgtatcctgagccattcctcttagactttgaggccttaatatgctgacaaatttaagcatcttactatttaaatttccaacacttatgaaagcatcattttaatgcttgactgtgtcataaacattgaaaatgtaattgtttctttggtcacaactcctccatcttttagcctttctcactcagagccagctattactttattttttcctccctattcattagtaggaaagtaatcagctggaaaaaaattatctatgaaactctcctttcttttgcttctcttgggtaatctcatctttttccttcccaaaccattgtcttagtcctgtgtccctctattgggcactggaaatcagaccagataaacaatctgcttgtccatggagatttgcctttgaccagcaacctgaaataacagaatgtcaaagaatctgagtaccacccctaaaaaatattatgttgctagcactctccttgatttaacaggaagaaaaaagtaaggtaactaaaaccttaaagtggtatggtaaatcaatgttagaaaacactgcatcataaataaaagccatgccatttatttaaagtggtatgttaaatcaatgttagaaaacaaagcatcataaataaaagccatgccatttattaaaagtgtgtaatagtatgtattttacactttcattttaatccgtcataatttttcctgcctatataattgacatttctaataggatttatatgcaggaggcaatactaaacaaaaataaaacacatccttaaaatcaaattcctttaggactataagatatataaaggttatcacttttgacttggcataacatactgtgatgctaatgacgggtaacaaattagaatattaattgatttcagtctctgaactaaatcttggctatctggcagatgtgttttttgcaaaattgatagcaaacagctttactctgtcacttgaaattcccacttgtaagaagaggggtgtcacaatggcaaggagtgtgcatgtcattagttgggtaatctgcacagtccagcatgaaacatattcaaaccaaattgcctgatgatatcatccaggccttaatttttttaaattaaggcttaaattttttttaaaaaaaggagaaggaaatggtaaacgcttagcatttttatctttcaattcattcttcacactgttatctaaatgaagcagacaaggctttttagaattttttttattttgcaactttgattttaatatgactagggccatggttggtctgtaaagcatgaactcatgtcatctgaatagctgtgattaaggctttgatattcatgagcttcttgaagtagagtgcacctttctttaagcacagtagaaagtcaaatagccagaacttgactcttagtccagaataagagcaagtggattaggaatagttgtataatttatgcagaaatgttattggatagacagtttaattcagaaattaaaaatacaagctctagccatagactacaagagttcaaaccctagctccactgcatactggctttgtgaccttgggcatcttaattaatttttctgactatcagtttcctcctatataaaatggggatgaaaataatactcccatcatagggttgtttggtaaaggtgtcaatgcatgtgaagtcgttagcagagtgtctggcactgaataagcgctctataaatggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccatttttttttttttttggtcctataattttactttctctctccttcattccctttagcctacacacatgctcaagattcacatatctgaaaatgcctagcaaaattccatacatcgtaggttcttaaggataccagttttctacctttatgctctaaaaatttcttcccctactttacctctcccatcaagctatcattctgtctcctcccttcacatctctaccatacttatttaaaaacgtaatctggaccctgacatctgttttatcaactcccattaccaactcaattcctttcactctaatttccatcctttgcatactattaaaattgtttttactaaagtccccagatacttcccgatgtacaattacgagggttattacaaatattcagttgctcagatatttctgcattattatcactattggccttcatctactgaaaactcttgacttccaggaccactctcctttcttcctcttctttcctccccttctccttcactgactggtccttcttttgttatgatcttttctcccattaggtgttagaggtccttgttttctggggtttctcttttaatcctattccatgtttattctacatgctctttttgggcagtttcattcacctagccattcaaataaaaaaatctcactattattcttgactccttgagcgatttcaccacatattctgtacctgcattcaagttatgtgaactaccttgaacgtctctcaaaaccagccagcacttcactacaccactgtctcccctcatgattttctctcttcctggattccccttccccagtaccctaatacattgttggggttttttttgccattcaagagccagttcaagtgtcaacacttggatgagaggttccctcatttcccaaggcagaaatatatgagtcttctccaacctttcagagttcttcattcaaatctctcactgttttggttacctggggttttctgcctttctcactgaaatgtaaattagccaaaggcaggaccattttcttacacatcttcgtatcccccacatcttgaaagtgtctgacaccaaaggcattaatcaaatccagatctcttctcggcactgtgttgggatgaggaacaacagcaaagctgtccttccaatacatggggcagcctaaacggggaggaggagctgtttcctttgagactaggttaattactgctacaaacaactatttagatatcaaattacaaaaattaacattaaagcaaacagtgcggttcttgtgccatgctcggagaaactgtgatctagaaagcagtagttttcaaacctttttagccaaggattgctttgttcaaatgcagtattacatagatacttaaatgtataaggtcttattttatttcatcatcttctttagtttataattttagtttaattttgactcaaaatatagaaagtgtgtctgtgtgtgtactaccgtgtacgtgtgttttaagagttaccattaaaaacaatcctatggcagaaagttcacctaaagcagtagggttttttttattttttatttttttatttttttttagacagagttttgctttgtcgcccaggctggagtgcagtggcacaatcccggctcactacaacttccgcttcccgggttcaagcgattctcctgccttagtctcccaagtagctgggatttcaggcgctcaccaccatgcctggctaattttttgtatttttagtagagacggggtttcatcatattggccaggctggtctcaaactcctgacctcgggtgatccacccgcctcagcctcccaaaatgctagaattacaggcgtgagccaccacgcccagccaagcagtagttcttaatagagatggcactgctcctacaacacagtgtaaatattttgggggtcattttcagtatattaaaaaatgcaggaaactcctggcatttagagggcatggtcacaggaccctacacatcctgtaaagtgtgggacagtttcacagaatgaagaattgttctgaatcccacacaaatttcaaaagccccataggacatacatgtagatggaaaccctttctataattatctgaacctaaaactattttctgtataaacacaaagtgtttttgcatggctctcatatatgaatacatggaatagtctagtttgtattctaatgtccacctagcctttaatctccaattttcttgtgatttttaaaaagtcttctgattgtcttctctaaatctaaacatgctttttagtattacatagtttcaagcatttgattatttcattgtgtcttattgtatagttgcatctgaagatttttgtactgaaatagaattttttaaataaattactgtcatttctccattatattatagttgacaaattttattaattttaaaattatgtaggtaggtatgttatattcttatttacactttgagacagaaaaaaaggaatattataaaatatttgttatgaactggggtaatactgattttaaaaaacaaatgtgcagtaggactctatcaacattctctatttaaggtggaatgctaacaaaagtacattctactgatgctacatttcaggaaggctgtttatatgtctccttggattttgttttataaactagtgttgagggatttttataaacttccaaagcacaggtaatacagagtaacagtaagcacaaaaagccaccaagtaaattaaaatcgcaactaagtttctaaactttattcagctacattccattagcatttcaaagatattaagaaaacacacctgaggaaaatgaggggcttgaacaagattttggacctatatccaaaataattcaggaattactttgctgaaacaccatacgaatatactttaaaatagctttaacatctattttgtttttaccacgtagcaaaccacagactacattttcactaagcaaagcctgactacaaaaacaaatctacaaagatgacagaataagagaagctgggagactgctgtttctcctcactcatgactatgtagatctcttattgcattgctgatctgtcaggtttgtgctagtttctattaaattgagtaaagaatttagaagcagaaaccagagggaatgtatgagatataccattatatttttagtgcttggctttatttttgtttgttttgattttcctttataagaatactgtaataaagggatttgtacttgatatcttctgagtccacgtgtctccccagcctgtcttttgagtgaacctaggtaactttgaaataaagattaagaaaatattggcccattgaaagatttcctcactaagcaacactttcattgacactgctaccctggagaaatttcaaaaccacttgaaccctctccttttttctcttctctttcaagctgttttcacacatacaagtttttcttaaaaaaaaaagataatagtagacaacgaataatagaaatatatttgaactgataaatatgccattttctgaaagtagtttatatctgtccataaaaactcagaaaagagccaggatcttgggacaataaactataattgatttagtcatattgttcaatgccttgaaggtaaaatgttattttaatgtaaaaatataaaaaattaattatttaatgtaaaatgtaaaaaatttatttttgtaaggatttggatcagattattttaaatcagttaactattgcagtggatttaaaacactgctgttataatcacgcaaatattactacctaaattatttgttatacttcagtagcccaaaagtggtagcaatttatccataatgctgtcttaatcactcacagattcttagccaatattagcaactaaccgaggttcaggagaacattgtttgctatggtgagcatctatgaaatgaggtcatttgtagcatgagctgcaaagttggtcttcccaagttcaaaattctgactctaccattactagtgtgtgaccttgggcaaatgatataatttctctgtaaaataaagacaataatagtactttacctctgggaaggtgtgagcagtaaagtattcgtgtatataaagtgcttaaaacaatgtctggaatataatggtcacattcaaattccataagcttccactgcatatgtatagagcacctactatgtgcaagactgtatatgccataggaaggagttaaatcaaagcacataatttttctggacctcaacagcattacaactcagaacttttctgcgagaaggacttctaaattaaaatgtcttagcaggacagcgatggctctttatgatatggctcttgcatatgctctagcctcctcttcaactgttcgccctcacacagtttgctccagcacgacagttactaaatgtattatccatagtttttctttcttccaggtctttatacaaattgtctcctctgcctgaaattccttacttgccatagcttgtctacctagactccttctagttagccttcagaactctatttttctttaaagcttttccttttttctggtaccaacttcctaacccactattcctcagcaattctccctccataacaagtttatactttgcatatgtttataaattttacttttattattttgtatttacttgaggccaaggacacactgtcttttcatctttgtgtctccagttccagcacaaaatctggctcataggtaggcagaattattattctcctttagctcaaaggccctcatatcaagttatcaagaaagacttccaaagagctcttacgggaaaagggtgagaggacataataatcaaaggcgacattcactgtgaagctgaaccgaaggtaggcgaccttccagaaccattctgccatgccctctaccccactctactttacaatacatctttgctttttctctctccttttatttcttttctccctttcctcgacctttctttaacattatcatcttctgttccctttctttcctccttgcccctgctgatttaaaatgttcattgtttatttttttctctacctgtctcgtggcagccccatctaattcagagtcaagatgcaagcagccaccaaattggtcctccagctaaacagtgtcctcacccccaagcatgtttattccaagtggagatcagggactcggtgatagcttcatctttttgttttaaaaataacgaattgtattgaaatgtccagaaaataagattagttcattttacatgatgattgttatctaacatagcccagtttcctgtgttttcactgagacagttcaaaagaaacctggatacactgttacagtggcttttcctccagtgggtacttgtgtgaggtttgctttgctgagtagctgtttatacgaaacttgtgtaggtttctgtgtttcaccctatcaggcacacaaagcacagcagttcctcttttcagctacattgtcgatatcaccacaaccgtggatatcatttgaagtggtgcttccacgtggcctggacagccatcttctgcccacagtgattggaactgttctgtcatctcacctttctacagctgctgtcattcatccacctttcttttccggatctgctaatgtggctctaatgcgatttacctggctgctttccaggccctcatcagtagtgaatctgttttgctattttgcattaagtagtcttaagcaccagtgctactgacgtgaaaggcaaggtacttccataaaagcttgaatgtaataatctaacagttgagccctgcataattttaccagtgctgcaattacaggaaaacatataggcagtttcccaaagtcagttgtgctgctgttatcttccattggagattgatgccgccttgcctctactctggattacttgatttggccattcccttaggcagggatagttggatccgtatgtacaaggcaccccacacaatgtatcttactgtttattgaaaatctcgtctcccttggcttctgatactcaattctctaattctctttctttccttctaacattctttctctctctctgtctcctccaattgcctacaggtgggtactctccaagcctctgcctctgacatttttctacctctatgatttatttataatttcaggatttccaatactatatgtaaatcacactcaaaactcagtcctcaaacttgatatctctgttgaactctcctcttttgttaaattaactttattgaagaatggtttacatacaataagatgcacccattgaaaatgtatagttctgtgcttttagtcatatacaagcaatgtaatcaccacccccaaaaattgcttctagttcctttctagcaatcgctgccctgctacctctagttatgggcagttattaatctgcttttctgttattacaaattagttataactgttccagcatttcactaaaatggaaccatgcacgtattctgtgtctgatttctttcacttagcacaatgtttttgcaattcatcttgcatgtttcagtagtccatttctttttattgctgagtagcatttcattgaatggatatccatgagttgcttatccatgtatttcttgatagacatttaggttatttctagtttggggctttttctttctttctttctttcttttttttttttttttgagatgaagtcttgctgtgtcaccaggctggagtgcagtggcgcaatcttggctcactgcaacctccgccttctgggttcaagcaattctcctgtctcagcctcctgagtagctgggactacaggcacatgccaccatgcccagctaatttttgtatttttagtagagatggggtttcaccatgttggctaggatggtctctttctcttggcttcgtgatccacccaccttggcctcccaaaatgctgggattacaggcgtgagccactgcgcccagcctagtttggggctcttaagaataaagttgcagtaaatatttttgggcaactctttaagaggacatatatttattatgttttcgtttctcttaggaagtgcctaagtatagaattactatgtctggtagtacagaagtatatttgtcttactttataaaaaagaactgccaatctgttttctaaagtggttttattatttatatctccacaggtgatatatgagagttctagttgctctacatccttgctaacacttggaattgtctagtctttttcattttagttactctagtatgtgtatagaatatatcattgtggttttaatgtgcaattccctggtaactcacaatggattgtagacctaaatgtaaaagttaaaactgtaaaacttctagaagaaaatatagacaataatttcatgaccttgatatagacaaagattttcttaacaggtcaccagaatcattaagtataaaagaaaaacttgataagttacggatttttcaaggagtcaagccttctgctttgtaaatataccattaagaaaataccaaaaacggctagtcacagaatgggagagaatattcatttcatatatagatataaatatatatgtaattaatatataaatatatataatgattatatataatgacatagaagtcatttccataatatatatattttaaaacttcttacaattcaatacaaatatgagcaaaatatttttaatagacactaaatcaaagaagatatgaatggctaagttcatgtaaacatgttcagcattcttagtaagaaaatataaaataacaatgaaatggatttttaaagctctcttctagatttgttcaactatatacccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtctgagccctcatctatattgtaagagtctcttaggaggtgttcccacaacgattttccatttatggccagcccatcgtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagatacgtgcttccatttcctgttgttttaccttagtctgtggtgttctcccatctgaaatgacattacccccatctctgtatagtcaaacctccctatcctaaaagactaagactcaattcaaatgctagctcttctataaagctcctgctgaataccagtattactcatttaatatacttttcatcttccaccaagtggtattactataagctcatatcttccttactagatttttaagaaaactgtagaggttgacccattcctacatagtgccaactacatgttatatgccctacaaggagaaaacagtcaacaaatgtttgtgtcatggataaacagcttgatgatgggatataaaatagaataagccatcattcttacaatctgataagagaaatagaatatgcatggaaacaataacaacgtagcatgtgatgcataataaaacttgtgagagacgtgtagaggagtcatcatagggtaatttggaattaggttagagaggtccatcaatatcaggctgaggttagactttatttaatagttaaagatgagccaggaaccattcaagatattcaaacacagaagtaacataattacagttttgtatcaatctggcagcagtgtgtgggtagaatggattgtgacgggggaacctggaaggagagaaaggcaggacagagagaactgaaggaacactagcgtgagataatgaaagactaaattgctagcaaaagcgcagatgtgacagactctgtgaacatgctgttgacaggtgctgtgtctgggtctgaaggtgtgtagaaaagagaaaatgaaatataatttcagagaagctgggtaaccattccagggttatgccctgtagggattggacaatacgagaaagagttgggcattagaaattgagatttctttgaccacatacaagtttaggttgcattaaataaagtggatatatgttattagtaagactacacagagggggaaaaaagacagaaatccagtgataaattcctaaaatacaaaactcatggaagagtaaagaagttgatgaagagataaatgagctgtcaaagactattgggtaaagtagaacagcagtgtgtcatggaagctaaattaagagagagtttcagagaaacaatagtcatttccatgtgaaagaatgttttttaaagtactgcttaaagtttggaagaaacaaacaatagggaggctctgagcttactccagctccagaagctgcccgttgaaaattttaaattaaaaaaaagaaataaaaatgattaaagcaggcaatctacccttatagtgttttcagtctaatggggcagaagtagcagacttcatcctcatcatcaccattcccatcattttccgagtgcttagtacaggccatcatctgtatattgaattataattttgctaaccctatacacttatgatcccaattttatagaggagtagaaagtctcaaagatgttatgcagaatacattttagtacagggtttaataaagtacatattaaagtgagatacaagtgagctaagatcaaaggaaatagaacttgtatgggaatgacagaaaaggagttaagaaagagataacctctagactgtgccttgaaccaaagaaggatttgcataaccagagagttggtaaaaagtcattccacactgaatgaggtatcatcagagttttgtggttaacagtgaggttggtgtgattgcttggtgtacaatatattgtatatcctacaacttactgtaggatacatttagtggtatggctggaagagaaagcatgtgaccccgttttctaagaacttttaatgccatcctaagcaggttttatgctgcaaactctaatcctttgtgggctttaaggaacaaagtatgacccaacttttttttctttttggaccattaaagaaatagctagacatataagcatccaggcatggcaaatgcttcagatatatcacagaagattatgcctgaaaagagggccagtggatttagagctctttgttgaccttggaaagccttgtttcattagagagctggaatcagaagccaagttgcagggtgcaggatgagaagttaagaagtgaggaaacagagtgagaatgtgaaagcggtgagcgtgaactgttctcttccataagaggacaagtagaattacagctcatgcacttaacaagatgcagggcaattgggtatgtgctgcggtagtgaaaagaaggagatgaaaataaataggttttcattaccaaaggcagagctaactctcctgcctacttccaaatgctaccacatatccacacccttgatgtcattactaatccctcatatatttgcagcagaagttgcttgtgaacctgggacagaaatgttgatggcaatccaactgataatcttgaatgtgagaaatccttttggatatattcatatggctaatttgctttgactataaagtgttgctgagacctcattaacaaatttgcgatatttcccctgcttctttgatcagagtctccctgtccttggaattctccataagcctcatgcatatagcacttgccaattttatttgtatgttctagttatttgccttattcttccaaattatcctatattctgtggtggcagaaattgatattttgtatgtactgctcctatacagcaggcactaaataattacttttggtttgaaataattttagatactatgtttccctattataaatatgtgtaaaaaattgacttgtagagatatcttagttttctattgctgcataaaagtttaccacaagctattcctctgcagaactaatagccctagtataaccatgagaaaaatatcagacaaatcccaatttagagacattttgaaaatacttgaccagtacttctcaaaactgtcaaggtcatcaagaataaagaaagtctgagaaactgtcacaaccaagagaagccaacggacacatgacaactaaatgtaatgtggtgtcctggaacagaaaaactcagaaaatctgaataaagtatggactttagttaacaataatgcatttacattggtccattcattctaataaatgtgccatattaatgtagaggttaataataggggaaactaggtatgaggtatatgagaaatctctgtacagtcttaacgtttctgtaaatctaaacctattctaaaaaaagtttgttaaaaacatttgctacaatattagtggcttaaaacaacacaacgtttattatctcacagtttacatgaattagaaatccaagcccagcctaacagtgtcctctgctcggtgtctcgcaaggctgccatcaaaatgtcaactagaccacagaagagggagtccaggcttttttccaagctctttcagactttttggcagaaattctgttccttgaaattacaggactgagaccctcagttcctaaagatgactctgccatatgcagtttacaacatgactgcttcttcaaggccagtggaacatctctctcacctcaggaagggcctagtcatgctttaagggcttgcaactgggctcacccaggacagtctcccttttgatgaactgaaatacaacctatttgggaatttaattacatctgcaaaatcctttcacctttgccacatagcacaatccattacagtcacggatctttcccatactcaaagagaaggcttacatagggcatgtatgcaggagagggtagagtcttgaaaaccatcttattaatagaattctgcttaccaaagatttggaaagagaatgaatgtatgacagagaacaaaagaattgttactttatgaaaaggcaatagattaccttttatctaaatagtgtcaattggcactactctattttttacaaaatttaaaggatttgaactgaaaagcatccttcttattctcattttcttctctccttctttttggtgtcattccattatagccactaaaatagtgtatttttgcagggttagcagcagcatggttattatagtggtgatatcttccagtgcagattctttagagtctgagcattgtttaaaaagaaaatgaaagctatatcagttcactattaattattctcagtctagtgaatccttcaaaggttatattttggtgatggtgatcagttcatatcaacaggttcaggaatgtctatttccaatctatgaaaacaacatagattccaggttggagacacggttccaattctaaacttttgcttaaaataaaaaaatgattaggaagaagtagagtttctgtgcttaatttgatctcagttgtacaacttgaaattatgagctagtatacatgggattggttattagaaattgctagcttgacacattcattttttaaaaagtaattatatattgcaaggtgttgatattgtcttttataagaaatatgcatctaaaaaatgtagaggagaatattttatttaaaaaagaaagggctgggcacaatggctcacacgtgtaatcccaacactttaggaggccacagcaggaggatagcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgagcaacagagtgaaaccctgtctcaaaacaaaaacaaaaacaaatggtaagtaaaattctgagattctagaaaaaagcgattcgtttactgaggaatgatttgtactggcaacttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtatttttagtacagatggggtttcgccatgttggccaggctggtctcgaactcctggcctcaggtgatcctcccaaagtgctgggattacaggcatgagccaccatgtccagcctacactgactttgaatgtgtttcccaaaacataaaaattcatgtttttataaagcataggaaaatgactaagtacaaaataattggtgttggtgaaaacagaaaaaaaatgtatctgcattaagaaattagaaatgtattttttaaactcaaaagtagataatgtgtgctgtgggtcgaatcatgtgccccatactgtatgttcaagtcctaacccttggtacctatctgcaaatgtgacttctttagaaatagatcactttttttttgaagatcgaatcaagttaaggtgaggtcataccgaagtaatgccttagaagagaagagaccagcatccttagaagagaagagagatacacagggagaacgccatgtggcaatggaggcagagattagagtgatacatctataagcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcgatgactttaccatctctgcccaggatcattgtcacccaccactcctgaaggagagaatgtcccttaacaagaagagggttatagagcggcttgggaagctagacttcatctacttatcatcttctcttgggctagttatgtctactttcgattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatatttttttaaatcatggcttctacacagaggtaaaacaatttcagaaattgaagatcagaaattgaagatagagagatttattaaccaagattattcaactgccaagtagcagggcaggattcaaaacttagccaaaactaagttcttgaaccaaccaggttgtctgctactacatactgcctcctcctcccaaaatgccagtggaagactgtgtgttatatttaatatgtaacttgtattgcacgtgtatataacttctatgtaactttacattgaaaattgtaccttgctgcttttttcctaaaatggtgtattagtcatttttatactgctatgaagaaatacccaagactgggtaatttataaagaaaaggagatttaatggactcacagtaccatatggctggagaagcctcacaatcatggcagaagatgaaggaggagaagaggcacatcttacatggcagcaggcaagagagcatgtgcaggggagctgccctttataaaaccatcagatcttgtgagacttatacactatcatgagaacagcaggggaaaaccagcccccatgattcaattacctcccatcgggtccctcccacaacatgtggggattatgggagctacaattcaagatgagatttgagtggggacacagtcgaaccatatcaaatagtctccaaaatgttcccattttatcattttttcatgtttgttttctttatgacttgttaaatagaatttcttaaattgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaacctaaagtcactccagagtggcagagttgtcactttaaagataggccttaatgtaatgctaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggagggaaggaaatacaggatgggggtggctaaattatacctaataaagcttagaatgtgatataaattttatgacatgaaaagcataatcctgtatactctatcataaagtaaaagaaagttgttatatattttacccagtttcataatgaactcttacaccacattttcaattgtgttaaaacaattgatcaattcaccttgattccattctgggcactttaacgtactgcatcgaaagacttcatactgataattattagtgttctcttttcctggccaaaaattaagatgctttaattaataccttcatcactatcattggctttgcacatgccatactctcatttactttacaatttgctaaacctttttctctctctttggaaatcttgatcctcaagaactttccacatgatttctttcatagttcttttgcattctttttctccttagaaactttcattttttctacattggcacaggaaacatcaatatttgatcataaagctaaagtgatagcctggcacagtggctcacgcctgtaatcccagcactttgggaggccaaggtgggaggatcacttgaggtcaggagttcgagaccagcctggccaacatggtaaaatctgtctctactaaaaatacaaaaattagccagtcatggtggtggcgcctgtagtcccagctactcaggaggctgaggcagaagaattgcttgaacccaggaggcagaggttgcagtgagccaggatcacgccactgcactccagcctggacgacagagagagaccctgtctcaaaaaaagaagaaaaaaaaaaaaaaagctaaagtgctccatggttatattaaccttccccgctaagtttccacacatctcagtttagtacatgttgagctagtgaagctgggattctagtttgacttttgaacggcttttttttaactgagatttctatctttagtttctttttctatgtggcaataatggaatgagaactttaaaagttactcaaaaacttcatctgatgaagtaggtagctgtcttggcaagtaaatgcaattcctgaaaattttttccactggaatgatagctattatggctacaagataaggtatgagcaatgagttttctggccgaaggaatgactctgaaattgccatacctctgtgtagaagcaagccatgctttaaaaaatgacactttggtctttgcttgaaaactcaaacataaataaataacttctaacctggctttgacttcataagaacttcattattgccgggcgcggtggctcacgcctgtaatcccagcactttggaaggccgaggcgggcggatcacgaggtgaggagatcctgaccatcctggctaacacacggtgaaaccccgtctctacaaaaaaaaaaaaaaaaaattagccaggcatgttagcgggcgcctgtagtcccagctactcgggagtttgaggcaggagaatggcgagaacccgggaagcggagctgcaatgagcccagatggcgccactgcactccagcctgggcacagagcgagactccgtcaacaaaaaaaaaaaaaaaaaaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaataattatgcaattttgttaattctgagaccaaagcaagctgttctggggagcaactcaggggaaatcccttaaactagcttctatcactgtctaattaaattcaacatgatttcttatagatcatgtagtaggataaatataggtgagataccaaatgaacataatacatgattccttcagttctagaaatgtttaacagagtagtttaagaggatttcatgaaaagtaaaaagaatatataacagtagactaacactttttttttttcaggaaagggaaccacatgagcaaatagatgtggcctgagcagggcataattgagatacgtggaaagatcagtttggttgcagaaaatcagcccctgcaccatagtatgagataaatgtttagcatccaaatataaagtacttttaatatcaatttaaagcagagcatttcttttattttaaaaaatagggagttattaaagatttttactagtattttaatcataagattaaaatattttatggaaattatgcaaaagtcttaatgaagaacagaatctgaagaccagtagacatgttagtggtcaattccaaaagacgaggcaatgtgcataaaagatattgttctctttttcaatgtagtacttattttcgcctctactcttttattcacgttgcctctctttcacccatcagcttcgcatgtgtgaattttacacatttttcatgatacccctttcataagtccattccagttcttctcttctttctctggatttccacttttttttaacttttgcctctgtcttagtccattcctgccgctataacaaaatatgtgcgactggataatttttaaagaacatgcatttattgctcacagttttggaggctggaaagtccaagatcaaggtaccaacaggttcagtgtctggataggggcctggtccttgcttctaagatggtgccttgaacactgtctcctcacacggtggcaggtggaagggcaaaggggcaaatactgtgtgaagcctcttttataaggcattaatcccattcacaagggaggagccctcatgacttaatcacttcttaaataccttgacttttaaaattaccacactggtgatgaagtttcaacatatgaattttgggggacacattcagacaataatggcctctgaggcaattatcgttaattctatctggaatcatagtcatttatctcttatctcaattattatgattttctggaaaattaaggggatgccttgatttctttttatcacccttgtccagcccagtggctggaacataagggttcagtataaggttgacagagcattcagttattgggggtgttagatggatagagtgatagaagtaaagatgtacagttgctgagaagtcaaagaataaaagcaacagattcaaaggataaaggtttttttaatctagaaattttaaatttgtttccaattccaagtgtcatagaggttgggaaaaataaagataattacatttagtgatgagtttatcacctgtgactttacagtgtatggtttttatagagcagatattaaaattttagggagggtattcaaaagtcaagtatgatgaggcatcttttctcacctgtatagaaaatgcattctcatttctcccatttaccggtactttcggttcactgcttttaaaaagatatctgaagttaaaaaccatctaatatgtataactcatgaggcagggaaggcttttcttataattggactttacaatattgtttttaaacattcttggcctagaattaacataccactgctgggatatatagagtataatgcaaagtaacacaagcaaagtcagtgatacacaattcttcctcatgagagaaacaatttatgggaaattattaagaactccaggattattagcatcccacctgcaattgagaaaggtaaaaacatatattcccttaatacatggtagattgtttagcaaccacctacacattggccgtggatctctaaacatttaatgagtgcctgctgtgtactaaacaaccttctagagtacacaacaatggcagtggaagacatttacaatacaatagatgctttcagcacacaaacatagatactcaaaaggctcacagttataaaagaaaacaaaaaaaaaataagagttgaaaaacagcttccagagcagtatttcaaaaaccgcaggaagctatagtgaaaatctaggaagatgcacagtgaaggaacacaaagtatgaaagtaataagagccatcttggctgctgaaaatatttctcttaagaaagaacatcttgaattacgtgttcagaaaatgaaggtcaataaagatcttattggttagaaaaaatagcgaagaatagtccgaataattaagtcaaattttaaagttaacttacacagaactaagcccatttgacccagttggcacagtccatttaaatcttccttaggatgccccacattaaagtaggtgaactaatcacataacattggtgcaaaccaatgagatttctgaaaaaaatactttaagtgaatcctccattaatggagagttgagaagattatttttagatccaaaagacaggatttaatagtaagtgagatgaatgagatggataaagggtacagtaagattagattgattaaaataaaaatatattagaaaaaaactaggactcaacagacggagagattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggagaggaatttggcagtggataggatgtaaatgagtaccaaagaagatggagaaggctaactttaccgaagactaaaatgagagtcaagaggaaatggtatgttcaacaaaatgcaaataggcaagaaaggcttgattctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaagcatatggctattccggcttagagttgttgaagggcaaccactatgcaaattattccctcttctctttacctctttcctttttttttttttttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcttgagccaccgcgcccggccctctttacctctttctatatcttccatctgaagagttggaagtgtgagtggtgagaaatcacatgcatccagaggagacagactctaaaggacatacacaactctatggaaggactagactagcagcccaatcaggtagttaaagaaagaccaaaagttattggtttttctttagggagatggcatcaaagcattttgagccagaagttagtgctaagtacctgcaggaaggatgtagaaacaagggtcttgtcatttgcagataaccaagcaggtaatgtggcagccaatagcagcagcccagccttggggatgactttactcctatcaatgaaccaacaagagaaggttaggtcaccattcctggagaaatggaatttaaaatttttcatgttaacagcagtttaggagaatgaagcctgttttagaaattagagtagaatgtaaagtatcaaagttttgaaccccaacatcagaagtgaatctccaaatcagaataaggcaaattaagaaagctagaactccttaaagtccccagaccaaataaaaaaaaaatagggttgggtctggaacctgtaatatgatcattatcattaatatagtgattattaagcactttacttgaatcatcttaattaatcttcatgcaattctataagatgaatattatcattatttccattttagagaaattaacttacccaaagttttaccaataatatgtatctaggaagatacaaaatctatctaaaagtggttgacaaaaaataccactgcataggtgaaaggaggattcaggacaagagttgaacatcccttttatagaagtccttccaggaaaaaaaggaacatggcttggtgtgtctgacttccagaatatgatacctcccagtaagaaaaagctcttatttcttgttcttactcaccctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttaggcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactcaccagacctgagacttatatccacccttaaagaagggaagaatcactaatactctaattactctgattaacaatgaggaagcattatttttccagagaggaatttgagtgcttttaccaaacaatggatatgaacctggagggaaaaaaaaaatcaattaaaactccaaaatccaaattcaggaaaattaaatgaggaaatctccccagaaaataaatagaacttgctcagataagagaaaatggaaatttgagtcaaaataagcctccttagtcatcaaatctagatactccctcacccagtcaacaagcgcaggtagcaaaatagtcttcccataaagagtaagttggtggatgaagttgcacttctatggataaccacactctgtagtcatcgcctgaatgcattgtctgaggtttataacttctatttatagaagttcagcactcaccaagtgaagagctctgggctatagatacttgcttccttccatggacagtaaaaagtgtgttcaatcttgacttaaccccaagtgagtagaactcaggctgttagtgattgaggcctcaggcttggtaatttataaaatatactttgcttttctgttttatggaggaaaacctgcctacttccatgctttggaaaaactgattcaaaacgtgtctaatatgctgacttcaactaagtgtatagtaactgataaatatctcctaatggagttttattttttttttccaataacagtgttatggtagttgaatatatgtttttcttaacaagatagatgattgatagatagatagatagatagatagatagatatatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataattttaaggattattatcatcatcatcatcatcatcaccatatttagtatacattcactgcaagtaacaggattcttaagcagaggtagtggtcattagtactgttcaaaaagtatttctgactgcgcctgcttaggggcacttggcagaattgcactttttttactctcttgtgggtagaattgtgtgattcattctgacagggaagttgtgaatggaagtgatatgcttcacttctgggataagcatttgattgttgatatgagatcatccagacctcattcttctttcaggaacagaaaccagcaattttgcaggtgctcctgctccatcaacccaggtctctaagtgactgcaataaacagaagttctactgatccaccgtagacctgtagcatgagtgagaaataagcttttgtggtgttatacccctgagacttcggattgtttgtgacattactggtgcataatctaacttatcctgactaatacagccaccttacacaataacgcatttaactttctcagataaagtcaagtaatggagaaggaagttccagagctagttgacaggttgagccagtaattctgagccttctctgaatcattaaagaacagctgtggcagctccaaacatcatattcccacatagcaatacaatcaggaagtggaatggtggggagcaaaggcaaaaaggatcttttcccctagtgctctctcttttatcagggaggaaaatattttctgaaagtctcctccaggtttccattatatcttactgttagtgctaaatcttatatccaaccctagaccaatcaatgacaaaaagaaaaaaactataagcttgccacattttatcatgtttcactgtattgcactttaaagataccgcagatttttttacaaattgaagatttttagtaaatctgtgtcaagcaaatcaatgccattttccccaaagctacgctcactctatctctctcatgtcacattttggtaattcttgaaatttttaaatctttttcattattattgtatctgttatggtgatcggtgatctttgatgttactattgtaattgggggcaccaagaactatgcccatatgagacagtaaacgtaatccataaatgtggtgtatgttctaactgttccaccaaaagccattgcccagtctctctctctctctctctctctctctctctctctctctcacctcagaaagcttcccaattctctgagacacaacaatattgaaattaggccaattaataatcctgcaatgacctctaagtgttcaagtgaaaggaagagtcttgtgtctttcactttaaatctaaagccaggaatgattaggcttagtgaggaaggcatgttgaaacccaagacaggctgaaagctagtcatctcgcacaacttagccaagttgtgaacgtaaaggaaaagttcttgaaggaaaggtgctactccactgaacacacaaatcacaagaaagtgaaacagccttattgctgatgtggagaaagtttcagatagaaggtcaaactagctacaactacctaatttgatgcctaatccagagcaagatcctaactctcttcacaactctatgaaagctgagagaggtaagggagctgcagaaaaacagtttgaagttggttcatgaagtttaaggaaagaagttgcctccagaccatcaaagtgcaaggtgaagcaggaagtgctgatggagaagctgccacaagttttccagaagactgatgaaggtggccacactaaacaacatgtcttccacgtaaataaagcagccttgcattggaagaagactttcataggactttcatagctagagagaagtcaatgcctggtttcaaagtttcaaaggacaggctgactcttagtagggatgaatgcagctggttgaagccagtgctcatttaccattccaaaaattttacagcccttaagaatgatgacacagctactcttcctatgttctataaatggaacaacaaagctggatggcagcatatctgtttacagcatggtttattgaatattttaagcccattgttgagacctgctgctcagccaaaaaaaagattattttcaaaatattactgcccattgacaatacacacagtcacccaagagctctgatgaagacgcaggaggagattgatgttgttttcatgcttgttaacacaacatcctttctgaagcccatggattaagaagtaattttaactttcaagccttattatttgagaaatacattttgtaagactgtaactgctgtatatagttattcttttaatgcagctgagcaaagtaaactgaaaatcttctagaaagtattcatcattctagatgccattaagaacattcatgattcataggaggtcaaaatatcaacattaacaggagtttggaagaagttgattccaatccttatggatgactttgagaggttcagaacttcagtggagaaggtaaatgcagatgtgataatggcaagagaactagaattagaagtggagcctgaagatgtaactgaattgctgcaatctcatgataaaacattaacagataaagaattgcttcttatggatgagcaaagaaagtggttccttgagatggcatttactcctggtgaagatactatgaacattattgaaatgacaacaaaggatttggattactacataaacttatttgataaagcagtggcagggtttgagcagattaactctgccttcaaaagaagtttggctgtgggtaaaatgttatcaaacagtatcacaggctgcagagaaagctttcatgaaaggaagagttggttgatgcagcaaacttcatagttatcttattttaagaaattgccacagccaccccaaactttagcaaccaccaccctaattagtcagcatccatcagccttcaacacagaagcaagaccctgcacctgcaaaagattatgacttgctgaaggctcagatgatcgtcagcatttttttagctataaagtgtttttaagttaatatatgtacattgatttttagacctaatgctattatatacttaacaggctacagtatagtgtaaacagaacttttatatgcactgtgaaaccaaaaattcatgtgactcactttattgcaatattcattttattgtggtggtttggaaccaagcctgcaatatctgtaagttatgcctgtacaaaactgacttaatttggtcataatccatctcacacatctgggaaaggaacctactattcttgagtaaattaatccctgcataataccagaacaattcagcactctcttagcaaaaagtaaggaagaagaatgtctatgtaaccaggaacgtttttcataagagtaatggccttctacaagactctgtggaattgaaagatttcttaaaatgaggtgcccttgtgtttgcagtatatgcagttttgtctcaggagagagttttgggtctactgagaagaaactgaggtatactgataagtttcactgcttgtgtattgtagtggataatgtggatttctaaatagatttgctctgccacattattagacagatgcctaataatttaatgtacattaaagtatgttaatagggagaatgtgtaatcataaattaattaccaagattatgattatcccaattttaaacagtgcttgaattaaaatatatccctagaatacaaaatgaatagtggcttacgtgttctaaggtgagagataagggctctgcaaccacttgtggctttggaaaatgacatattttgcagtttgaaagcatggatttcagttaaacattaaaagcagatgactgccatgactatctgtaacatgatcatgcaggacaatgagagaaacggcaaaagaaattctgcctttcggcacatattttctctactaatatttgcaatgccaattttcaacagcacaggtgtatttaattgcctctgaatattgcaatgcaaacccattcaatgttgaaaacaggagcccaaaaaggaatctcaggctttgttggcctgcagaatcttgtagctccagattgattttaatatatccagggaattttttttctttgtcattgcgctttctttagaagggcatttaaattatcaaaccattaccttatcaagcacaaatgtgatgccaattcttgtgatttctgagttatatgtgctaaaaattacatgagttctattgaatatttttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtatttacacaatatgagaatattatattttacgcagggtatacccatgattcatctttaaattaacttcaggaaatctccaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcagatattataataagacaataactcaatttcagacttgtaaacaaaggtgacattaatctattgaaatgtgggaaaatagtcaacctgtatccttctcataccataaatcagcatgtttgatcactggaagcttcattttgatgattagcagtcatgtattgaggctaaatgatatgtttgtcgcacagctaatattaactaaatctatttatcatcttgccagtggtactacagtgaggtcacacttttggtgcagaacaaaaagaagccaggaatctgttaacagcatcccattgtaacattgctgttttttgttttgttttgttttgttttgtttttgtttttgagacggagtctcgctctgtcgcccaggccggactgcggactgcagtggcgcaatctctgctcactgcaagctccgcctcccgggttcacgccattctcctgcctcagcctcccgagtagctgggactacaggcacccgccacaacgcccggctgattttttgtatttttagtagagacagggtttcaccatgttagccaggatgatctcgatctcttgacctggtgatccgctcgcctcggcctcccaaagtgctgggattacaggcgtgagccaccgcgcgaataaaccgagaaagaaaagcatctgactattaacctcatatacttttggaaatggatgtttgtgtccacatcccctttgatatactgggttatggccttggcggtgaaaattccttactgtatatagtgggttaaaaaagtaggatgaatgctaacaaatgttttaggatgtatcacaacatctgaattctcccttctgatgcttagcattttatttcacaaaaggcaaggttactaaaagaagaaaaaaaatcaactgtttagatgaagaagcaaaattaattagtaaatataaaaagtgattatttgagttttgctatgacaataaacaagatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaactgagagttcttccaaggatagagtgtgtaaatgctgacctacattaaatacaagtgacatggatttctgggcatgtgggacgccttggtaatttgagtgacaaatcacatatggtgcgtttactactcttttgtggctttaaagttaggtgattttgactctaaagcatgaaagttcaaagagctgttaagatttctctgtgatgtatgcaagggttttcttaggaataaaaagtctaaaaaattcccaagaagacacttatgtgtaataaaagcataaagaaatgtacaggaataaaagcactagattttgtgtagaggttaccccttaggaagagagaaaaggatgcaatcaaaggtagtcatatgtggccttagtagtacccatacttttttatttcttcactgagtgtgggtaaataaataattttttacttgacttaattttaataatatttgaaagaattaaagaagtccatgaggtaatgtgaaaacttgtaatgaaaaaggctgaatacaaaattgtatatgctgggatgacaactctaaatgtttgtgtggagatggggacaagaagaaatagaaagagttaacttgctaagatggcagaattatgagaaatttggacagaaattgatgagaaaagtgatttgaggttttggtgatgaagaaagggagaatataacctaaggaagattaaagatttcacataaaactaggaaatgtttagcataaatcagtttcaccaatttgaacctggtcttcctctctgtcctctcccttgtactcaccaaatcattttacaatcttccaataaggaaaaatacttcctttggtatgaatgtctagaattaatatttatagttctacaaaaaaattcagagctcttaacctaaaacaagtgaaagtacaatcattgtttttaaatgttacaaatacaatacctgacattaaattgtatttcctctatattgcatattctgaatttaaaactgtctaacacctttaagcttaaagcttaaattaggcatgtaaaacaagataatgacaaaagaaaagaaggccggatgtggtggctcatgcctataatcccagcactttaggaagcaaagactggagaatgcttgagcccaggagttcaagatcagcctgggcaacatatggagaccccatctctataaaaaaataaaaatattagccaggcattgtgtcatgcacctgtggtcccagctactcaggaggctgaggcaggaggatctcttgagcctggaaggtaggggctagagtgagctatgattgtgtcactgacctccagcctggatggaagagtgagtccctgtcacaaacagaaacaaaaaaactcatatttattttcagaagggacttgattatgtggagccatatggggcaaagtgcaaatataccttagaactactttaaaatacctattatttcttctataagtatccacagccagaaagagcaaaacttgctgagtatgattggcaaaaagattttcttttgttttgattccaccgttccttatttttcaggccttgaataaagtcaaatacagaactcttatgaaaaaattcagtgtagaacctataatttagctgcgattgttctcttggttttattttattttgatcaatttcagtcaggttcccttgatttctctgaaactggagagtattgtattctaaacgaatgacttgtctttgctagttgaagtaaataagcaattagagcaaaaggctatttcattgaacttcaaagaaaattgtttttaagattctgttgttgttctgtggcccctaataatgcagacggtctttatacaacagaaatctgtcagagaagaaatttttattggtagctaactttacacacacacaaacacatgcacacacaacttcagaagcagaagcacaaggtacttcctcagagaaccacaaatatcatcaaagtcttattttgacataatgctactttaacaagaaattcagatttatggaatgaaaattgctgtagtaacaagtattttgaaatccaccctaatacccagaaagtgacagcaaatcccagtgcttcagtaactctgagccagttaaactgtaggacaaaattctgttgtgttctagtattactgtctttctgaactaagactgtcttgtgctttggttgataggaagcagtgagggtcctgcctttcccaggtttgaactttctcaggtggttgagatcttccttgcagctcctaaatttcattatatttttctctactccacaatccccatccagtaataaaaatctattcaaaagttgaaattaggaattcttccatttacatctaagcgttagattatttttctaaggaaaaaattaagattctgtttttacagaaatctcatatttttttttttagtagacttgggtctcaagccattctgttaaaaggggaaaggagtaatatcattatattaaaatatccaaccatatcatgagatcaaaggataaaaacatcttgaggatcatttggtgagtccgtctacctgcagaaatcctgcatgtctgcatcactgtgaacagctcagtatggctcaggggtcacctcgctgttggaacttcagtggtctcacatagtccctaaatccaagccactgtcattgttcttgggggttgtaaaggccattaagtgctcagtagtcttataaaaacatgcagattcttcaaacagaaataatagctttagttagtgtactttagagccataagtttaaaacccagcaggagaatataaatgatggccaggcaagaaaaacaaaactccctgccaaccttcactgcctacaaaacttaatgatctatgccacatctactatttgtaaaattctttcagaaagtatccattcttaacattaagaaatgtctaccttccttcctccaatattttcaatctctctgccacactatgtttatattctctcagaattctagtggatcccattgtctaagacttaaaagctgttattttatactggattaactttaatcatctgtatttcttccaaattgtagagattgcattggtccaattttcttttccttcaatttttaagagaagcaaatcaaaccaagtctttaaaggaagcacagcaagtctcagataattttattgtttgggcctaattattttaaatgttaccaaggaatatctttaggttaaaaaaattaaattttagaacagaatttgatatatatttcttattatttaaaatgggaaagggcattagcatttattaaatctcatctgtgtgccaagtattcataggtatcacctcatgtaattctcacagttattattgcggtattattatttcaattttcatgtaaagaaataaaagctcaaagaagaaaatgactcactgagttctgaacacacaattctctgagtccaaacctctagcactttctagaataccatgaagagtggaagtaatatgtaacattataattaatgttttattattttactctcttattgttaaatttcacacagtaaaatctacacataaacattcattttaatttaaaatcaaattatactgacatagtgccaaaataactgctctatgagatcaataaatccaatctattctgatatagaaaggcaaaacccgtgtgcattgctttgtaatagtaaccaaacagtcattatgtttcagccatttcaggaacttatttgtgattgttgtatattgattataattctggtcagttgtagttaacaagccttttttttccttatactttcttttttccaaagaacctattttgttttatagcatggttggacttttctctagaaaattacaaatgtattcaatataaccagtatttatcccaactttctgaagaagaaacttctcctacttaactccaaccttatgactcttctctgatatttttccagccataggtgttagcatctgctgttgtaaaatctttggtgttgattggtgtggactgagatgaggaccagagccaagatcactttttacaagaaatattatacaattctgccccttgtccaactctataaattactagaagtttctggaagtgtgtacatcttcaagctcatcttaatcatttccacatttgtattcttgagattatacctgagattctcatccacacaatccttaattaaagcagctgactcgcttctcacaatataggaaaatgggggtgccaactgctttctctgccaacttctgagtactgttgaagctgaactagctcctcaacgcttcttctccaggaaatgtactgcaactctcatgctatttagcaccttccctcctcatttcaaaaattgtgctgatcagagacattcagaaaaagtgcaaaagaacaaaacagctccaaatagctttccacagttctgcactgtattctaccctctgttgatttccctacaaaacagataggcaaaaaagcagctcacaaaaaagatagagtacatagaaaagagaaaaccgaggcataagacagcactgtgtgcttcaagaaagtcctggagcaaagcttggagcacagggttcaggtgagaactgaagttatattagcataaacatatggtcgcttactgccccctctgcaatgtccagaatgcattcctaattttcattccatttgtctccaatgcgtgataggacttcaaagagtcatgattaaagaaattgttcagtgcaattagtcaccacttacaagtcagtgagctcgcattctggggtgagtgctaagctttttcaataggagatagcacactccattcacttctttgttgttctttcttaagatccttcttctggtgattttttttttttttttatgtccagagttctactattttctttctttctgcctaataatacttaatttaaaataaatacatcttttcagaaataataatttcatccttagtgaaaacatttacccatatctgcccactatattttgtgttttatattctttcatttaaaagtattaagatgaacttcaattataaaatcttacattgcttgaaagacatttgcctaaatatgttatgtgtctactgtagtttttcaaaaaattttgatttaagaagccacaagtatattaaaataattctatttcttccaggaaatggctggatttagtgatcctgtaaggttaaaaacattataatatttgtatagtgaccaggctcttgatttagatggttacatataagcaaaatactgaatgaagacaaaaaacacagctatcccttttattaagtttcatagcttttaatcccctaaggaaatcctttagctatttcactattttactaaatcatattaaaatgcaaatttccactaatattacaattctagtcaaaaccaccaaaagaaaacatgggctcttaagcttttttttttttaagtatgagcacagacagcagaaaataaagctttcctgtaagtgaatatggcatctacatttgaattatgtacacagtaaaggactaaaaattgtgtggtcctaagtaagtttaaattctattgtctttgattgatttgaaatagaattatcagagattggattaataaaaagagcttgacagttcaaagaagtaagcttgtgattgggctatgattttttccaaggattttttgggcagtcatattattttctgtaccttaaatttaccatctatgaataaagataatattgactgcatgaaataataagcccagcaactttttttttttttttgagatggagtctcctgtgtcacccaagctggagtgcagtggtgtgctctctgctcactgcaagctccacctctcaggttcatgccattctcctgcctcagcctctcgagtagctgggactactggcgcccaccaccacacctggctaattttttgtatttttagcagagacggtaaactattcagtggaaacgtgataaagttgtttctcaatgaaaaatgatcattataatgtaaatgtgcatgtaactagttattgaataataaaagttgaactcaaggtagctttttcagtcacttcaaatacttggccaattttgaaggaaaaaagaaagcagcacccaaaagtctattgttgttgatgcactatagaattgagagtgtgttcaagcaaaatctagcatgttgccaatggaaagatagtaaaaatcttgctactaatacctgcactgctctgctgaaacatttacctcaggtagtgttagctggaatggctaattattgaaaatacaaagtactgcatattgtttatttccattagtacaaatttagtattattctaatgctgcttgcattatttgaataagataaacaattctcagtcactgtgacttcaaagaactattctttattctccccaaagtttgatttactcattctattgtttattcatgaatagctgtgtactaccaaatgtcttgcctttcagtttttcaacagcaatctttactttagaaccttactctcaccttctgatatatcattaagtttgaacatgttgaatgctttgacggttgtattatacatgtaaaattgcttgtatttcatcttttatctagacagcttttatagtttgggtttttttcaaccaagttttcaacatttttaagttatgaagtttaacaggaattgctgacaaatgataataactggcatttttaaactcttcttagtatccactacactaagtactttacatattataaatctatatattatcacaaatcatttacagggtttttatgcttatctcttctctccacctggctctcattttatacagaggaaaactgaagttcagaaagtttaactaacttgatcaaatttatttggcaatttaagtggcaaagctaggagtccaaatccatgaaacttcttatacttgatactgccctgttgttgttatgattaatagcaattatgttttttgacaaatgattttcactgatttggagtaaataatttaaaattatttcatttaaattaagcctgatagtactatactaactgatacgtttacaaaactaaactcttcttagctgtaatatcattagcatttgctcaattttcagcagagacacaaaagaatgccagaatatatggaaagagtatgaaagctgaaccccaaggacctaaatctgatcccaactctaataggaatcactttacagaagctacattttagatccccaatgttatcatctttaaaatgaagataatgttagctactttagctattctacaatatggtgtttaggatcaaaccagttgaggtcatgtgaaagggtctcagaaagtgaaaaaaactataaatgaaagaattagacaatactgcaagtgctgcatgcaagaagagtaaaactattagcattactaatacattgttaaggagaatcttttcaagaggatctgctttgcaaaaattatttagaaaaactaattgacagaaaacaattgagtctttctgtcatttccatagtctatccagaataaagagtaatgaacacgtgcatacgttttctaaataatctggaaaagttgatattttttaagtgtaccacttagatttaataaggagtccagtggagccatgcttacactataggtaaacaatatttgaagaaagctttctctgcctctgattatatttttatttattcaataaacattttctaaagacttagcatgtacttaactgacatttcatggaaggcaaaggaaaggaagaaagcagtatccctcttcaggtagcctcccccatgttagaaagacaagtcacaaagctactagaaaacaaagattgatatatgataatacaaaacaaaaggagtgaatacatgcagatgtgaaacaaaataaagggcttatatatggtattactcaggtagacatttggaagaaatcttttgggagcaatgtcttattttggcaaagaaaaaaaaataaaggggattctacatccttaagggagatctgtgaaaacctacaatagcaagagtcatgcagggccttgtggtcatgtgcttacagttgcagtgcttagaatacaaactctaaacagaagaggcatatgatggtaaaagaaaaaaatcatgaagaaaaagtaactgtgtaaaagactgacaggtatagggaagtcccttcagacgcaagaacagacaataaatcaaggatcatgggagttgtagaataaagttgacagtttaaaagccaggaaacaaaaagaaaaactgctgctacactttgaaaattggacagataaaattgccatggagagaaactgattgacaaaaacagagcaaactacagattgggaggaaaattaataagcttggtctgtagcagcacaaatccattggataatcaaagaaaaatgtcccgtggatacttaggcaagtgaggggctttgttttcactgttgcctacctgtcactttgtatagtaatgaaattaatgagcctgaatcttccctttcatgactgtaaagactcaaacgccctgttcttctccacccaagcatagcagccatgcaattctgctgtcaatgcaatcaaatctttccaagttacagagaattctaaaaacgtcctcacttgtttctagaatcttaaaagaaaggtagtggaggaaaaaaaatccttccaaaaaacaagtaataaggcatttttgtttacttattgcttatagctgttggccttaaattataaaatatcagggaatatatctgcccctttagctgataatcttttatcataattgaatttaatctcaataacattaaattgcttagaaaagaaacaaagtagatattaagatattgaattattcagaagctatcaacaggggccatgttcaattcttggaatgaatttctttttctcaggcatctttgccaaagttggaaaacaggttaacaaaattgttaaccaaattgaaagtgtcaaaataaagccaaatacaaattgggtcagaatccaagagctgcctattgtgaagtcttctaacgtaaaagttgaaaagaaagttagcttccttgacaaaagaaaaaaaagactaagaggttatgtgtttttagttttgaacttagaaatcagaactcaagaaagacatactgaaaatttcataggatgaatggatttccctttaaccacaatattgtgttgtccacagcatgaatgaaaactgttacaaacttccaaaggcttcagatgattagcctgtgaattgccttcacctctgccaacttacctggcatcctttacgtttaccagcgcacttctccctggagcctgcagacagcaagctcctgggctgactgtggaggcttatctaaatcctctgaaagttgtgctggggtttatctctgcctgaagacccatcattttgcatgtcaaatgtcagacattccaatactgtgaagatatagatggctttgccttatcatttaaagcagactaatattattataggcattttataaaattaattatttgaccaatacatgtgcagataaaacgtccttcattcaactaacttccatcatcaagactaatcattgcctgcagtgagaaacatcagtaaccttaataagttattcagtagggactgtgaatttgttcaacagcacaggaagtacagaaatcagatcaaagggtagaggatctggtaaaaatttatcgaagcatagattgtgactttgtgtatatcaaaacaatatgatatactttactaaagttttgatgtattgacagttgagtttatgggcaaagagaggcagatttacgattctattaaatgttaaggatttttaaaaaatcatcgaaaaaattgtattcatttgacatgtaaaataagtttgccgtgactatatagcagaatcaaaatccattaaccatggattaatcattaaccctttaatttggaattaagatgatatgtggtatttttcacagtatttcatatatgttagtcaaatctgcccaagcagactgtaaactaataaattatttcaaacttgttcaaatggatgagtgaatgaatgagtgaatgaatgaatgaatgagtctctcttctagattactgttaaccacaatttatctgccctaaaaagtcacaggtaactgacccaagtcaatggcttggagcatttttacagtatttttgcacagacatatattccagtttcctctttgtcaggaacacaaattgaaaagagaaatagagctatgtgggaggagaatgtgacatgtattcttaaggagacaattctgaaggctatttggagaaggctacatgaatttactacaaggaaacatcttttcatctactatgatagaaaaatctaatgcagattttgataagtctgtatcatattgaaagctctgtttaacagagtaatcactggctgacaaattagattaaaaggagtctgaaaaccaaaggaaagaaaggaaggaaagagaaaggatgaaagagaggcaggtaggaaaagaaacggtgtcttccaaatactattttcaccgtggagcaagaagggctttggagcatacctcagaacgtagctcctccatgaagtcgtttttgaattccaggccccttttatcttgcccttctcttttttttttttttattgaatatcaataaatttattgaatgccagattctgggctcaatgttttcatacatttgttcgcttaatccttacagcaatcctgtgaggcaggtagtgttctcttaatttacaggtagaaaactgtgaaacagagaatttttttattgtaaataaagtccctctccatgagctttatatatatatcttgcccttctctaaccagctacctataaatcctttctgctccactgaattttgtgcttaactgtattgcctcctatctctagttttattttctgggagttagtctttctaagctcctagggaaagggaaccatcctttctgtgttctctgttctctcactccacctctgcataagttctctcactccacccctgtatagtttaaacacacagcagattgtcagtaggaaagaaatgaacggttaaatgatctgatgcaggaatacgtttttcctttggccttggtgtgtcttgccttgatgctctgagaaacaggtttttaatttggagtccagttgtcttccagacctggagaacaataatctgcactcgggtaccacatattaccaactgtatgaaaaagtacacacacacacacacacaatgcacacacggatatatgcagtttcccatgaagagtccacaacttttatcatattttaaactggacatatgattcaaaaaaggtttagaactatcattctaaaggaaaaaagatacttcagtaccctggggccaagaattggtagtctttgaagccattttaggctataatgagaaattcttcatttggacctctgattgatttaatcttaaattatgttctatgagactttacatactttttcaaatatgcatttaatgttctgtctccagaggtggctaatgagtgtattaatgcacatatttccagaacttttttccatttgtattgtataatttagaaaaagcttgtttttatttttgctgatttttgaaaaatgattatccttgtgtgtttttgaaaattattcataaacagccccaaaagcaagactttgaaaaagattttttgtgctagttaacagcagaataattatttccatattatattctgcaccttgcatctacttataatgatctagaaagatgatggattattttgagtaaaactagaaattggcaaaaagcatcagtaaatataagaatgaagaaacatgtagattattcataaaatgaataatgcacacattagtgcagtggtgaagcattcataagacaaaatagagatatgttgaaggtagaaaatgcttgaagttactgctgaatttttgtggtgaccatagcaatggtattacctgtattgtcttgaggctcttggctgaaatatctgggactgttacaaatgtacaagcttatatttttccagggatgaaaatatagctcatcctgtgaaaaagatatggatttaaggttgtttcttaatatgataaatgccaatggaactaataatacaaatctgcccttaaaagtgaaaccaaggcagaaatacaaaagacaatgaattatgccgtagattaaaccaagatcccagtgagtaaatctaccaaagttttccagcctaggggacagaaatagctgactatgaatgggaatgaggatgaagagaatcagtgctaaggaaaagccccttgagatagtggcgtacttcaaagactgtccgctctacttctacttgagcttaagaacatggctatgtgggtttccttcaagtcatctaatatttattgagcactgactcaggcattttagggactgcaaaaaagatccattgggaaataaatgcgtagaaccgcatagagcctgcctccccttagccatagggcacattgtataaattagaaaaggggctcctccccaattgttcattcagtaggtgtgagattcaatgaatgtctgatgaacaggcctcagatttggaagcatgaacttgacatgcacagctgctagtctataataccaaagattttcctttttaaaatgtatactctgcaacacccttgctcttggtgaagatttcatctttgttttcacaatgctcaattaaagagaaagatatttggagcatttacttttaaaatatatatatgtcaggactccttaagtaaataattttttaaaaaatttatttagtgccaaaactccctggaagaagaaataatgacgtttttccatccgagagttatatttttattgtagaaagaatatttgttagttggcttcacaatagttgtatccctgaagcactaaatttgtatacaggagcctattaggccatgtagatttcatttgaaaaatgtaccgtattatgttctaagagctgagtttagcaaatatgagaaattgagttcttttagtaaaataaataagactgagattttaacacctgggaaataaataataagcttcatgattgcacaaaccatccttagcactgtatcccaatcctgagaaaaatgccttgcacatagtagatgctcaataaatatttttctttgcacaatttttaactgctcaatttatgcctacttgtcatgaaaaaacaggctttcttgataaaggaagatctttttttcaacaaaagacttgctaatactaatttatttctaaatgattccaagtatttctattgtgtttgtattaatatcagtgctttgtgtcatgaataatctacagagagccaagatttaagtcggtgagaaaaacatttcttgtatgggaagagagtttattaagatacattttatacatttgcacacatttatctctttttttcttaatgcatctttttatacccatctaacataaaccactcaatgtattgtatcacatagtcaatatttctaccaatggggagcagattttaacagatgtatccgatatttttattgaaaaatccatcaatgctaagtgaggcatatggtaagccttgaaaaggaagtattatttaaatgactggagaggaagaagaatagcatttgaaaaaagaaagaatgcactttagaaaacacaggagtagaattgagcagggaacaacttacccagtctgatgagaatagaggtgagtgtgggggaacagtgagaaataaacacaaataagtaggatgggctaaatgacagaggactttgaacactgtgcacaaaataattgataattatatattggaaagttttatctgattacaatgaacgggtaaaatggacagaggagataattgatgggaaaagagatcagatgggagataatatcaggtctacaccttataaatagacataaaagaagagtaaaacacattgaaggagaaatggcaaagcttaccaaccagttggatttgggagtatgtatttccccatttttccaatggggtaggaaacgacagaagcaccgacagagccatggagctgttttggagaactggtttgggaaggagataaaggatgcacaaagcattctatagactttgggaatacactcctggagtatagaatagggagtagaatagagtaactgaacgagtagtgaggcatgggaaagcatgtgctcaacaatgagtgaatgggaagataaccaaggggctgagaaccaccttaagtagcaaccacattcaagccttgagaatagaaagggaaggagaggggaaaaatgtagagatgtagcagaacatgctggtagggaacagtaacatgaaaataaaagcagaagaaaattttaagaaggattatgtgatcaagattttctaataccacagacagtgttgtttgggtttgaccaaaaaaagctattcattatcttttggagaatcctgagtacaatgttagagtcttgagactggttgcagaatgaatagatagaaagggtagataagaagaaaagacagttttttacccccaagatagcggattggagcctttgttagtgtgcctcagccacttggagagagcaaaatagtgtgtgttaccttttttctttctttttttttttttttgacaatatctcgctctgttactcaggctgcagtgcagtggcacaatcatagctcatggcaggctcaaactcctgggcttaagtgatcctatcacctcagctcctacatagctgggaccacaggtatgcacaacatccagctatttttttttattattttttgtagagctaaggtctcatgttgcctagatcttgaactcctggactcaggtgatcctcctgcctcagcctcccaaagtactggcattatagttatgagccaccatgcctggccacacattgtgaacttttatccaagaaggaaaagagaaacttaacagaaaaagtgaaagaaacttcactttcaaaggagcagtaggcagtgaggcagaaaactgtgagtctccaaagggcaaaagagggagagaccatcaccatgattctcatttccactgcagagcctggcaattcaggccacaggggagcgccttaaccctacccagcactgaagctgattttgtgagcagcgaggaggatatgaggagcggcatcaggacacactttgcaggcactcctagaccccagtgaaacagaaggaagacattcctgatcctaactcgtaaaatcctccaaaagttggcaagttaaactcagccagcgcttagaggttgccagaaactcccaactgtggtggggcgtgatggctcacgcctgtaatcccagcactttggaaggccgatgctggcagatcacgaggtcaagagatggagaccatcctggccaacatggtgaaaccccgtctctactaaaaatacagaaattagctggccgtggtggcacgcactggtagtcccagctactcgggaggctgaggcaggaggatcgcttgaacccaggaggcagaggttgcagtgagccgagatggtgccactgcactccagcctggcgacaaagcaagactccgtctgaaaaaataaataaataagaaagaaagaaactcccaaatgagattcgtgatctaatctcaagtggggatgaaccccgaaggccagagctaagcacaagtgggaagtgtgctcttgccacaggtgcgggagctggacacctctgctttgcgggtcaatccaggaagggtgtggcctgagagccattgtttgtgtcttgagtgggaagtcttgcatcctgggtcagttttgtattctgagcatgaactgcctgagattccgctggcagttacagctttcttctgctgaagtctgcaggtgtgagacacaccatgtcaggggcatgagagctgagtgggtctcactgtggtctgctgcccctctcttcctgtgcagactgttttgtgcagcagaaatggttccactcctctctggaacattaccccagtggccaggaaacttcctttcaacctccgctgctttgcatctgcacttgggcagccgcagcgcaaacttggctcacccaacccccacacagcttcacctcctttatatgccttggtagcagacaatggatagggacttttgagagttcgatggccccacccatctcctgggatatctgagtactcttcctgggtaacctaggccatgcataaatcccacagccacagctggctccctcctgaaagtgtcacctcctggcaggaggtcaactggcacagccaattacaacatctgctgacacaacatagtactcatagtgaacatgctcactgtagctggcaattgagaaagccaccacactaaggctatttataaccaaggaaatcttagagagatacatcacttccctgtcacccccatcagagctggtgcttgcacctgccactgggagaccagaggacagatcagccttgtccagctccacccaccaccagcatgggttgtggcagccccaccaggtggctagatccagaggagcaggagaattcacagtcttctgaccctaagggactgccactcctaggggaaaagggagtgcaccacaccaagggagcaccccacaggacaaaagaaaccagagagtttttctctattccagaactttctgcttgtgggcaaagaacagctgcatctctttaagcagaggcacaggcagagtgctgggctcagtggaggaagactatggctctgcacagcagtcaagcagcccctgtgctcatgaagagatttggagaagggtacttcttgtctcccttggccattgctgcaggcacacccaggaattctcctgtgaaaactcagtgagagtgcacctgtacacagcctttctggaacatttgggggtgactgcgtccccaagggaggtgtgccctccaggttcaggcttgcaagaggggtggagttccactccccctctacatgaatatcagtattcctgcagatggaccgaggtgcctatctgatctgaatataaaaaatcctgggatgggggcatgataggaaggtaggtcacttttgtgctggcctcatagtggagctgaggtgactccctccctcccctgtaaagatttcaatgtatttcgctgggagctcctccagccgcctctatcagagctgggacttttgcccactattgggttttgcatttacccagctgcttcagccacaggcagttcttacccttaggtggcttctactggcctgaaggctgaactgttcaacccagtgaaaaaatactgagggtgtggggagggaagtacacatgactggggaatgaggtaagcttcatgagacctctgccaccctagccccacaggagacagtaaacctgcttacacatccagtacatagctactacaagcagcatgtgagaaagtcattgcacaaagattctctatatctaaggaactcatacagagtctttgacatggaaagcacccagagccaaagctagtcaatcataaactatacacattatagtcacaacctcaaagctccatcaaaataaatttttaaataataagaagaaatatccccagatgagaaagaaccagaaaaatgattctggcaatataaaacaaacaaacaaacaaacagttttataacacccccaaaagatcaccctaactctccagcaaaggatccaaatcaaatgaaatctttggaataccagataaagaattcaaaaaattgattgcaaagtttctcagtgcaatccaagagaaagttggaaaccaacataaaaaatcaaaaaatacaattcaggatataaatgaaaaattatctaaaaacaaatatttctttaaaaaacaaaacaaaaaaaacagaattagtggggcgcaatgactcatgcctgtaattccagcactttgagaggccaaggcaggcagatcatgaggtcaagagatcgagaccatcctggccaacatggtgaaaccccatctctactaaaaatacaaaaattagctgggcatggtggcacacacctctagtcccagctactagggtggctgaggcaggagaatcacttgaacccgggaggcagaggttgcagtgagctaagatcgcgccactgcactctagcctggtgacagagcaagactccatcaaaaaaaaaaaaacaaaaaaaccagaacttctagaaataaaagacttgcttagggaattacacaacgcagttgaaaattttaacagtaaactagaccaagcagatgaaagaaattaagagcttgaagatgaggcttttaagttaacccaatcagacaaaaataacaaaaacaaaaagaaataaagtctccaagaaatgtggcattacataaaatgtcaaaacctaacaatccagaagaagaaggaaaaatgatgaaggaaggagaagaagaagaaggaagaaggaggaggaggaggaggaagaggaggaggaggagggagaaggaggagaaaaggaagaggaagaggaagaagaaggagaaggggacaacaataaaatgtttagaaacctatttgagaggacaattgaggaaatattccctggtcttgctggaatattagacatctagacacaaaaagctcaaagaactcctgggagatacattacaaaaaggatatcaccacagtatataattatcaggttatataaaatcaatgtgaaggaaagaattctaagagtagtgagacaaaataacttataaaagaaataacatataaaggaaatcaaataacttataaaggaaaacctattagactaacagcagacttctcagcagaaaccttctaaaccagaaggccttggggtcttgtctttagtcttctaaacagaagaactatcagccaagaattttgtatcctgcaaaactaaatttcataaataaaggtgaagtaaagtcattcccagacaaacaaatgctgacagaatttgtcacaattagactacctctacaagaaatgctcaaaggaatggtaaacatcaaagcaaaaggttgatattcaccagtataaaaacactcaaaattataaattcatagagcttatgaaataataacacagtggagaatacaaagcaattaatgatccacatgatgaatggaacagttacccacatatcaatattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacaatcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaaaacaagtctcaataaatttttagagatttaaatcctaccaagtatcttctcagaccacagcagaataaaactaaaaatcaattttaggaggagctctcaaaactataaaaaacacatggaaatttaaaacctgcttctgaatgatctttgggtcaatgatgaaattaagacagaaatttttaaaaatttttgaaaggaattataacagtaacacaatgtatcaaaatctctgggatacagcaagagcagagctaagagggaagtttacaatgcttaatgcctacacaaaaaagacagaaacatcacaattgacaagctaatgtcatgcctcaaggaactagaaaaacaagaacaaaccaaacccaaacctagcagaagaaaagaaataataaagagcagaactaaatgaaattgaaaccaacaaatacaaggatcaatgaaacaaaaagttggttatttgaaaagataaataaaatcgatagaccaatagctagattaaccaaaaaaagaagaaagagaatttaaataagctcaatcagaaatgaaaatgaagacattacaacagatactacagaaatgtaaagtattattcaagattactctgaacacctctaagcaaacaaactagaaaatctagaggaaatagataaattcctaaaaacatatagcccccccaagcctgaatcaggaagaaatagaactcttgaacagaccaataacaagtcttgaaattgaattaatactaaaaaaaaaaaaaaaacctcacaacaaagaaaagcccagaactagatgaattcatagccaaattctaccagtcataaaactgacatcaatcctaccgaaactactccagtggatcaagaaggagagaatcctccctaactcattctacaaagccagtatcaccctaataaccaagccagaaaaggacacagccgaataggaaatgtccctgatgaacatagatgcaaaaattctcaacaaaatactagaaaaccaaatccaacagcacatgaaaaaattaattcaccgcaatcaagtgggtttcattccagggatgctaggagggataaatatatgcaagtcaataaacatgattcaccacataagcagaattaaaaataaaaaccatatgatcgtatcaatagatgtagaaaaatcattcaataaaatctagcatctcttcctggtaaaaattctccacaaactaggaatagaaggaaaaggaacataactcaaaataataaaagccagatacatcaaacccatagccaacatcatactgaatgagggcaaagtagaatgtgttccccctaagaaccagaacaagacaagggctcccagttttaccacttccattcaacatagtactggaggtcttagccagaacaatcaggcaaaataaagaaataaagagcatccacattggaaaagaggatgtcaaactgtctctgttggctgttgatataaatgtatacatagaaaaccccaaagactcctagatttgataaatgaatttaatgaagtctcagggtacaaaatcaaggtacgtaaatcagtaccactgctatatgccaataatgatcaagctgagaatcaaatcgagaactcaatcccatttataatagctgcaaaaaacataaaatacctaaaaatatgcttaactaaggagatgaaagatctctacaaggagaactacaaaacactgataaaagaaatcatagatgacacaaacaaatggaaaagcatcccatgttcatggattaaaagaatcaatattgtgaaaatgaccatactatccaaagcaatcttcggactcaatataattactgtcaaagtatcaacatcatttttcacagaattagaaaaaaaaacactaaaattcatatggaaccaaaaaagagcctgaatagcctaagcaatcctaaacaaaaataacaaatctggcaatatcacattacctgacttaaaattatactacaaggctctagcaaccaaaacagcatggttgtaaaataaaagtaatataaaagtagacatatagaccaatgaaacagaatatacccagaaataaagccacgtctctacagccaactgatcttcaacaaagccgatgagaacatacactggggaatcgatatcctattcaacaaatggtgctgggaaaattggatagccaaatacagaagaatgaaactggatccctatctctgaccatatacaaaaaaaattaacacaacttggattaaagacttaaatgtaagacccaaaaccataaagattctaaaagaaaacctagggaaaaaaactcttctcaacattggtgtaggtaaaagatttatgaccaagaccccaaaagcaaatgtaataaaaacaaaaataaataaataggacttaaattaaaaaacttctgtacagctaaataaataatcaacagagtaaatagacaacctatagaatgggagaaaatattcacaaactatacatccaacaaacggctaatatccaagatccacagggacctcaaatcagcaagaaaaaaagataataatcccataaaaagtgggaatatgtgaagagagatttttcaaaagaagccatacaagtggccaacaaacatatgaaaaaaatgctccacatcactaatcatcagagaaataaaaattaaaaccaaaatgagataccaccttacagtcagaatggccattaataaaaagtaaaaaaaaaaaaaatagatactggcatggatgctgtgaaaatggaactcttactcactgttgatgtattaggtaaattagtacaacttctatgcagaacagtatggagagttctcaaagaactaaaaacagttctaccatttgatccagcaatcccactaatggatatctacccaaagaaaaagaagccattatatcaaaaagacacctgcacttatatgtttattgcagcacaattcacaaacgcagaggtatggaatcaacctaagtgctcatcaatggatgagtggataaagaaaatgtcagatacggatatagagatatagatagatatagatagatagatcatggaatactactcagttataataaaagaacaaaataatgtctttttgcagcaacttggttagaattggaggctattatcctaagtgaagtaactcagaaacagaaaaccaaaaactgcatattctcacttataagtgaaagctaagctatgggtatgcatgggcatatagaatggtataatgaacactggagactcaaaagtgggaaggggatgagagattaaatattacctattggatacaatgtacaccattcaggtgatgggtacactaaaagcccagacgttactactatacaattcatccatttaaccaaacccctagagctactaaaataaataaataaatgaaaagacagcagaaaatacatgactagcccacatgaatattactaatgtatagttacctatatacagcatatattacaaatctcttgaggtcttctttgtatcacttgagttcctattgttgctataatgaattattccaagtttactgtcataaaagccacacacatttattattttcccattctggaggtcagaaatctgaaattggtttcactgagctgaaatcaaggcgtcagcagggccaattctctcttgaaggtgtaggggagaatccatttccctgccttttccagcttcaagaggcacctgcattccttggctcatggtccctttctttatctacaaaaccagcaacagagactcttcaaatctccctctctctcttggactctgacatttctgcctgcctctttcacttataaaaactctggtaattgcattgagtctacactcagataattcaggataatttccccatctcaagatccttaatctaatcacacttgcaaagtccctcttaccaggcagggtaaggtattcacagcttccagaaaataggatgtggtcatcttggaggggccattatcatgtctaccacaaggtattaattaaaacatcagaagcagttttaaattaatttgccttgtacttaattattatgtatcaatttacctttgggtcagataatatatgtgagattgattcattaactagaaaatgaaaataaaatttttaatagagtttttatactagtcaattattttctgctgaaaggcctttaagttgaatgttaaaattgttattataaacttccatgtaatggtagttgggtagcaataacaataaactgatagttttctgcctgtagcagtattttgatgagactatttttgactgaaactcttattttgtatttaaaaaatcactgcattttatgctgttatttgcttcactgaattatttaatttaatatgttctattaaagagactttaaagctagatacaaattttttctccgtatacatttttaatattcacatttttaacctaacgacctaaagataaatttgaatttctcaaactattcaacctatagtttttcctctgtaaaactgcagtgatactgaacaaaactgctgcaaagaataaataagataatgtatctataactgtagccaaattgctgggccataacaggtaggtaggtcttcaataaacttttagcctgatccaaaatatattccacaagatttgctgaccaatattgaaacatgtttctacaaatactgcagatgaataatactgtgggtgttgtttcttagtaaacttgccaaattttaaatatttggttactctacacaattaaataaaattttaacatgagcatccaagtaactctatttactaaaaatggctgtttctttacatgatatatgactaatgagtgaagctatcctatagctatacaaaatgataacgttaagcattttttattttgtctatctaaaggtgccaatacattgtgaagaaaattctgttaatttcattatatttaatacagcatattccaacttaaagttattcagaagatcaactgaaggcaaatctaaaagacagcagtgctttaagaaataaaagtcataaaacaaaagtttttcagtggttataaattactttcaagttgcattatttcaaatttcttcctgtaatctcatgttcctagctctttaactccctttgattaaatgatgttcctttgctttcactattttctttttgtgaacttgtcaaatcatctttgtcttgtcttgtacaatttaagagacttttatgtagctctctgagcgactatcaccacacaagtccaactgggagaataatttatgaggttcaaaatgaagggtcattatgaatgctgtctttcccgcaatgaatacatacactctcttgttcatgcatgacaggattttaactaaatcaatggagatagatgcttttaaatgaagtattatgaatgatatcattggttacataaaataatttactttttatgtaatctttaccttgtttaataaatttagagaactggaagaaaacttctttaggtgtgggtttatctgtaactgtcacataagtatttctttggtagaaaacacaatttcaaaagttgtagttttatgtccttaggttaacatctagtatccagtcataagccagaatattatgcatagtaagtattctgcacaatgatactaaatgcagaggaaaagcaaagagagtagattttctcaattttgaagagaggttaatttttaagtgtttttactttatcaaagtattcctgactggtgttcagcaatcattggttctagtaatgtttatttggctttttcttatcatttcagtgcccagtatcttttttttttattacaacagacaaatctaattacttctgattaatctcaatagctgtgatttggattatgaatacttcccttccaatctaactgaaatcataaatgtttccatgtcaccttattttttataagcacatggtgtaaggcataccaaataagaaaatatattaacttttatcagagagacaactgtaatagaaaactcaatgtttattttagtatatttatgtatatatgttctattattttaaacagcctgtaaacctaagcctctcctcttatctaaaaatcatccgtcctcctctcattgcctttgcattttcactaaactcccctctgtgtatttatcttgctttttaggtatttacttgtgtgagtagtttatgttttttcatatgtcctgagctctctgccttacccaccatgccttgactataaagaaatgatagctaactttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccgaagccaaaatctaaacctgggttaagagccaccgaacacatgagcatcacccacatctggagaacttcagtgcatacattttccccatgcttgattttcaaatcaccaagtacttttaattaaccttcactattgttatgatttgacatttgttgttctatatatacaactaatatctgccccataccatgccagaacataagaatacaacacctagtattttatagatgagtaatagcagctgccatttattaagcttttgccatgtgccaggcactgcatcttattatttaatactcagaaagatctatggggtacctaccaatttatttccactttagagatgaggaaagtgaggcagagagaggttagatgacttgcccaagatcacacagctagtaaatggtgaagccaggatttaaactcaatggctgaactccaaagcttggctctgaatgagtgaagagatgtgttcctagaaatctagcttggagagtcaagaaaagtaatagggaggagatgacatttgacatatctggaagggcaaagtgggaaagaaaggaaacaatacactcaagggagacaacaacatggataaagtactgaggaatggtgtacctgcagcataacaggtgctcaaaaatgcaaatgaaaaaaatgaatatctttatagcccatgagttaaaaggttttccacatctaagtgttgtatgactagtgctctctgtgtgtttctttcagtgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggtaatgtattctttctacatttcttcttattttgtttaaaaaagataaacaaatgtattattttatgccatataattacagaaataaacaacttctggacccatatcgtttttgagatgctttgcaaacctttcagtcattgttcaagatcccaaagcataatggaagcatttggcagggttttccaatctcctgagcatatagaacagaaaagggcatccatgatcatcaggcccatcttgatgggtttggcatatgagaatgatgcctgaatattttgattacatctgtttaaccagtcttcattgcgtttagagttagaaaaatcagataaaaagtgcctgagtgttttgcatttgggcaggggatctttctaatttctactgttcatagtcactgttaaataactgagttttacggctgttcatcaaactggatgaaagctgcttttcctacatgtccatccagctgaaaaattaattctcaagaataatgagttacatgggagaagggagagaaatatgagccagttctaaagaacacgacaggatagaatttttgccttatgaaaaagttttctttcttatttcttataagacaaaattctcatttcaatttaataaggacaattacaaccataacactggttataaaatccatctggctgggttatctttccaagcccaaaaaagctatttggatgttctttatgttgctatctgtttttggctaaattaattggacaacttggttcaagataatgtttactattattaatgataattattaaatgcctcttcatttttgaaataatatccatgttgaatatctctaaagaatatttaattcatattttaaaattaaaatgtaaatgtacagattttttatagaattaacattttcaattatcaatgttttcatcaaatacaaaagttttatttattcccaaatagcaaaatatataagcagttttataaattcctcttatactattaattactattaatcaaactcttaaacctgaatctccttaagaacaatttaatcaggtgttacaacaggcattttaagtacatttgcgttgtttcctagttcattacacattcagggacattaactccccttcccagcttcagttttaaactctttttcctcaaagacactatagtatctattgataataatttcacaaaggctcatgttttactccctgcatttttgttctgttttggagctatggaatggatgaaatgcctgtactcatactcagagagttttggcctgagctcggagtagcaagggtttgatttttctggcaatttctaatcacagtcacaaaagccaatgcataaacgttcaactacaggtgtctaataaagatttttctcttcagttaatttaagtagaaactaaaatttccaggcatgtcttactttatttccacacttttcatagcaagcaggacttgataaagatttctttaaacaacttattgggagattaagtgtggaaataacctcctagatggacatggactgaataatatgtatgttaattttatcaatattgtgaaaacaataatttgacaatagatcactatctttttcataattatcataaaatttgaatgtggtttccctgtgttctagaactaattaaaattactgaataatgttaagtgataacgatagcatttcttcctaggacaataaatctataatatttgtgggatttgttctgtatgatgtaaaattataatttacagcatagtggtggtgtttattacccctgttatgacctggataaatgaccaagatctcaaatatagagaattaatgggggttaatttttcattgatgatctattttttggatggggagagacagagaaaatgattcaaacaaagaaatattaagaagtcagtgatagtttatactaatctgttattgcaaattatttagaatttcaaccactcaaaaagatgttttcagttattttaggtagagcactttgtctacataggacattagctaggtctcaatttttgtaagttatgaacaattaaattcacagaataaggtacaatttggacagatgaatatacactccagggataaacgtttatataaccatagcttatgctactttttgaagcagacaaaagtagctaatcatgggttccatcattttatgaagaggaaggctaaaaaagcaaaatagaatgtgcagattttaagaggatgtttcatcacatgatgatcgccagatcacccaaaattcaaaacagcatgaatacaaattaaaattattattaaataattatattttcaaaatatcttcagcagaatgttgaagtgaacatggggaagaaaataaagatggcttatgcccttctcgtttaaaaacaagacagatgtgagaggcattttagatataatttcttaatcttaagaaatatctatatataggctctatatacaagatataaaggctctaggacaatcaatacatttttaccattttaattcatatcaaattcacagaaattccaatttcaatattcatggctacatgtctctatagtaaggttttgcaaccaaggaagatttttttaaatattctgcaatgactacaaaaagtatagacatttatgttgcataagatatatatttatgtgttcttttgtatgtgttaaaattggagaacactaaccagacagagggaaaatattcacatgtaaagtcataggtctggaaaggtcatttctccacggttttcactaatgtgtgtggatattttaatttttatttcttccttctatgtccttatctgtgttgtgtctcatgactgttctggactgtcccttgcggtaggtttcctctgctacttagacatccctagtcaacgctcagatacatttagtggcctggcacctggggctccacagctgagggtatatcattctgacacacatcaagaggctgaactaaattgatttttttaaagataaggtgttctcattttaaacacgctaacagattaaatataacagtattagaaagctcaagttttaagttgatggacacaaaaagaaattcagtcccttgtgctacttttctagtgcgccttattaaatccaaatctgaacaatgtaactgagaatgaacaaatgctccttttgatggttgcaaacaaagcacctgttgaatgtcaaagcaaaccatatgcatgcgcacttaatctttgaaatttaagataaggtctgatgttcccaacccagctttttctactgcaatttatcaaacctcagtactgctaggtttacaagctttttcttccgaattttgttctatgaagaggaaaatagtgctcttgagatattataatagctactgatttaataggtctgaatttaatatgatggtacagaaaatgtcttgcttaagctcagcctttgggacaggaatagacttaatcacttcagtgatgaacagtagcactgagaaattatcaaaaatttagccctatttcatgcagaataattgcagagatggtcctgccttctattcaggtaaaaaccacttagggagaaggagatttaatatatcagctatttcaaattgcattgggctgaaacatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattaccgaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaagtggtttgtagctaaccaaatttgataatgtttctacaccgatgtatatcatgatggcaattttcaattttcaaaactcactgaaggctcctaagaaatttccagcaaacaaaggggaggcatcactgacaacagctcaattctgtttatatgaccttcccacctgaatgagttctattaaactgtgatacagctgagtctcagttttttagaatcaaattggagttaaccgggtgaagccaaattagaaaatcttgtaatttcaaggactgagggtgccattttgaagcaccactgaagatccctgagtaagtgggtggattgaacagagaatctccttcctgagaatgctgaacacagcaaagaaaaaagaccatgtagtcttggatgtgggggtagcagagtggaggaactgcggtctgatgactgatgcctatctacagcctggttatacttcttgcatttgagttctatgagaattcttagattcaatttgagagctaagaagagttaagattcctttactttatcagagatataaaacagtctaccactggcttatccattttgatttctgtgagattctacagtaatacatgcatgcatacacatatacaaaaatagcaatgaaaatgctataacctaaaaccaggagacaataattgtgatatataacacaacaatgaagttgaaatcatcaaaatacaaagagcctttgcaaatcaataagaaaaaggcaaacaacacatagacaaattagcaaaggatatgtacaggcagtccccagaagaaaaaatacaaatggttaatgtaaaagtttgtaatcttttcaacctcaggaaaatgtaattttgtatttttttaattttgaataatgactgtgtatagatttctaattaattattctaattacttaaagcagtaagaattacacatccctagaaacaaaacttcatgtacttataacctttgatatttttagcaaaatgtttgcatattagaaaaacacattatatattttgattttttaaaaagaagagcatttgaatgaaacttatgagttagtgagctttctaatatttccatttatagtacacttaagttttaggttataaagagtattcaattggtcagactgagttttgagagttcaatacaattgattttgttcttaaatacaaaacgaattcttatgccaatttgtttttgacagaactgcaaacttaactctttttatcttttgatatcaaacagactcttaatcaatttaattcagcctagcttttggtggagctgttatgaaaataaagtggtaaactgaaattggaagtggggtgaacttttctctaaacacggatttgctggtggtatgtttttttcctctttttcataccatgataaatgtatatgtgaaacacagggaatttaaattttctgaggatcattactgaactatctttttcataggaaataaggcaacaaaaggccatgcattttatattaattattccactgcatgtagcgatgatattttatatgatgctgagcatctctttaaactacatgaatgtgaaacttggcctggttagtagcatgtttatctttcctctgaaagcagcagttttatcagagccaaatacaacaccaagttgacactttctttgcaacaatgttacattttttgcttgcaatattctgaggggcttcttccatcgcttccattttgcttgctgattggggaaagaaattccgtgcacaaaaggaatttaaaaaatatgtaagcagcaaatgtgaatgtgtgtcagacaaacagatttccagcatcttagtgcttgcttcgaacagcttggaagtgtaactacaggcccagttcaatttgagttttgatgaaaactctgaaattcacatgtgatcctttctctatacataggccctcaaggatgatgatgctgaaactggattgacagatggagaagaaaaagaagaacccaaagaagaggagaaactgggaaaacttcagtattcactggattatgatttccaaaataaccaggtatgaagtggagaaatgtcttctaattccattacattttctgaaattaccaagtagaaattgcagcaagatacctcttaaaatattttgtttgctgtgaggggaaaatgcaattatcaaagctatggatgaaataatttctaagaacaggcagtcccctacttgctaatttaacttctggtaattagaattcacagtattcaaccgattacatctacttgtggcactttcagcaggcagacagaatacaaattaacttgaagcagtcggtctgcttctgagagcttctagccacagtctcaccttctcagcttcctcagcctgagctgcagcaaccttccttggactttacagatttagaactagacagggctaggggccttttgagttgggccgctattctagccaaatttttgaaaaataatataatgatttgataagggatcgaagatgaaaaattaattcttgtccattaaatttaaaagcaggatggccttatatgatactaggtgaaactcctagtgctaatgagacagcaattctaaaagagtgagaaaaccagagacttacttctagtgcctaggaatattgcccaaaaagtgacaaggaactaaaggaggtaacaaaacggacatttttgcttcaatttctcaagaagtcatgaaatgtcacctagatgaatgataatattggctaccttttattgactgcctgtcaataaaatagagattgctgaaagacaactgttaaaaatcgcttttcatttgaagacattccaggatccacaacgttgatgaaaatgttcctcaccttctgaattgttaaagaaatgtgaaagctggataagaattaggggaacaggctaagttagagaccaggtttttaaaaatctgtaagacaggcagggtgcagtggctcaggcctgtaatcccagcactttgggaggccaaggcaggcatatcacgaggtcaggagatcaagaccatcctggctaacacggtgaaaccctgtctctacaaaaaatacaaaaaaaaaaaaaaaaaattagctgggcgtggtgacaggcgcctgtagtcccagctactcaggaggctgaggcaggagaatggtgtgaacccgggaggcagagcttgcagtgagccgagatcgtgccactgcactccagcctgggcgacagagcgagactccatctcaaaaaataaaataaaataaaataaaataaaataaaataaaataaaataaaataaaataaaataaaataaaataaaataaaataaaattaaaaaatctgtaagacatagcccttctccaagtaggaaagttttaaacctctccagttcattttgcttctctcatctttttgggtaaagaactgatgaatgtaaaataaatacagttactagtaatgcagcatgtgctaatgatttccagtttgatgagaaatgaacaataaataaatgaaacactaatgctcatctttgataactaacatccaaagtcagtaatgctgtgagagctctaagcagttgcagaaattctgtgctttatttaggaattgacagttctaataatgtcttcactttctaaagtttccagagggttcctcatgaaggatgtacaaatatactgtcatattaaaaataattttttgatcagcttcattatagccctggctagttattacataatacattctagaaaactacattattggtttacaggttcaggtttgtagttataccatttttagttaattacatctgatatttgtggtcatttctatcacttctatgaaaatttgagcatcaggatttggttaggagcaaaacctcttatttatatattctaggaaagatcaaggacaacttatattggtcttaatatataacatattttccaaaaatttaatctggctttctatatgcatccagtatttttttcatcatattgaccattcatattttccagtggaaatctagtggtgtctcattctgattagtcataattttgaagctttcaagttagctttaattattaatactataagtatcattttataaagtagtatttttaagaaaataaataataacactgagaatttttttactaaaatatagtgagagtacatttactgttcccttttcagcaaacatcaaatctaaaaagttatttcattctgagaaactgatgaatttttaaaatattacacattggtttttcccaaatgttctcagttaatttgatttataaagtgattcctaagaggcaggaagttaaagtctgaaaaacttcataaagtttggatcaaatatatgtttaccaaaactaaaagacaaccctaaaatattctaattaagacgctttcatggtacagagaaatgtgatatttatctcttaggcagaagtcagaacaaggttgtaaaaagtaacctcattctttattaacaaaatatccaaaaactctaaattataaatcatctagtttctaaagagtttaagccatctctctagcattttttctgctcaaaagaaaattggttataaaaagtgaggatgaggaagtagaatcttacttattcgcattactacataaaggtaaataccaaatacctacttagcaaacaaagagacagactgtttcctttactaatcatgtctttataatccgatgcctattttagctgttttttgaccatctgtctgtgttttgtttacctacaatctagcactcttattgccactgttgtatcatgattccacaaaaaaaaaaaaagatattgaagcattaaaatagaaacaacataatcattcaggttattgggccatgttaaaagttgagccacctagccaaaatgcacttaagtacacggtgggtcacaattaaaatggttatgcattttttttaagagggggaattgcttttttactctactagctaaaaaggcatgaactcagatttttcaggctgagatgtaaaaacctatggtgttactgcatttacaaaatagcatataccttgaataacagtaagagtctgctttgttacctatatggatctaaatcagtctgttgacacaaaatctctaatggcagagtatctatgatagtctactcacacctctttttttcttcgcaaaaatattaaccataccataataccttaatattcataatgaggcttaagaatgcatcagtaagaaaacagacttaaagaaatgtaatagttctgtggtgtttggaaaaaataaaaaacacagttactcaccattaaaaaacctcacctctaatctcccttgctttctatgaagctgaaattacatttcttttactccgtgtcctatatttaaacacagaatctcatagataataatcattctactgtaagttaaaataaatgtagtctgcacaccagtgaaggtcaaatataatagaaactagaagatcttattttttatctcaaaatgctacccaatttctaagaaatttctactcagctagcctgaggctttgataaagaataaaagtttcccactttgtaattacaaacttgtgattgcttaacaatgcattttcacttacaaatcatgctctggaaagaaaaacaatgcacaagagcttttagcaactggaaagttatttgattacaactcttttgcaaaaatgaactccatatttaactgcaatcagcaaccttttaaaagcctcttttgtgcttaaaaccaggcttcccagagcctgcatcagtcataattgggtttctgaagtctacatagctcagttcatttgccttctgtgttcagattcataagagaatcagagttttattaaaaataaataggaagagggagaaatcccaatatgcagcattgtgaacaaatcgatcttttccaaaatgtccactgatatttatgtatgctgtattctgtcatttatttcagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtatttgttaacatttatttataacctttcctttgttgttttacttaaaagactgatctcatcctgacacatacatagacatgcacatgaatgcttgttcaggcactcacaataattccagtcagaatatgcaaaattcttatcttcactacagtcaacattcgatattgcctttcagcgtgttcagagtaggattcggttcagtcatttcagaatggaatggactagaacatgactaggatgtcatagtcacatctaaaaagtgagatccctccctgaaataaagccaaaggaatgaaatcattatttttctgaatttcaaagtttgtgaaaataagtacatctgttacaatcccaggattaagtaagctgtgtcccaatgcttaaatggtacaaatagacatgactcttgtaacaaaattgtgtgtgtagagggcaatttgagcacttcaaagtcattcttcttaactaatcaataaaaggaatatgaacatattttttattgcatttctagccttcttcctttactctaggttctgccctgatgttcttcatcttgttgaggcacctcagttgacaaacaacagagagattccagccatataatatctcatcaggaaaacatgtcctgcaggtctccaggatcttcgtggatcttggcttgaaatcattcattaaaaacaattcttttggtggatatctttaacgtgcgaaaaaaactttttaatgcattacttagaacaatatgtttctgaaaaatgaaatatctgtgaatatgccagcaggctaattcaaaatcaccacgtccatcagccaggcttagcatatgccttgtgttggcaaacattctgggatgaaataaattgaaaatgagggcatgagtcattttctcaaaccttgttttcaattatgtaaaggggaagtgtctttctattcactctaaaatttctgagttttcaagacaaaggtccctcatgtattgtcagtaatcttatttaaaatctggtttttctgtacctaagcagtgaatttaaagtagcagtaaagacattctggaaatactcagttcatgaagagtatctgctcatgaagcttaatcactatagtcaacatactacgaaacgtaaaatggaaataaaattttaaaaatattgtaatagtaatcacagttgttttattcatctatttattaaccttaacttaggtcagcagtttctgaccaaaacttagtaaggaaattcttaaattatatgagctaatgtattggggctttgttttgtattgcattacctacattattatttctttaaaaaatgctaataattttattagtaatttctataaaaccaagtataattattgaaatttttgaattctctatacatttttatcaagtttcattttatttcagaaaggttgatcaaactatacataaatccaaagtataatatattctgctatattaaaaaatacttcaatttttctagagaactggttagacattgtagattactcatcttgaaatgccaagaggcaatatgatacaggaatggaagtataaaagactttaaagaagcctggctttacaatggatttaaatcacttaacaggaactcaacatgccccaaattaattcatcttcttttcccccaaaacagttatctgaaggagctactaatcattcaaacaataaatatttttaagtgcttcttctgtgctaggtgttttacatatattcattcatccctaaaatagccccatgaagcagccattattacagtattatcacaatttaatagatgaataaacttatgtttaatcacgtgccccaggccctttagttggaaagtccaaatctggtacaaggtctgtctgaccccaagtccaggtttttgactgttgctctttgagtacaatcactagaaagtctagagagattttagatatacaataacattttcaagggtttatccttactctaaaaaattttgtttctttctttgagagtcagctctttggaagggtttattttccattccttctaaaatggaaaaaggatgatgcttactttttaatcatatcattttaataaaataatcaggttccaaacagatggtaaataaatgacagaaaagaaaaactctttggaaaactaaaatttcttgtatgtagatggcccaatattcttccttttcttccctccttaatatacagagttaattgagaaatgtttgctgaagcataagacaaccatttacactgataaaataataggaagtgtatgaaaattgatcaaacctttaagacaagtctaaacaatttcttaattaggtatttctacccagttactgaagtgtagcttacttggattgcactgctttcactgaatattaaaaatgtcactaataaacatcccaacccatagcatctgtcccagatatatttgaacagctggagaattcatcagttcttggccttttgccaccactcatcctaaggcatgtcatacccaagaatgaacttcaaaacccatattataatgcacctcttatattcaaaacatcaatttcctagtcagttcttgtcaatcagcaaattattttagggagtaggtgaggcacttgtgaatatcatttcaatcctttcagactcctagcatagcctttaataaatcattgctccattgaactgtggcatttaaatgccttgaaagagttaatggagcatttgaaataagttatttgcccctcagtaagttacaccctgacaatacaacttaaaacaacaataacaacaaaatattctacaagaaaaacttacttatagtcaaatgcaattggcttgtttattgttttattaatcttaaggctttatagtataactaacagcaggatccattattaataatgctaacagcttctagaactttgagataaggcaataaatcactaaaatttcccattttctctcaagtaattttagcctcaagcagtttgtcaaaagtctgaatttaaaaaataaccaaaaacaaaattatctccctgttctgtttatgcaacgtaaatattaaattaagcaccatgaacaagtaacatgttttaagcatttttgtgactggatattttatcctcatgtcttttaatttaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagaggtaagggaattactagcatttctaacatcacaagctgtactcgccagttgctgctcatataataacttattgagaaatactctttacaaagggggatgtgggcctctagttgttgacagctgataaaatagggtcaagggcactgcaccacctcgttaaaaagtgtacaggtcttctgggtgttatctgaaagaagagagacatttgtgtactggatctagaaacagcaaccctggacacaaacaaacacacatgcccacaggaactctttctaaaagcttacaaaaggccacacacactcataaactactgctttaaaatgacaacgaaaaattattttatttctcatttttccacaatcattttgtgttttctgcataggttatgtagctattacacagaaataaaatggtactttttccttgattgtttctgcatatcacagacagttcattgtttctcctaaagatacgagagcatgattggtcaaacatcaaatataattcacaaagcctgatattaaatccattttttaaatgactcacatttttatgctactcctcacattgtttattcccagttttaatagtttagcccagtatttttccatgacttgaaaagggaagttcaatatgtttagtgcatttaagcttcataataatcaattgtatctgattatgcgatgcctgcctggcaccagcatttttctctgcaaacatttcagtagaccaatactagaaaagcaaacaacccttagcttctccaaattcctaaaacaactcctttcgcagtcactctttagttcctgacgtaaggctgtaattacgcaagagattgctgacagctcagtcatttaggatctccaggtccctaggattccctggcctcttggggtcaccagggagatcagagagaacgtcaggccttcagagaaactcaatcaagtccatcacctgggaatcctctcagcctaaggttttctgtgaccaatctgaggctatgaactttataccccctatatgatgaaatgaggttttagaacaggcctattaattcccatgctgaaattgaacttttcactctaacattgctgtttgctatttgattttacaaaatgagtcaaaaatacttaagttaaactctgctcttttttttggaaaaaagtatgtatacttatactttccaaaaaagagagcagagcttaagtatttttgtatataatattcatgtatacttattatatatatatatatatatatatatatatatatatttactgtctcaatatctaagaatgttgactaacctttcttagacattgacacagatttagccctactgtggatattcaagaatacccaggaaaaataccgagttttaaaattatatgattttatggatagttctttcctataagtgaactaatagtaatgttacagacatcttcatgaaaaaaaaaattcgatcattcagttacaatgtttataattatttaacaaagtagtgggatgtttcattgacttttttgttgaagtgtttgactttgtgtaaattttttgggtgataaagtaggaccataagaaatgtttattaactgattggttttattaattgactggtgtttggttggcttgttggttgaatatgagaacatgaaccactggtacttcacaatgcccacttgtgcagggtgcatggttcacacttgttactttcacctggataattatcaggtggtaatgacatccaagatcacacccagtgggtttctgaaaaattgtgcaatgtttttttctgagctaagggaatgtggaccattgagcaagtttcctctttcagaaatctttgagtacgagcagagtttgaaacttaacaccaggctgacgggtttcactctagaatctaggggtttaggtaaactgcccattcagaattttaacctagaaagtggcctaacatgatttaccccttatcttacttaccgatgaaatagaatagaacatgaagtacccagcatagagtctggcatatggtaaatgttcactaagtgagaggtctctcatacctttttcttggttaattttgtgtgtgtgttctctttccccattttgtgtgttcatctcctcatttgttgtgtctcttccctctatttttatctacttcgctatcctttttctcaccattgcacttactgagtatctgtaggagttattaatgggaaatattaattttatcattacactcgtaaaactctagagactttcctctttgatttctactcaggaatagaaatttttggttttcagttagactatttctctttatcaaggtataggttataaaaaactgtataagacagatgtctagcttacaaagtatctctggatgactagacccagttagaaactttttcattataaaggaagtaagattccacttgcattttatatctgaagaattacatattctcaatgatatctgctctaacttttcatgccactgtccattaattgtagaaaattataattgtgtgaataaattgaagtcttagattgactttagttttatgattttaaagaaattgtttttccactttacatgagcaattttgttcatgattttagttttgctttcatctagcagtgttaagcattatttttaatgtcataatgagatgaaagatatcaaagaaagtgagaaaaaggagttcaaggaacagctttggaatctagaacaagtactgctaatcatagtaagctgttctgccggagacttggatttaaagaggttaaatcaaacccactgacagccaactctgtgatgttaattaaatggagtaaggttttattgccagaaagttgacaactataagtcataagatgatgaagtaattgtgtaacttaaaggattatgtactattttagcgaccaaataatgtgcaagcaatttagaaagaaatgggaaggaacatggatagtgtaagagcctcatttggaagtgactaggcccatgtttaaaaggaagtgatgtggaagagataaggtgtaccaggaagagccacaacaaaagcacattgttcccactattcgattctatccccaggtggaaacatcactggtgaggtttccatttggcttgatcgtgttccgcaaatttacacaatcaaagccacctcactggtttccgttcacttgccggtttgttttttcagtgatgcacggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttcaaaatcatccttggtaatcagtatataattcttcagtgtgcaaaaggctaccaatatgtatagccccaagctgaatctttgagattttcttctctttaatctttcaaaaaataagtatttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggtatatcatcaaagtatttaaactctttttattttaacattttgttcctatttataaagtttatttttatctccatgccttctactgatatttgttatctctaaaaacagcataaggaatagatagcaccagaaaaaaaaactaagcctttttttttaacattccgccctgatatgctgcaagctctcatgacttgagcagtactgttttattgttttgtttccattagagaataagtctatcacctcggctttgtgtaaaatttggtaaagagtgatttttaaatgagattctgtaatctagtgcaaatggaaaaaaattgattgcagaattaaaacaagttggaacataatttaattagtatccaagcagaagggaagagaaactactttaatgctttaatggaaaatcaattttgcaagaaaatttcacatttttaagcctaattagaaaaagatttacttcacagaaaagcatgtgaagaatacatattcaatcaaatggcaacagttttttaacttccaatggtcaattccttagtacttccttggaatgagttaaagtcattattccttatggcatcttttatgcccaaggatcatgaaagaagtgatgctatttctaagtacatttagcaatcagacggcaactatgctctccaagaatctccacccaacgatcaatgccctgattggaaatccttataaaaggttaattgttggaattttaaacatggatgccaataagaaccttcctggtcattcattcacaacctatcacatttgagaaatacaacaaaaacattaatttgcatccatagcatttcaggaattatacttgtttttctttacttgttcattgtctatcttcctcactggactgaaactccatccaggcagcaaccatgtctatggttcctcaccaagtgtaatcacagaggcaagaacacaataggcgtgaaaaactatttttgaatgaatgaatggagatgtttattgtattgtaagaaatgtgtccaaacgccctttttaaagtccgtgttaatagtcattgtgttcatattttacaaatgaaggttaaagtattctgaaagctaatcagcaaaatgtcctagctctgaatgctgaagatagtttagtgcctttctgggtttttttggtatgtttctttaaagatagaggcagtacagatgcttagcaaaatcaaccttgttattgtttttgtttttggttttgaaaatgataatagattttgtctcaacaacttttgtttgtttgttaaaggcttatttagtgtctccctctttgtaaccctctttttcatcctgtttccataatgcacatggagctcatagattaccttaatttttatttaaatgtaagactgaaagctatggtgtaagtctctgcctacatcatggaaattgatccagaggaaaatgggaaagaattagttctagggagaactcaaagagtaggaataaaatctaagtttatcatgcctagaatatttgttgttaatcaattttataatatagtagatatagtttagtagtattgaattattttatagtatattaaaactataatatatattagtgtacctagtatctctgcgtccatatcatgggacttggaacatattgatttccctttaaactgctacagaagtatagatgtgttttattttttacagtatcttgggtcatagctgtggtttatttgagtttgagtctttggttagaatttctgtcaccaattataattgtattcttatgtataataaatgttatccacttcgtgatgtggtttccaagaacatgataggaaaaagcaaataacttgaaatatctctctagtatgtaggactgtaatttgcttgcctttctggttaaaaagacttttcaggcagaggtaaaagaaatccaaattctcactttagagtttctaaacaaaaatccaatattttttattttaaattccctagaaaagtaatataaattagactctaatttgaagcaagaattaaagcaaggagagatcctggacattttcaaaatgcactttggctaccttccattgttctccctcacgttgtcatactttagcctactgcacctgccttccttgtcacagtgataaccacccaaaggtctggtctcacagcctggctctctagcttccaaagttcatcttcattaaagcttatattaacttctctacctatcctataaacacaaataatagctatcatttactgagagtctactatatgctgacaaaaaaaaaaatctcataacattcttcaaaattggcattaccaaatctgttttacaaaacagggaaggaagggaactgagacccaggaaagtttaagtaatgtgtccaagtttacacgggcaatgccataactacaattcaaacacaggtctaaaagcctacacttgccattttttgagattgagtctcactctatcgcccaggctagagtgcagtggtgtgatctcagctcactgcaaccccccgcctcccgggttcaagcgattctcctgcctcagccgcccaagtagctgggattacaggtgcctgccaccatgcccagctattttttgtatttttagtagaaatgaggtttcaccatgttggccagcctggtctcgaactcatgacctcaagtgacccacccacctcggcctcccaaagtgctgggattacacgtgtgagccactgcacctggcccacaccattttctttaaagagtctctcttggtcttttcaggtctgtctggctcccaaacccattttctctctacactgccatattgccactaagagagtgcaaggatattgtctgttttgtttatctacttaggcccagcacattgcactgtgactgcaacatccaaagtgcttaaataaatattttcaagtagattggttgaacaaattagaatttaacaaatatgcattctaatgttctatcacctttgagagagtcatctttaaaagatacccagtcattccagttgcactgtagtatcctaaaatatttttgaattccagtccctctctccaagtatctttctcaatgtataatacattatctgttctcaataatgatttgtctttgctttgaaaaggtaaatctcattgaaatggccataactatgtagggtcaagtataggctattagttgatgatcgaattgggtaaaacagttgtaattactgtgggaaagtgatgagatggatgttcttgtgagttttatattctgattctgtcctaaatgctttgagcattaacatcattacatggtctctcaaatggtttgctatggggaaaattctcattaggagatataaattctgatacacatagtaccaagaaaatataattgttttaatagaaatcaatgtaagtattaggttttctttttatccaaagaataaaaggaccgagagttttcagctgaattttaaataaagcagagcaaagtggatttgggagcctggatttcatgtgtataagctggcagagcagaaagtgaggagtgggagttgaaatgggaacaaatataaaacaaaaggagaatgagaataatgatgtagacaagagcagccttgtttacatctggtttttcatattactgaaataatgaaaagggttttgagtgggaagcaatgtgagcaacacaggagaatgttttgttctgtcttccacagatttaaacctattcaaatgtaatcttttctcttgagttcatcatatgcttgggagcaatattttttatcttgtttgtgaatcttaaaattagatgtttttaccttctgtcttactcctacctacctttgagcaggccaaatgtttgtgctgtaaaatctttaatccattacaatctgttactctgcaattagatgaaatgtcagtgattgacttgtactagttgtactacagaataagggaggagaatgaggactcgctgaaaaacaagagcttaaataattaaagaatgcgagagagaggaagcatacacagacacacaaacttacttgctttaaacatgattaaattcttgccaattatgaacaagaacttttaaatactgtaaattaattttatttattcattctttcactgatttcatcatatattaaacctcttttataagccaggtattgtgctaacttcagggaatacagtggtgaataagatagacccccacgttcggccacctgaccttccgagctggcggggctgaggctggagtcctcccaggagccacaggggaatgaaatttgcagacttccggggcgcctggccctgggcgttgggcgagcccggggatggtcggaagggctgggggtgggggtgggggggcgtgggggggggcggcaggaggagcccgaacgaagcctttgcgattacagtcatggccacccagatggggcagtcttctggaggagaagggctgtttaccggcaatggcaacattggaatggccttgcctaacggcatgtatgacttgcatgatctctctaaagctgaactggcctcacctcatcctgtcttgctggcaaatgcggccttcagtgggaaagtaaatggcagctgctgtgattacctggtcggtgaagaaagacagatggcaaaattgatgcctgttggggatgacagcttttcagatagtgaagaaggagaaggcctcgaagagtgctgaaatgaaaggtgaacctcatgggctgagacgtttggaactcagcgttgtagaacttcagcctgcatttgaagcatcagctgctccagagatttacagctcaaataaagatcttcctcctgaaacacctggaacagaggacagaggcaagaactcgaagaccaaatcctttcgctgtaagtcatgccaatatgaagcagaatctgaagaacagtttgtgcatcacatcagagtgcacagtgccaagaaattttttgtggaagtgcggagaggcaggccgcggtggctcacgcctgtaatcccagcactttgggaggccgagacgggagaatcacctgaggtcaggagttcgagaccagcctgaccaacatggagaaaccctgtctccattaaaaatacaaaattagcccggtgttgtggcgcatgcctgtaatcccagctactcgggaggctgaagccaggaggcggagcttgcatgcggtgagccgagatcatgccattgcactgcagcctatacaacaagagcgaaactccgtcaaaagaaagaaagaaagaagaaataaagaaagaaagaaagaaaaaagaaagaaaggaaaagaaagaaaagaaggaaaagaaagaagaaagaaagaaagaaagaaaaaaaagaaagaaagaaagaaagaaagaaagaaaagagaaggaagcaatagacaaggaatctggctcttccactgcagaagagggagatttctccaaggtctgtattcgctgtgaccactgtggctacaataccaatcgatatggtccctatactgcacacctgaaacaccacaccagagctggggataatgagcgagtctacaagtgtatcatctgcacatacacaacagtaaacgatatttggaaactgtaagcctggaattaggagacataactattccttcaagttttatagaatatcacttgggagattccaaaaccatagctattacatggcaaacctaggataagagcagtagtatgagtgctggcagaccagctgccactttcctatacagtgaaaaaggccggtgaaacaagtacaggccagatttttaaaaatcatactttctcaaggatctccacaaactggagggtgtcctggctgtctgtgtgatagcctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagcttcagattttggtggtacaacatgaaagattaggaaaagcattaataatctgtgggtggaaaacttattagaaatctgagagtaaagtttgagttaaaagttgtttgaacatggaattgactgggaggccaaagatttttaaaagcagaagattcttaagacctgaggaataagttatgtgataatggtgtgtgttttgtgtgcatgaatggaaattgtaaatgttgaattctaggctccgataatcactgtcaacagaagatcaagctgcaaatatttatgctttaaaacttaaattataaagctagttaaatctttctaacaactagttttaatgttcatgggtacattttacctaaggtactgttaacattgtatagagaaagattcatcttaagcacagattggctatcaggaattagtttggggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttcagtttaattacatcccatttgtcaattttggcttttgttgccattgcttttggtgttttagacatgaagtccttgcccatgcctatgtactgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcccaattgcttctttctctgaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcaggctcttttggttccatatgaactttaaagtagttttttccaattctgtgaagaaagtcattggtagcttgatgggaatggcattgaatctataaattaccttgggcagtatggccattttcatgatattgattcttcctacccgtgagcatggaatgttcttccatttgtttgtatcctcttttatttcattgagcagtggtttgtagttctccttgaagaggtccttcacgtccctcgtaagttggattcctaggtattttattctctttgaagcaattgtgaatgggagttcactcataatttggctctctgtttgtctgttattggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaatacgctttatttccttctcctgcctaatggccctggccagacttccaacagtatattgaataggagtggtgagagagggcatccctgtcttgtgccagttttcaaagggaatgcttccagtttttgcccattcagtatgatattggctgtgggtttgtcatagatagctcttattattttgagatacgtccccatcaaaaagtgggcaaaggacatgaacagacacttctcaaaagaagacatttatgcagccaaaaaacacatgaaaaaatgctcaccatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaagcaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatggatacatatgtaactaacctgcacattgtgcacatgtaccctaaaacttaaagtgtaataataataaaataaaaaataaaattaattaattaattaatttttaaaaaggaattagtttggggaaaatgtttttttgtggattctttcatactgcaaaagtaaaaccatttgccttctggggaattgagctaaattctcatctagtctaagactaaaatgctaaaaacaaaaacatgaaggaaattaaaaccccttattattaaatcgatttgtaaaaatgttgttactggaaatttattggacttgaggccttcttccagaaaataaggacttgattgtcagggcctgtattaggttctgaaccttaatgccatgtattcgtacttatcagaaattatttcagtgaaaagtacattagcagtatgaacttctgatccagttggaagttcttccatttgaaaaatgtgatatttgcatggaactgttttcatctttttcttttctagtcccactcccccacactggatagaatttaagctagaattttcccttttgataaaagaacaaaaaatgaacatgttatttgtaagttgatgtgtagtatctagtgataaacttgaaacactagaatacatgacaagcctaatcttaggtagtcttatgaaaacgaatctcttacctatcttttgaaactatattcacattgatttttaagattttttaagttatattttttccttttttcttcagagctgcttcttattttggcaccacttttttcttttattgtgtaattcacaaggggctgcattttttttttttttttttgataaggcttgtaactatggctggatgttttgctctagtcttctaagaaaggccattttatttttcagagtcacttataaagtcatgtgtaactaactttgtagactgttttgcatatgactgctgctacaaattaaaacccaaatagacctcattgcatgtcactctatgaatgttgacaatgaaaggaataccttgcctgtggtatactgtcacttttggactgaaaagctgaggaagaaacttaattttcttttttgcataagtcagaaaaacttacagctggtgttcccagtttcctggttgactccagcagatgaaatgaacagatagtgttaattcagactgaagaaattatctgaatcttggcttgtgtagatttacaatctacatgcaatattaactaaatcagatagcttttacagtttcacatgtgtacataggttccctcccagtcccttccatacccattagttattgaactttctaattctattgaaacattacaacagtgttttgttgcaccaattttataaacttatgccgtgcaatacgtgttatttttctgaggcagaccaaaggtaaatttctcaaggttcttgctgccttctttagcagtatttgagggaggatcttttatacatttgtaacagataaaaatgaagcagattgcaaatccttttttaaaatcttaaaccatgtaccaagtttttggtccaaattgtgtaggataagttaaccttaaattgcattctattaaccaataagagggtatttccgtaagcatagttatgttgaaatacagttttaaaaagcaaaaaaaaaaaaaaacaaaataaaagatagacctgctaagcttagtcaattaaaaattaatggtgagacagaactacagggtagattaaagctcagcctatatgcatcaccatgactccgcttactactgatgtctccttcggcttgttgcttaatcctttcataaaatgggattagtatttactcacctccatgagttgtgacacactctaaatgagataattaatgtaaagcacttagaacaatacttggcaccagagaagctctcaaaaaaatattagcggggccgggcgcggtggctcacgcctgtaattccagcactttgggaggccgaggcgggcggatcacgaggtcaggagatcgagaccatcctggttaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaattagcggtttttgttattaaaaacattggtcagagcccttatttccttgccagccgaaaagcattgctctgatgactagatttacatccttccttttttgaggacagtgggacagcctaagtgttcagaaggcattgtcatacatggttttaataaaaaagtggatatctgagcctagataccatgtgcgagagtctgtgggatgtgaaaagattgcacaaagacgaacccagtttaaggctcagcacgtgtgagtggaagatagtgctaccatggtgtgacctcagtgattgtgcaccaattaattcctctaagctctgacaccccacaaaggaactcaaagtttcaggctctgctaaaataagacagacaatagcaagtgttggcaaagatgtgaaaaaattggaattcttatacgttgctaatggaaggtaaaatgatgtagccacttttgaaaccagtttgacagttcctcaaaatgttaaataaagttgccatgctatccaacaattctactaagttctacccaagaaaaatggaaactcatgtatacacaccaaaaaaaatgtacaacaacagtagtagcatttttcataacagccaaaaaagtagaaacaaccaaaatattcatcaagtgatgaatggataagcaaaatgtggtatatccatacaatagaaaattacttagctgtaaaaagaaatagtcttgatacatgctataacactcatgagccaaaataggcaaatccacagacagacagaaagtagattcatgcctaagggtaaggttagggtaggaaatggggaatgacaggtaatgggtatgggattcttttggagtgatgaaaatcttctagaattagatagcaatgatggttacataacccagtgaatatactaaaatccaccaaactgtacactttaaatgggtgaattttatggtatgtgaataaataccatttttctcaataagctgtttcttattttttattttctttattatttttatattaaatacaattaaaaaaattatttgagacagggtctctttttgtcacccagaccagtgtacagtggcacaatcatagctcactgcagcttcaaactcccaaacccaagcaatcctttcacctcagcctcctgagtagctgggactgcaggctggcaccaccatgcccagctaatattttttgtttgtttgtttgtagagactggatcttactatgttactcagtttggcctcaaactcctggcctcaaacaatcctctcacctaagcctcataacctgtggatcaccacagccagtcctaaatctgtttttaaaaaaaagtttcagggacagagatcctaaacatcaaagcatgatgctccaggctgactggggttccatgtgaaacagccctcaggtgtgctggaaatgtctttcctggggctgtttcaaaagttttgggatattcgctgaaaatattctagtctctctttaaagtagaacacttgtctccaaaatcacactccttattaccatttctattgatataagggcagtactaaggttcactttttagagatgaggaacccaggcctaggacatatgctagccaatgagagctcaagatgtaaatgccagtttttctgattccacagccattttctagtagtctactctcccttaagacaagaagtttatgcctaattctcctgatgtaaaaacaaagttttaaacatgagaaccaatctttttgcagcttgttttcatactgtagcttctcagagattcccccaagttgctcttttccagacctttttcctactaacatcgtgactttttaaattgaaataaaattggcatgcaataaaatgcacagatgttaagtgtacagttcaatgagtcttgacaacgctatacacagtgtaacaccaatcaagctacagaacatttcttatccccaaagaagttcctcatacctctttccaatgtgtcttagtgcaagctcctagaggtaacttctgttctgatttttcttaccacagattagtttgcctgttttgaactatataccatggaatcatgttattttgtgtctggcttcttcagctcaagatgatgtttatgagattcttcatacagtaatatttcactcctttttattgctaagtggtattctattatgtgaatatatcaagatttatccattttcctattggtggacttttgggttacttccagtttgagattgttaggaataaagctgttgtacagctttctgtggacatatgctttcatttctcctgaactgctggttcataggtaggtgtatgtatcacacttctttaaagctaaaatgaccaggaccccaggtaatagtctatacaggaatgtgttgtgatacctactgtacaggcttcagtcatgttttcttttcattctcactagcctccacgatgatgctcagtaccaccttgattcttgacctgggcactatgttgtctatcgtccaccgtacaactggcacctcataacacacgtttattctctaagtgtaggtgcatacccacacaatgctgttagataaaaagatgccttgtttacctgtttcgttgtctcgataggtagaacataagcttcttataagtgaggaaagcatcttagcacttttgcacatcacagtaattagctcttaggagaaagtatggcatggatcaaatgagcatagaactcggagtccaagtcacatcaactctctgagcctcatttccacatatgttaaatattattgaaaaaatgtaaaataaattatatacctatgtgtttgaaatttaaaagttatttttcaagcataggtctgtccaatgccaaatgaattcctaaaataaacaatcggatacatcgagtagctattcactttcactattttatggggggaaaacaatccattgtttacagaaccgtttaaaaagtttaggagtattttcactctcactgcagggctagtgaacatctcagtatctttgtcaccacttccttccatccttcccagatttcaagtgcccgaaggcaaagtagaatgacccctaagcttttttcgaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaacccagctcaagtcaagctatctactcacaactttaaaatgcttatagggcactgttgtcagaggtgactgtcgggcgaagtgtcagagccctggcatcaggaagtgctcaactcacgtgttggtaaaaagaatttaccaacaacagcataggtttgaaaaggaaaagtttattggaaagaaagaacactgcagaagagtgcagcagtgcaccgcagtgagaggactgagtgcactgctgtgggtttttccttaggggtattcatggaccttaaggcgggagcttaagggtaatttggaccgtattagtcacatagatcatgataaatgatcaagtttgtagacattttggtgtgttaatgtcagcaagggttgtaaaatgagttttggaatggcattactgatataagatactgagctgtgaagaattgccccaaatttaaaaatttttaaagaatgagaaagctaccaaaaatgtatggttccctaaatgtactgcaatgggaactatggcactgaccattctcctaaatttccatttctatataaagagatgtatagaaattttaattacttagaaagattgaaaaaggcctggaaccagaggccaactttggatattaggaaagtctaattacttctaattttcccagataaggagttgtgcctccggagggcctgtttaatagtcaccgggtgacccgtactctcttctaaattcctcaaataaggagtttttgtctccggggccttttcaatggtcaccaggtgattttcactctcctctgtgacctggtttgtcctcgaatggaaccctgcttccagcatcccttctgaaagccttctacatcaatatttctcttttcatgtgaactataactatgttatatgcaagaataaatttctgggccctggataacactagaatacagacagaaacatttatgagtgaagcgaaaggccccacgtacaattctagatgaggacaaaaaggaaaatttgaaactatctctagtcaacttttcttattctctaagctgcagatactctggaatgtagtcagaggttgagatttgccacaagttaaccaactgctcttcactttaagctgtgatttctacatgaataaatcaatattccgacaaggtgcttccctgaattttaacgttctgctagtgttttaaagataggagaaaaaaatgtttttcagaaaccaacatagcgtcagaaatagtctgctcttaatcgtatctcagtgtcaaaaaacaaaaacagagtgagattagaatattaaaataggcagagagtgtggaattttatgtttttattttataacgtatttttggatagcctctcaagtcataaacagggaatatagaaagcagactttgaaatgcccgcctgatataaaataaacattaatatttaacttagaatcagaggagagatgtacgcctcttttcaaggtcatcaactttccaagctgtgtcacactgatgttctgtttatgttgaagccatgctgccatgtttgaagatgacataaaggcaatggaacctatgtgtcgcagtaggattacctaattttggtttaaaaaatgccatttttgtttctttttggtaaacagtgctctctatttcctggaaaatcacgtatagtgcaaatttacctttactcatgtttaaggtcacaccattgagtatctgcttaagtcaagcactgtgctcagtgtgtaactcatttactcacaacaacactgtggggtaggcgccattattatccccaatttataggcaaagaagctgaaactcagagaagttggaattccacgtggccaagtagctaataatggaagggctgagattcagaattttgtctgaccataaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccagcatccattcaacaccactcccaagtctcttagctgctcccaagatttctgggccactctttccatgatatacatatgcatgaaaaatctcatataaaattcacatgcttctgttttcaagtccctctattccccatcctttgctttattccattccacaatagtgcaagttcctggaaaaacgcaataatgtcttccatctctttcatcaccttcccttttaccaaataggatgaggagcatggagtagaatatccatccctgtaattatacctaaaacactaaagatcagtgaagtgtgtattttaatgttctccaaatagtatttaattaggggtacttgaatatatgagaaatgtctttgcaaagtaaatgttttacgtgcttagagttttctaagcccttgtgtttcataatgcaatataagctctttattagtaccctctggctgagataagatattgagctgtgaagaattgcccaaaatttaaaactttttaaagaataaaaaagctaccaaaaaatgtatgattccctaaaatgtactgcgatgtgaactgcagcactgaccattctcccaaatttccatcccaaaaccctgcttctcatgaaagagagagagaaaaatagggagaaaaaagcacatgctgcatcttacaaaaccagatagttactaaatgcttgtcatttggtccccaaattatcctttcttgaaatccaaatctttaatattttaaagaataaattgcagcatttctgccttgaggtttttatgtcatcttcataggaatcattttgaccaattttacatataacttagctaaatttttgtgttagatctgaatcttggagcataactagtctgtattagatgaggaacagttgtcattttcagttatgactctccaaacgtcatatcagctggtgctatggctctgatttcctctatcagcagcacctctctcgggtaatttatctttttttctttttcccctttttttttttttttttttttgagacagagtggtgcgatctcagctcactgcaacctccgcctcctggggttcaggtgattctcctgcctcagcctcccaagtagcttggactataggcatgttccaccaggcacagctaatttttgtgtttttagtagagatggggtttcaccatgttggccaggatggtctctatctcttggcctcgtgatcggcccaactcggcctcccaaagtgctgggattacaggtgtgagccaccacacctggcctctcgggtaatttctgaagaccttgattctcaccaccactgcaaacccccaaacccaacccattctacctgctggcttgtgctccctcttcagaactttcctaattttgtgattctagttgctgttcagtccccttgagaggaaaaacaatggacaaacttaatttaaatctgaaataactgattagttcaatgaaatctcacaaactgtgttacagatattattaagacaaatttgcaaattaggaaactgagactcagaaaggctaagaaatttatctggaatcatataactaaggaagtaatggccaaaaatttaaatcaaaagtttgccttactccaaagtgtgtgttaattactattttaaagttctgttaaagcagggacttcatgttaaattcctagtattgggagttcaggaaatgttcaagaaaagcatgagggtccctggtaatgaacttatgaaagaaatgtatcatgtgaatatggtgacttttccttttttaacaaatggattgaaggtttcctgaaaaagtgatgagggataactttaaaaggtgcctatttaaattagcatacaggcagtttgaattctagttcttcctcttttagtatgttaaagggaaggaaatggtttatcccagtgactgctactccatagacacctgaactgaacctgaaggtagaaaaggaatgggacttagctgaattttaacaaggatcatttaggccagggctgctgttcagggcactgggtttgagtctgagactagtatttaccaaaatatgttatacaagtcatcaggggatacattcatggaaaaactcagtacacaaggacaaggaccaaaccttctttcagatcctcatgttgagcacataatgaattcagtgccctgggctagaatttaagtaactgggaacagaaaccagttcatcatgtgtaatttctataggaagataatgcttcagatattgtgtggtctcctccaagtggagcacagccacttgcccagccattagttagagtgcccggacgagaggagagaagcagaggctgggaacgtaacaggggagtgcagttgattgttcctctcagggccaagatgaagtgacccaccgtttcccaccgcccctctcattctcagtatacagtctggtcaatgttccctaagaaaatgattcattcagcatgccccatttccagttgaaatcacatacacttgacttcagaactgagaacgaaaatggttcttcctaaatgcaagttctggcatgcctaaacaaaaatttcatatatagtaagctaaaatctcctaaagagtttaacgcataacttattcaaacgtattctgagactgtgaaaattgaggactcatctatcctcaaatggaaactgccgctggcctcatcttctgcaccttatctttccttttaaaaaaaactctgagatttaccacttacatgcctgcatctgtttggattaactttcatgttccatatatttctgtttttattagttcatctttgtcctccaaatgtgggtcatcatacaagtgataagtttaagtaagatttacattctctttgttcttatgagtgtatcagtgaatattattaatattgcctcacatttgcaggacactttaatgtgctatggaagccattggaacccagccccgtatttctgaaccaaattctctcctccctcaaactctcggggcgttgggcatttcctcaattatgtggcgtctatggcagtttctaatctgattggggctcttaaaatagaaccagaatctcttttttggagtgagagagcgcagtgatgagtatttattaattaagggaaaagcctccacttgaggcagctgggaatgactttctgaagacactaaaatccaaataaaaagaaagacattcaaatgtgggaagaaaaagtaaacccagtaagaccctcctgaaagtgttaaatgttgaaacgatatctgaaagaaccaacttctttggaggatttttaaaaataagaattggggcatggatttgtagtcttgcttcaaggcaagggaatagacaaggtgatctcccgtgggatctaacagccctgtaattcatcaaagaaggtatttaaaagcaaagccatgggggaaagagaacagtagcatcaatctaaatcaagccttacatgcattttctctcttttttttttttttcacttctaatctctccctgcttttttgtaagacctatcacagcaggacatactctctacaattactttgacaaacaatggtaacagcacttgggtttttaatgtcttccaaagtaatctatttttgacagtgaaaagtagaggaaactgattcctgaagctatgaactaaaatgacagatttggggatctgatttaccagagtgggttttccatatatcagcccttgctgacattcctgggcaagtacccacaggcacaaactcccaatggaaagtcggataaatgtaacacaaacaacagtcataagttgactttcctatcaggtaccttgtgaaaaaataggtacaacattttataaatcttttattttaatgaagtttacttaacaccgaaaacgtcagtccagagatgtgaaatcttacattataaagaattatggcaaatagaaacactaacaaactgagcctttagctgtcatatctgaaatactatacatacacatattcatggatgccaacatgctgtaacataattttacatattaaaataggctcaattttcaatgataataaaatggttactgatactatgacttcatggaatattagatagccattaggcatacttatatggaaaaatgttttagtatgttaaatagaaaaagcaaaatataaaattatatataaattatatatatatgcttttgtagtgggttttaaaaatatttgcatatgtataaaaataatttgggaatccatgaaatgagaataattattttaggaggctaagattatggtatttttgtttctattttcttttttttttttttttttttgagatagagtcttcctctgtcacccaggctggagtgcagtggcgcaatctcagctcactaccacctccacctcccgtgttcaagcgattctcctgcctcagcctcctgagtatctgggattacaggtgcacgccaccactcctggctaattttttgtatttttagtagaaacggggtttcaccatgttgttcaggatggtctcaaactcctgaccttgtgatctgcctgcctcggcctcccaaagtgctgggattacaggcgtgagccaccgcgcctggcctgtttccattttcaatatacaaaaatacaaatgcacacacacagggagataacacatttgatgtaacaaatgaccgtgctttcagaattcagtccagtatattatggttgaagaacagacttacattaagtgttctgccacgagttatcagaaaaagtcaatagacccacatgaccccgccttcattcccttttctcctcttaacacctctgccagcaagaacacacacactgagtgggccattgtaacttagatccatctggtaagattctttttcttcttccaaattagtttgttccaaaaattatccagcagattgttcaagagaggcatttaatatttgtctttaagaaatgagaaaatagggaggtcaaaatgaattagcatttaaaaataagacctatagcacccctgcggtgcatctgtggggtttgagatgtgcagcatcatacaaatatcactaggaaactgagacatttggaaacagctaagaagagccacgttgctggaaaaaaccatgactggcaaaaaaaaaagctttttgtgaatattccataacctacaaagaacgggacaaaaataaatacataaagacttataccctggaataacacagcagaaaatatcttattaaaaggttttcactacctttgagataccatgacataatcatattaatccaaaatacttccttgaagcatggatttttaaagcttgactttttaatgccagttgggctgtgttataagtagccatcagattttttgtttccttttcctggccaactaccaaaaatctttggtagttggtgagtttgctctactacaagaaaacctggtaaccttgggatactctgctgttaatatccgattcctattcaagtatcttcccaggaaaagcatgggggttgcagggggaggccaaaccatctgcttattttaacaaggcttttggccagcttctcatggttaaggagcgctaactctctggctagcctaccagaagctcagagaatgagagttcctggtatttacagtgttactttttaaatcagtttcagaatgtgattagcacaccttcctaggtaggaaaaagctatgttatggctgaaaagaaaagaagcagatactcttattcttggtggatgtgggaaaacaaacaatttggatactgaataaagaataaatactgttaagcacttaatttcatacacaaaatatatagagaatttattttaagctttcaattgccttttagatgccaaattcagatctatttatagatgccagctttgagtaattcaaaaatttatataaaatcatttctgtgaaacttacagtttatggaaaacagagaaaggtttgcccatttcaggtaaggcctatgatttcctccttttacactgatttagtatggctacagataaggttcatggaataagaaggtttttgtagtcagacctgggttcggattgcctctgccattcatgagccatgcaaacttgaagacagctaacctccctgtgctttaatgttctcatgcataagatagagaatataaaacctcatcacagtgttattgtagggattagatgagatgcaatatgcaaaaacacccaaaactaacaagtatgcagtcaatattagctccctttcctcttttccttcttccaggctcttgggctactgtaatttacacattaactcattctgtaactttaatttcctactacctctttaaaatacagaccatatttattgatggggggaaaatatacaaagcttaaagcatgtgccgtaaaatagttccttaaagggtagtacagcaaaatggaacacattttcttgcccattcacaggacgactgtgaattttagcataattattgaaaaaaactcagctactctgactttttacaatatctagtgatcaagaaaacctttagatcatattacttttcctctcaatgttgtagttaggctattcactcagagaggcctgtgacaagctatagttaataagtcttccatggtgtcaaaagtaataatattaacacgcctttgtgagttaaattaattttgttttgtgcactggcctgcataaatgtgaatgacatttcaaaatatgatcaggcagaagctgagaaggagccaagtggcaaggcagaatgagatgcggtcattagagcagagcagccagctgcaagcatttgtcagtgcaggcaaagaggtgcaggatattattacagcaaacttagggggttgttctttcagttcattttgccctttggaaaaaaaatactgatttttgtctttagagaaaaatagagatgtttgacatccaggctctccatgtttggaaatgaaagaccatcttcctgctaatcactgatttcaagtgtctttcaacccacagattttttttctctgcctgcgagaggcagctgattggtaatagcttttaaactaatgaccaaacagtggcattttaaagtcttaatggttgtgtttatttcagagacttcttcagattccccaccaccaccatacacaaaggcatatacctcctgcaaatagaacaaataaatatgctgtctgtaaacagttaaaagatacaggttgaacctaggaagaaaacacctcaggatgactcagggatcagatgaccaaaatgactggtgtaataagttttatactttttaccaaatggctggacaagcccttttccacttgagttctagtattttgattactgcaatcagaaatcaaattataagaaaaatggagatgttcctattaaggcagtcaccgtaaacaagaactggataataatttaaggggctctgtacctcttcatatgttaaacttgacaatttaggcaacatcccatagtaatgagcctctacatttctttcatatatctagtatcacaatatttttgtctgttcagaagtactacacatgcaacaaacaatttttaaatttgtctatagaagtttctctattttaataaaatgaagagcactatattcagagctctgcatattgtttagtatccacagcaatcctacatgatatgaaagcattgttatcctcatttcacaaaggaaaagtaaaggaattccctgaaagctataggactgttaagtcacagaatctgtgttttaactcagatcaatttcactccaaagcctgtgctctaggtaacatatagccaaaaatacccatgccctatttccttctggcaaccaatccactgtgacttctatggtaaacaactatgttctgtagcttctgcatttaactatctcaaatcaaaaggcaccagcaaaggaaatggcttattctggaagattttgcattaatctgatgattcacttcaacaaacatacatcttcagatcatttcatgctgggcactggtgatgtaaagatgaattagacagtgctaggctcaaggacttcataggcgatgaggaagggatgatgctatctggaagtgaagagagttcagaagagatggtcagaatgtaaatttgaaatgagttctaaaggatgactaggaattcaactgattgagaataagggcttccaagaagaggaagcagggaaagcattggaacatgtaaagaacaagatgtccagatctgattataatctagtactgtacatgtgagaggggaatggcgtgaggggtaagccagaaaaaataaataagggtaatattttagggccttgaaggtgggagttaacattttaagtctcacatttgggaggcagggaggatattaaagctgtcagtggccacatcagctctgtgtgtaagaaagccaattttttggcagtgtgaagatgaattggaggctcttgcctccatttaggagtccatgaacgatatggctgtgaagacagaatgtgaactaaaattgaaaaagtattttcaaaacaagaatttgcagaattttgttactgatcagatagagaggtgaggggcagagaaagctattgaaaataatttcaattagtttggttgactgagaaatgagcaaacaggacaataaatgaaattacaggaagatgcactaattttaagggaaaacattaagttctgttttggacatgttcattaaaacagagttcatttctatttaagatgatattacatccttttttaccccaccacaacttgttttaatgttttatatgcagtatttaatgttctcctaaatagtaccatacccacagtcaaggagcattatttaatttatctgattccactatctctttaccaacctaacacttctttaaaattactcatggccgggtgcggtggctcacgcctgtaatcccagcactttgggaggctgaggcgggcagatcacgaggttaggagatcgagaccatcctggctaacacagtgaaaccccgtctctactaaaaatacaaaaaattagccgggcgtggtggcaggcacctgcagtcccagctactcaggaggctgaggcaggagaatggcctgaacccgggaggcagagcttgcagtaagccaagatcacgccatagcactccagcctgggcgacagagcgagactccatctcaaaaaaaaaaaaaaaaattactcacaaagaaatcataaaaccatgtttttttctttcaaaagaattccaaaggaaaaaaaatgccctgaagaatagcaagcatggcctttatctttgcagcttaggatgctgcattttcaggtttcctcatggactttgtgatttccatttcaacacatcccagttagcagccaggtataacaaaccgctacaatcatccgctctttattgtgctgatccaagctcatggccacagaggggttaagtggaaaatgaaatccaaactgtgttatccaagcacaagattcagtggacttcagctctgaaagacccactgggtgaggaggccgtaagcaaccctgcagaaggagagccttggaaagggcccaagtgtggtaagatacacacctccacatagatgtcttacaaggcctcactccatgtgctcttctgtgtgtctaagaaaaacctggtaagagagctgacttaggggaatgtctctatatgaacacttacatgacattatctttccattaattaatatactgaaaatataagtgtctgctatgtgccaggcactagctgagcacgaaatacacaaagttggataaaacattttaaaattattcttaattacctatggatgggaatgctactgtacttgaataataatgaaataactagcatgcatgtacactttccacattctaggcactgttctgaccactttatctcatctcatctcatttaatcctcacaaccaggtgagatcagtacaattattatccccattttatacaataggaaacaagcttagagaaatgaaacaatctgcacaaggtcacctatctagtaagtggcaagccagagtttccaagctgtgtctgtctgacttaaggcttcagctgcaaactcctactctgtgtaacctaacaggtgcttcactcacacagccatctctacactgtatccattgaccttcagccatatggaaacggagaagatagcacttattgcttgtttagagaaggtggcttgcttttatctttttctaattcactccttaaaataatccctttcttgcatttatccctcttttttgcagaaagcatatctttccacctattttatcgtatttgacctcattaaatccctataaggagagaggaataaattttattacccctcctgagtcaaggcactgtaatacatctcctcttagtcaatctgtttaactcaggcaacctcaggaatgtaaaggaaaatcagaagcttgtgtttggacatgattctgctcctctgagaaaccctttcacctcaacagtctacagatttccatggaagaccttgagacggtcattcaggaattgtagcctgctgtttcctgtgcattcaggaagacatgaaagcaattacaaattgcttaacagatgatgcataatattagagatgaagaatctggctgtgaacacttgcaccagggaaattctgctgtgtgatttctcttccagatcagcaccttgtgctaacagtatcgtactggcatgatgctgagtactcctaaataatgatccagtataagaagaaaattaaaatttcagaaactttcactacatagaagaaagagcatggatgtctgtgcttaacagacctgttttctgagttctaataacattaggaaaattacctcacagggctgactctcaatttgttcattcacaaaatggagataataactatatttcagggctgtgaagatatgaaataacttacgtgaaatacctagcatatagaagctgttccataagtgatagcctgttgttgacattgactaacatttattgagcacttagtatatgccaggtgctgttgtatgcacttcatatgtattaatccgttaaatccacagaacggtcctttcacttaggtactattatcatttggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttcttagtgaccccaggaaaaattgccccagcttaactctgtaacctgttcaattttaccctcacatgcaattgagaagtgttcttaatttataacagcaacagcttctttcagaaagctttcccacctaactgtaccaatctcacctataagcgacatcattggctcatttctctaccttgaatttcactctggataaatttagaagtcaccttttgtaattttacacattttctttaaatttttcccacaacataaacctacaagattcttcttttttcttaacagcttgcaaaagtggtcatatatatctatgattcatctccttcagccaaatggtctgaaatattcaaggacttcaactgcctaaaggcttttttcagataacacaattgtgcatatactcttttcagctttaaattcaaaatactgtccattagatttttcatattctcctagttgaaagactttttaggacatctaaaatttgtgtgaatttttaaatttatgtcttttgagttattttcttcttttattttgccaagaattaatatgcattttaaagcaatagaaataatttgtccctttgcagcattttttatccctttgcagaatttattagacaatagttactacctttatgaagcagatttcctggacatctacaaacttctttaaattacagtgttagtagtaaacatgcttttatgagattccacatgtggaaaaaaataactttttaagaatgtttagtttgatctctgcccaataggatatcatataataaaattataggtaaaagccacaaaaaaaaataaagtcataaaaaatgataaaagttatctggtgaaattgattagcaatgtatggatcatttttctcatttacatttttctagaaacttattaatttttcttcatcaaaatgtgatgctcaaaagttgaaagccagaatgccatcacaaataaggaggaaaattgtcgtagtttagaatgcctaaagttacaattgcataacatatgctgttaaaaaaatatatcctctattagtcatttctcacaaaaatctgtgatgaactttacataaccaaaaaatccctggtatctcagcagggtcactccagctgtcagtgtgaatacatgcaaaatgaaacaaacaagatatacctattttctttctttgtctgaaaaggatggctttcattcaaattcacatcatacatttgcagataaactatatttttgcattgtgtgatttagtgacatcacattttcatgcaaaggaccattgaattccctaatgatgttctgattttcttaacaatgaacaccagtgaactttcccctaggcaaaccagatggaaactaaatcgtttctgcagaatgaacgatttgtgaaatcttggcaaattgaattccaaatatacttagagatgatcttgactttctctgtaactctaccacaacatgcaatgcatttaaggcctacatgggaaatacactaattagttgcataacctttatgcagaaatgaatgagaacagaagatcaccatcaaaggaataaaagtcagtaactccgaaaaagaagtaatatgcagatgggacatcttcactaagaaagtatgagtttaatgtagatattgtgggaggtattcccttgtcatctttgaattggttctttttaacctgctttgtgaaggaggtaactcattaagcacgtttctttacattgtttcaaatacgtcatttagctagttatatgaaaatctgaattcaaattcttaatctatgtgtctacattttctacttcacacactctcttacctataccccaaaatggaattaaatggactgtgcatgaaaaagattttgtttctattacccacaatctaattatattattttcacagtgacattatgaaactatccagtagatgcaacatgtttgtcacacaaaagataaattgtgctttcttctttatttcaagtaaagaatccttacaattctcatagcattccatctacagagggttataatttccccagatgtgactaaaatggccatagttatcattaggttttatatcttgtctgagtccatttaggctactataacaagataccataaactgggtggctcataaacaacaaaaatttatttctcacagttctggaagctgagaagtctgagatgaaggtgccagcaaatttagtgtctgatgaagtccgcttactggctcatggtcttttcaccatgtcctcacatgtcagacggggcaaaggaattctctctggcctcttttacaaggactctcatcccattcaggaagactcagccctcatcacctaatcacctcccattggcctcacctcctaataccatcaccttgggagttaggatttcaatgtatgaattctgcggaggagacacaaacattcacagcacagtgtacctattcagaaattcagatattccacctcagctactatgtcatcaagtaatcagggcttttttgcatttttacaaggttcactcatatctaaatctaaatctaaagagggtttttttgcatctttacaagattcagccactcaatgtctttaaaaaataatgaggcaaagtcaggaaaacgctttttagaaagggttattctactggcattaaactagcaagaaaaaaaatattggcatctttcatttatagaacaggtttaatttctcaacacttttatgttttgacttgtttattcctaccagctctttgttataaaagatagttacattattatttataaatctaacaacaaacaacaaaccagccaaattcccaatgttgtttatgtatcatttttcaaacctattcatttttctcaaattgtgattgttttctctttgtcttgtttacattttttcctgccaagttaattctccaataaactttatacatggtccgtgacattgctccccttctggaaacattgatacccaaaatcctactttatatttttacctttgcttttaatgagaaacccaaatgtatcttaactcttcaaaaaaaagttactgagtatacgctatgtgctaggcagctttttctttttaatatcactattgcctgtagcttagtttttcatttttacctcatggtcttgaccaactaactccaaacttttcttactgaggtacaaactaagaatgactattttctctgtcctatgcctttcccacagttaaaaaaaaaaatctctcttgtctgtaactctatattcatatggtgcacactgttaggcaaaccgattaaaacccaggacatatttaatgaaagagggagaaaggtgagcagatatttacggcacaatattgcaagtgctatactgagggtttgggaaggtgttacagaaatgcaaagaaagaagaagggccaaacttgaacgagaatggtcagggaaaggctcggcgaggatatgacagtgagaaataagtaggagaccagtaggaaaacaagggaagggaagttgtaccaggcagatgaagcagcacgttcaaaggcttggaggcacaagaacatggtgcaatcgagaacatgcacgcatccgctctccttgttctatttcctgcaaccctatatgaatttgctttcacgtagtaagatttctgttgtgtaagcttaatctcctttgatatttctttgataatactttcatcatttttcttcttatgtccatagacttcatcctctactctggcatcatcttcataggttgccctttgtattcttaaaaatcttttcaagtgggatcaccttttccaaaagcctgtcaagaggtcaggttatgtttaaccaggaccctcccatgtctactgtgttaatccttcttgcttgtaaatattaggagagccaggaacattcacaaagctggtcttttttatttctcacgacacattgacacatctaactcactttttccttctcccacaattcattcccccactccaggtgacattcttcccctactgatgagtatcaaaacatcccaagcctatcccttcaggtgtgttgacctccctctttacattatagtaaagtgcttgtgcttaatagtaaattccattctgcttccaacacggcaagcagtgctttcctacacttgtacgattttatttagtcccccaagaccctttcaactagatctttctttctggaatctaatgtctcctcttgtcagatagtcctttttcctggaacttgggttttatccacagaaagcctgttatgtttggtctgtttttccagcctttcctcgtatttcttnnnnnnnnnnnnnnnnnnnnactaggtatatccacagaagcctgtatgttgtctgttttccagccttcctcgtattctcctgtgggtctatgcctttcctttccatgtaagctttgctgtgatctctgatgctttttatgtttttactcgcaatctttcattaatcactgtgggacttcaaacacaggtccgtgtttgaaaaggcagtggtttccctttcctctgcaagaaccatcttctccaggcacctttatcttggctcttgctcttccgactagcttatttaaattcctgctgtacctttcaatccattttgagagaagtataaataatatgtaacattgataacattttcctccattcaatcaacaatagtttaccaacacacacacatacccaaaatacccaatgacaacctctttttagggtccatccattcaaaaacacataccctgtgctaaacctctcatgctaccttttccttatctgagacttttctccaagcactttcttctcatgtgatttgtcaacacacatataaaggacatctctggctgttccagcaacagccagaacttgtttctgttctggattaaaagcagctggaaagtagaatgcccatgttcaccttgacagctttctgttccatacttatgtttccctatcctaatgccaaatttctctgctgctgttaatgaaactttactacatcataatgggatttttcaatgaaattgccatatgacctatctcctgtgttacagtcttgaagagaactaacagcctttggctttaacttgcttggggaaatcaccagtgcctactgctttttctcctgatacagcctacaaaatatatccattttctctatcatctgaggttcacatcaaactctttatttctgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagataaaatagacaaattggcactttttcccctttattctcttcctcaagcttcttttttctcctctatatctttctctatttttcctacggctttgcctctctaactgcaattctttgcctttttttgtgtcttctctccttttttaagtgtcccatttgcatttgctgttgacagaggccatggcaagctagagccaaaagtagagaagctggctttggccccctctgacctccctaacactgcactcattcattcattcattgagacaggatctcagtcttttacccaggctggagtgcagtggcaatcatagttcactgcagcctccttataacttctgggctcaagcaatccttccacctcggcctctggaatagctgggatgaccggtgcacaccaccatgctgggccaattatttattttttatttcatgttatgtatttatttatttttattattttttattttggggggtggagacagggtcttgttttgttgcacaggctggtctcaaactcctgatttcaagagatcttctgccttagcctccaaaaattttgggagtacagcatgagccactgtgcccagcccctaacactcctttaaatagctcttctctcctcaccatcttctgtgtgacttgccttagtctatcccatgtctttcatgtcctcctttttggttcccctccccccagtgttgggaccccttggctcacagatagattgtgtgccatcctcactgataggtaaatagacatttacagtcaatattgcagtagacaaagaagatattatttatccattttaatggtgggaggagaacatgctcagagtgcacctaggagctgattagtggcagaactcaggtctgctgggcattccccacagctcctcttttatgacagctccctgacaagaaggaaaactttccttgggtaatgacatctccaaattgcgtggccattcctattccctccagagatttcttcttggatactattgtcccagaactaaaaagagaaaaatactctttggatagaacaacatcctagcttctgagctttctgcatcaagaccccattttccccatgatgtcctctcaagttaattaggatgcactagcagaagtagctacagagtgacagaacttcaggatacaaagtccttgcagtcattgagtatcattagtaaaaaggtaatgctgctctgtcaggaagcctgtgtataaatcattcagatacatatctctgccactaaagattatgcttctcagagttaaaagtactaaacaatgccttccaaggtttatctgccactgtttttcatgaacgctccaggatcaagagcacactttctggcatattgctttaaaatgcctcctttctaactgtgcaggtcaaatctgcattgttatttagaaatacatgttgcccatatttcaaaattacttggtatccacacttacatttacattttaacagaagataatactggttcccataatccaaatcactatgaggcagctttatcccagagcctcaaagtcaggtgaggacaggaaagtagaatgtttaaaattggatttgacccagaaaaccgaggacatgtggttgacagagggagaatgttaaagtgacaaagcaacttggtaaaaggtttgtctttggacgccatccccaaactgttctccattagtttctttccacttcgcatgtccttaggcaattggccatttgcctggattcctacttagccctctaccgagagcagcacccaagctatggggctcacctaccatcttccccatttttcaccatttccattgacttagagaaatcatccatattccaagaaaatgtcaactaatttttttttcttttttctttttcctttttttttttcttttttgagacaggatctcactctgtcacccaggctggagggcagtggtacaaatcatagctcactgcagcttcaaactcctgggcttaggcaatcccccgacctcctacctcagcctcccaagtcactgggactacaggcatacaccaccactaattttctttaatttttatttttagtcgctttgttgcccaggctggtcttgaactcctgagctcaagtgatcctcccaccctgacctcccaacaaactgggattacaactgtgagccaccacacctgaccaactaaaatttctcttttttttttcttcaatccctccctgcctccctccctccctcccttccttacttcctttcttccttccttcttccctccctccctccctttttttttattatactttaagttctagggtacatgtgcacaatgtgcaggtttgttacatatgtatacatgtgctgtgttggtttgccgcacccattaactcgtcatttacattaggtatttctcctaatactatccctcccccatcccccgaccccacaacaggcccgtgtgtgatgttccccaccctgtgtccaagtgttctcattgttcaattcccacctatgagtgagaacatgcagtgtttgtttttctgtccttgtgatagtttgctcagaataatggtttccagcttcatccatgtcactacaaacaacatgaattcatccttttttatggctgcgtagtattccatggtgtatatgtgccgcattttcttaatccagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccttgaaggaattgccacactgtcttccacaatggttgaactaatttacactcccaccaacagtgtaaaagtgttcctatttctccacatcctctccagcacctgttgtttcctgactttttaatgatcgccattctaactgttgtgagatagtatctcattgtggttttgatttgcatttctctgatgaccagtgatgatgagcattttttcatgtgtctgttggctgcataaatgtcttcttttgaaaagtatctgttcatatcctttgcccacgttttgatggggtcgtttgatttttcttgtaaatttgtttaagttctttgtagattctggaaattagccctttgtcagatgggtagattgcaaaaattttctgccattctgaaggttacctgttcactctgatggtagtttcttttgctgtgcagaagccctttagtttaattagatcccatttgtctattttgacttttgttgtcattgcttttggtgttttagtcatgaagtccttgcccatgcctacgtcctgaatggtattgcctaggttttcttctagggattttatggttttaggtctaacatttaagtctttaatgcatcttgaattaatttttgtataaggtgtaaggaagggatccagtttcagctttctacataatggctagccatttttcccagcaccatttgttaaatagggaatcctttccccatttcttgtttttgtcagttttgtcaaagatcagatggttgtagatgtgtggtgttatttctgagggctctgttctgttccattggtctatatgtctgttttggtaccagtaccatgctgttttggttactgtagccttgtagtatagtttgaagtcaggtagtgtgatgcctccagctttgttctttttgcttaggatgtcttggcaatgcgggctcttttttggttccatatgaactttaaagtagttttttccaattctgtgaagaaagtcattggtagcttgatggggatggcactgaatctataaattaccttgggcagtatggccattttcatgatattcattcttcctgtccatgaacatggagtgttcttccatttgcttgtgtcctcttttatttccttgagcagtggtttgtagttctccttgaagaggtccttcacatcccttgtaagttggattcctaggtatttttttctctttgtggtaattgtgaatgggagctcactcatgatttggctctctgtttgtctgttattggtgtataagaatgcttgtgattttgcatattgattttgtatcctgagactgctgaagttgcttatcagcttaaggagattttgggctgagacaatggggttttctaaatatacaatcatgtcatctgcaaacagggacaatttgacttcctgttttcctaattgaataccctttatttctttcccttgcctgattgccctctggccaactacaatttcataccatgatggatgccatgttgcccattagggggtgaaacagtgtttcatattgttttaaaggacccatagagatctaaagctttagctaaaggtaataaatggtagaatttcaagtacctcagcacactatagcataaagaatcttttgacaaggacacttttggaattcacttttccctactctccactaaaaagtcacagtagtaattatttacaaattcctctactttctctatagtggtccttcctaatacatgtttctataatgacacctacaattttatgttgaatttttgtttatatgcctgttcatgccagcattgaaaaagcttcttagggcaaagacatgttttaatcatcctttgtttctagttctttgtagcatgactggcatattgaaaacccaacataagggtttgacatataagactaagctttactcattttctacaaaccacagatttttaagtggatcactaattatacttctgaaaacactgtttagaagtcatttatttattattagtattaattatttcaggctaggctacaataacaaataggcccaaacacgtaatgggttctgcaaaagagaagtcttggcaggtagggctctgctttattaaatcttcaaggatcctgtctcactgaacctctgccatcttcagcatttcagcatgtagcttccaaggtcactctgaggtcactatcacagacatagaaaagaaaaaaaatcatgggtaggagttctgggggactgggtctaggagtggtgcacatcacttctgttcacattccattagctagaacccaatcacaagaccacatctaactacaagaaaggctgggaaatgtagtctagctgtgttctcaggaagaagagcgtggacttttggtaaactacagagactctggcagtctctgccagagtggaatacttaataaatacattcattctttttttttttttttttttttttttgagacagagtctcgctctgttgcctaggctggagtgcagtggcatgatctcagctcactgcaagctccaactcccaggttcacaccattctcctgcctcagcctcccaagtagctgggactataggcacccgccaccatgcccagctaattttttgtatttttagtagagacggagtttcaccgtgttagccaggatggtcttgatctcctgacctcgtgatccacccgcctcgtcattcagaaagatgtgaaagatgagtgaaagttaactaagtaaacgggagggtggcaagagggcagaatgtcaagcaaaaggaactgtttatgtgaagcctctgaaagtgtaggtggcgtggcacagttaatgatataaagaaggctttccccttgtggctgttgcgcagagggagaaagaggcatttgatgaggcagaggaataagtaggaaatagaacttgaagattattctaaatgatcataagaatttgggccttttaactcaagagagataggagacctacttaaggattttaagatttggttttttgatgttttgttttttagagacagggtcttgctctgttgcccaggctggagtgcagtgccacaatcatagctcactgaagactcaaactctcgggctcaactgatcttcctgcctcagcctcctgagtcactggaaccacaggcatgcaccaccatgcccggctatttttttgttttttgtagagatagagtctggcttcattgcccagactggtctcaaaatcctggtttcaagctattcgccctccttggcctcccaaagtgcggggattataggagtgagatacgatgcctgttatttaaaaggtgactctgtcaattgtattctaagagtaaatttcaggaaaccaattaagagggtattggagtaatctatatgagagattatttgatcacatggtgaagactataaggatggaaacaagtgaacttattgagagattttatgataaataaaatcagaactcaaaagaagtcaatgatcaacgatcagtgataatgcccagttttctggcttaagcaaccccttggatgctaatatcatttgttgaaatcgagtgaaccagatttagaagaaagatcataaattcagtttttggcattcgagtctaaaacgagtgtgagatattcaatgactagtggacagttagatataaaagtctggggcttagagaaaatatctaaactagagatacaaactggagaatcacttccatattataactaaaaccatatactgggataagattagtttatgaagaaaagaagttagttataactacaccctgcaaagggagaccaagagtgagtggccagggaggcagagaaactaaaatcaggaaatcattgtattatagaatccaaggaaagaaagggagtcaataaattctgctgaaagttcatggaaatgagacctgcaaaatattaatggttcggtaatatggatgtcatttgaaatcttagtagcaactattttaataaaatgatggagagagaaatcaatggaacatgaaaaaatggggacagtgattgtaaccaatttcttcaagaaatttggctgtgcaaaggagcagagagacatggcacatgtagaaaagaggatagttgaaataggaattttgttatgataatagcgaacactcacacagtacattttgtgagccaggaactcttctaactccttttttacatactaactgatgtaattctactgactccatcactattcttccattttagagattagaaaagtgaggcacagaagagaaagtacattgcctgaggcttagtaggtaataagaagcagacttgggaattgaacctaagtagcctgactatagagtccatgttgttacaaagtcactgaggaatcttctaagcatattttaatgttgaaagaaagatctcaaatgttattttgtcttttgtcagtaataaaatatttggcacatactcccaatatttctgtctttctataaatcatatatatattgtgctataccaatatatgatgtgttttataaaacatataaatgaaacacaattttgaaaatatgggataaaagtaaatataaatagaaggtctaatattgtcttctcatactccaatggattatcttatgaaatctgcaatgaagataactaaagaagagagggaaaggatagagaaaaagaactgagtgcatttactggtttcgactacatgtgcaaatttccacaaactccgtggcttaaaacacccatttattagttcagtccagtaaaacagagagaaaaactagacaggtagctctaataaagtaaaatcatggaaatatatgatttcccagccagaagaaccttcaggactgtgttatccagacctgttttataaagacaaggaaggtggatcccgatggttaagcagttgaccacatttcacctccttcaaatccttcttatacagacattccctgaacttcctgtttcaaattgctatccttattccccacctactttacatgtttccacagcacatacctcaccaaacatgccttttattttactgttattttgttgactttgcgtgtcttactgaccactgtgcccaagtgcctagaacagtgcctggcacagaggaggtacccaataaatatcagttataccaaaaaatagtgaatgaatacacatggtggtccagtgctctttccaccactctatactgtactttactgtcactttttgtttgtttttgttattgagacagggtctcgctctgtctcccaggctaaactacagtggcacgatctctgcccactgcaacctccacctcttgggcccaagtaatcctcccacctcagcctcctgagtagctggggctataggcacgcatcacaccacacctggctatttttttgtatttttttgtagagacaggatttcaccaagttgcccaggctggtctcaaactcctgggctcaagcagtctgcccgcctctgccttccaaagtgctggtattacagccatgagccaccacacccggcctactgtcacttttaagaagcattttgattttctattttcatccttattttgatcacatcagaatatctgcttttctgtgaattattatttctaatgggaccacaagtgtatcagttaatcaaaatataaattatggacatcatgaggaaattttgaatttctaaatcataaagtggaaatccattttcaattaaattacatgaattttacacttacagaagagtaacttggtttaagctgttcaaggggtatagtactgtgtacatgcattcctgtgcctagaacactcatgccctcttgtggacagggttcatcctgacttcctgccgaaccttccttatctcagctcaggtaaccgctcctccaggacacctatatgtcccctgccctcctcctcctcccacagacaccagctctggttaaaaggggaaaactagaaggcttgtcttaaagctacatttgcatggccagcacattggttttacaaagaacatgcatttggggtggcttgcagaaatttataacgattattgagggaataaatctctaaagtccccctctccttagttactagaccctggaaggtttcaatcttcacctcctatagcatttgtgccacttctgtagtacagtcaatgcattatatttttactcatctaggtatccatagagcctagactagaacctagaagagtctgtggtggaactcagtaattattttttaataagaaatgaacgaatataaaccaatgagttacagagtatgcctaaagaataagcatccaaagatacactctctttcacctgaacaatttactatacatttgtagactaggccagattcagtctttctagcctgaacacattacacagcaacatttcacactgtgaccatctggtccattagatgtaaataccgatttggcagatacttcaggagtatgagagtaatgcaggaataaaatgaagttgaaaaatgctaccacccaaaagatatatttaaagccacatattatcttattaaaattaaaaacctaacattgtccttcatataagtgaagactgttttagtatttttactaatggggactatgcaaatggtctgaattttcatttgagagataattgggtctccatttgtatgtcacctctaaacaagactcccaacctcagagaaaaaccatctactcatcaaagaatctgttgccaatttaacacatagaaaaatcttcttacaattaacataaatagaatgtccttttaaaatgtcacagcattaattcaggtacttttgaaaaactcactcaagagtacagtgtttccatcaaatgtatgaacttagccccatttgcaaaggtcactaaaatgaacccatctttttccacataaaacgatgtatggggctacagagccattaaataaatattcattttaaatcaagctttttatttatccattggagatgacctctgttctaattatctataatgcttttcaaaaaggaaaggtatttttgtcgttgtctagtaaatcattaatttgtgtctattcaatggctgcatttttttaaaaataatgaaattatcaagctgctcagaacaaagctgccttctgattgtcagctgtatattctaaaagagcaggtaaatttctctgaatctcacagctggaacttttctaacactaactggcagtttccacctagtgatcaaggcaattgactaaaataaattacacataaagctgaaattcctaatagtaataaggccccttcatgagataatcacaccagcaaaagcactcatgtgttggctgcaaccctacagggtcttgaaattatcttataaaagctatacctccagaaatggttttgtttctagtttcatgacagggctaatatgacagtgtccatagcactaggtacaaaggaggagctccaaacaaaattcgttacttgactggattaaaatggagacactgttgttaaagcactaacatcagtgctatttacaaagcagatgactggtgaggacctcatttcaatacagtcaactgacaattatttcgaagcttttattatgtgcctggagctaggcatagaaaagtagtatatagtccctgctcttctggagtttaaggtgagttgagctcacgtgtaagaaataaatagggaaaaagtaatctcgaggcaccattctaccagctataaagcaattgctagcagaaatccaagtgggctagaatagtaaggaggtttttttgtttgtttgtgtgtttgttttttctttttttttttttttttgaacatggactagggcttaatggttaggagtaatttgattaggcagaagggaataaaggattgcagatggattttccaactaagcaaaagtctggtaactggaaggaatatagctcacagagaaatagtgattgctgtagcaaacttcccaatctttgtaccatcttcatgaccaatgcatttattaactgggctgtcaggagtgttgatggcttatagctcataactgagttcccccttcctggcatcaccctcagctgaaaagatgctcacccaagatgtaggagcagcccacatccaatgtttgggggattcaggatgataaaatctcatccttgttgccccatttccaaatatctttgaagaactctcccagctccagagttccccatagaattgactgaggtcttgatgtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagaaagctgcatgttctcattcagtaggcatagacactattccaatgctgggaacacagcagtaagaaaaacaagtcttttctcttatggatctgatattctggtgaggaaaacctaaatagacataatagaatgtcaagtaatgacgggtgctaagacaaaaaagaagcagggcaagaggagaggtaatgtttgtgtttaggactgcattggactacattagatagagtggccacagaaaaagtccctaaagaggtaacatgcaagcagaaagctgaataaactaatgaaacaattcataccagtatctaggagaatattgctgacagaaggaacagcaatgcaaagatcctcagatagaagtgtgtttggcatgttttggaaagaggaagtgaaatctggagaacagtggtaggatacgaagggggcagatcatatcaggccttttagtgtaaggaacagatgttattctaagtaaaaagggaagatctcaaagggctttgagtaggattgtcccatgatcagatttccattttaaaaggatcatgctgccttttatgtgagaaggaaactagaaaggagcaagaagagatgcagagaggctattatgaggctattacagaggtctaggtcagaagtgacaatgacatggacttaaggttgccactggtcatggcttgcctgggactgaggggtttcccaggatgcaggacttttagatcttaaaccaggaggatcttaaacaaatcaggatgtttggtcaccctacttggactagagtaataaccctatgaatgaaggcatgtggtcaggttcaaaatatattctaagggttgaagaagcagtgaaacaagagcaaatggtttagacatttaggacagaggcaaaatgtaaaacttcttgaaagtcaggaagaggggttcagacctttcaaacattcacttggcattagtatgtagtatgcattgaattttgaagagactataactaaagaggtctttaatcagactacttcagaaaatatgacagaaatgtcactagggcttaaccacaatggaactgatggtaaaaatggaggtggaggtgattgaaatggtggtgttggtagtagcagaggtcatagtgtaggatggtgaaggtggtagtgatagtgacaagtatcatatagagatggtgctcatattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaagaaagaaagaaagaaaggagggagggagggagggagggaaggaagggaggaaggaaggacggacaaacaggaggaagggaggaaggtaggaaggaagaggaaggaaggaagaaaaggggaaggaaggaaagaagggacggagggaaggaaggaaggggaaggaaggaacgatggaaggaaggatctaacttgagagacatttacaaaatgagaaatatcaggacttgtgggttaaatgaataaaggaaaacaaagagaaaggaaatggagatgagttagtgaccctgacagaaagatgttggaaagaatagttgaggggagggattggtattgaacattaatttagttacagatataaagtaagagtggaataaccaagtggatggccagctgggatattagtttctatcattccagacagcagtgtactagtaaagaaaactcatgattttgagttaaaagagtttgccccagttcctctctgagacagctatgtaacctacaccctctcagtctcaaagtctttatatataaaatggacataacagtacctcgttcacagggctattctagaaaaaagtagacaaaattgtcaaggagcagcaaggatatgacttgggtatcttcttttttctttgcaaattttccaagaacccttttagtccccatcaccataatcccaccaaagaaaaacattctttttaatttagaaaatcttggtttctagaactttagagtgataaataaaatatttatattaaatgtttataaattactatgcagccatctttcttccaaactggcatgccaaaactatgaaattagagtttgatgtaaaactgttcatataaaactattgggttcttctaattcttctatgttgatggacaagagatatagtaaaagcttcacatgctagaacaagactctagggacagaagtgcttttcttctcatcacagaagttcagtgaaagacttcactgaggaaatgaaaatattggtttccaaaaattcgtactggcatgagtctttaaatctgattcagggtaacaacactggcttactatataagccacaaacacaagccttgttttgactggggcagaatagaacacaccttgtggggatgacacagaagtccagatcgtcctgccgtgagggtccttcttgcgggcagtatcagggcctccccaggatgcatattcttttttttttttttttttttttttgagacggagtctcgctctgtcgcccaggctggagtgcagtggcgcgatctcggctcactgcaagctccgcctcccgggttcacaccattctcctgcctcagcctccagagtagctgggactacaggcgcccgccaccatgcccggctaattttttctatttttagtagagacggggttttaccgtgttagccaggatggtctcgatgtcctgacctcgtgatccgcccgcctcggactcccaaagagctgggattacaggcgtgagccaccgcgcccggccctcaggatgcatattcttgctcttgtttcacataaacttcaagtccctcatcctccccaacatgtgagaaacacatgacaatcatatttgcaaatatcctagatcaattaatcttggatcaaaccaccaggtagtaaaagaaagctgccctaattttcaaacttttggtagacaattattaaagctaattcttagggcattagggaaagcatatacttaaacctccaaaaatttcactaacaagaaaatggttagtataaattggatattttccttgcctttttctggaaatgagtttttctctatcttgttgatgcccataaaggacacaaatttcaggaaaatcaaggactagctttcaaatatcttggagatccagaagtaataaaatgctaaaactttttgaaaagtaacttcagttaattaatataaactacacattcaatttggcatatcaattacaataattttatgagcaaatgaaattttacatgttaaagttcttaaactaatgaagcaaatgtagatctgtaaagggtgctttaaaaaagcacttttccatatttttctttctcccaaaatgcccatatttttctcttaaacactcattcttctcccatcccataactttaaaattacaagtaacatcacagatttctcctgcttccgagcatgctttttcaaactgtacaaatactctcttctgaagataaatattatgtaaaatcttttaaacttcctatgtgtcataagattgaggaataaaaggtattggaagaagacatttgtgacatttctttgttcaacacaattgcaatgcccctaaattaatcgtggaattagattatggcccataaagggagatgttatttaagagagagcagtcatgtctgaaattcctaattagaacagttagagtaacctgatcctgcaacacaatcagttccccaaggaggctattgtggaaaatagacagaattctgcgaaaaaaaaaaaaagagccctcctcctaacgagcattttgaacagcaattttgttcatttacatttctcttgtcccataaagttcagataaatttgtccatattttatattaatttccatgatattgtctcccattcattattttcagatactctgaagagtaatttattccactagcctctcctgttgtataaattaattcctaggagtgagtaggcacatcaggtgaattcagcacattagaagtaactctttattatttatattagtgaaagggggttatgacctagataattcaaaacaggtattttctaaagtttccacttatttaagttttgaaactgtgtggaaagtgataatttaatgatggatcctgtcttcaaggagtttacaatcatgtgggagaattaagacatatacacactgagacaaaaacagagttcttggtaacatagagatgtatggtaaaatgctatggggactcaagaaatgaaacacttggagccataaacatatttggtgatgtttccagcacagacattactttagcagaaagaggcactatttctccctcacacattgaatgtattacctctcaattatagaaaaattacaatctttctcttttgaaaaatggatataatgaatacaccccccccccaaaaaaaaaacgggggggaattacattttcttacctgttaaattacatctaggcacctatttccacactggagactctggctgacttaacatatatgtcaagttatagataaagacacatatagtcataataagggtattacttgaaagtgccttagtatatggctttctgtagctcattcctatgttaaaagtctatctgcagaagtctgacataactgttgccttctgtagaatcagaattcacattttattgtgggaaacactaaaataagtcttgatttgccatatagctaattctgcatgtcagaaagcactctagagcctccagtatctgaggggcatacaacaaactctctctcttgcactctctctatctctatctcatgcttataaatatgaatgcaaattctacttatgttgaacaataatttggttcttaattaatcaccctagaaaataaaacacttaaggcaggagaatcagtaggagtcttttccgaaaaaaaaagtaaaattctctataccatcatcattgtaaacacttgatcagttgttcaaaaatgcctgagtacaggactgttgaatgttctttgggcctaaagtatggttatcagtgaaataacatgagaagttatgagatgcatttgcattgtgttactatgggtttcaattttctagcctgctgctcagatttttagaattaggaataaaagttagacctcacttaagatgagtaatactaaaagtgcgaaaccttatactttgttacatttcagctatcaggaattcagaatttctcatcaataaatagaatttaatgacacacaaatgcaagtccttttcccaaaaacctagagtattagaggtaatcctatttgaaatgtaaaaggacaaaaatttaggtcgattgattcaactaaagtgttaggcttatttcaaagctgtttaataaaaacatgaaaattttgccaagagttttgcagtgctattcagagcacaaagtctctttaaaaagtcatgttgttctcatttcctgcaccattgaattatagatatattttgatgaacattaaagtatagatgatctttgttaaaaactgaaatagatggtcttaaaaaaaaaaagctgttatcactcttgataccttagtcaatgaaaggccactgtgtaaatgccaatggacctacaattttcaaattctaatcaacataatcctcctcttgaagaatttacaatatatatgttaaaactctatttacttgtatttgaaaaattgctaatactttcttattggttttcttagcaagagaaattgggtgatatctgcttctcccttcgctacgtacctactgctggtaagctgactgttgtcattctggaggcaaagaacctgaagaagatggatgtgggtggcttatccggtaagcctgcagtgtttattgatttttttcaaatgctgtttcgtcgtggataccaaatgcatggcgcacatgctgcgactccccacttcttaattgatcacagttctctttcctatggagcctggaagcagtctcagaattcatcccaacacagtgccccaggaagccactctcaattcataggaattagcatagaagatgaaatctattttccttctttggagccaaagtatcaattgtctttttaatggcattgaaagctgaaaatgtttgcttcttttctgaaagagagtgttcatgacagattataattttgttgagcttagagggggtttttggtcaaaattcacccacgatataaaaaacaatgttttccatgagacttatttattaggtatttgatagcctaacatagttcctacgataccatttattaaagacacagcatttcaatatatatgcataatgaaatctctgtttcagagtgaacccctatggtaatgcatttaattccacagctgacattgaggatgggagagatgtggggattgaaatttccatacaacccaaccttagtaaaacgtggtggataaagtataccctggctcaaaagcaaagtcaactcaaggacttgtcacttccacggttgaacataatttttcttcttctgcatatgattaaatcaattatatttttaattttccgctaaatcattaaagtgtgaggaattttcttgatatgccacaaggtcatcataaattgactgcagttgtcattgtttgtggctgtggaattacaactaacattactggttattcaacactttctttaataaaaatattgcaaacttcaaaaggtcatcctaaggcagcatggtgattttttattctaaagcataacagctaaaaagtgctacagctgagcttcccctcacttacccactaatttgtcgaccaaattctcctggtacctgagtgtatttctctttataaataagtcacctggggaagctgtactaattctttcatgtcattaagaccctatttaataacttgctgtttttattgtgcctagcagtgtaacacagcaaatttgaagcaaagagcacagtgttctctagaagtatagagtatttaatgtgactataagtgaaaaacatgcagagaaatttttaactacaataacagttccctcctagattattacttagtttcctaaggtaacttcagacacctttaacatttccctgtcctttggttcaacagccaactatcatgacatgatttctttgtatcctgtctcttatgctttgtcccaaatatccatgccaaccatcccctcataacctatgtctagtactctgctagtcttcctaagtcatcctatctgcttcagcagataggatttgtcctggcttcttccggggtcccagaaatgagttcccatcatcatagagagatatttcaaccacgagttgttcatcccagtttgctgtctgtttccactaggacttctccaccgtctgtccccttctcgttcagtggcatcagagaggctggctgcaggcattttggaacttggctaagggaagttaggtctagcaggttatttttatggggcttacagtcatataatgtatagtgaggttattgctagctatcccaaagaaggaagggtacctgcaatgcactaactaactcagcattgtgaaatgaataaggaaaggccaaaggtcatacctaattttgtattcataattttatattctttgtttctgaagagaaccagcaaaaccatattagcttcaggatcctcacaacctgggttcacccctacatttgaattacctggaaggagtttaattattaagtaagaatatttaaagagtaaatatcctgaaaagccctaattttaagggcttctcactgcctgtagaattaagccataatcactctaatcacttgagtctacataatgtagatatgtccagcctatgtcatgccatatctcattttcaccaaattgaccaacacactcttttgcaaacaaactatacaactttctgcctctattacttgcttaggtcgtttccttcacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcttaagacctcatggttttaagatccatcccagtagaacaaatctttgcctttttttaaatgccattagccatttgtttacacccctcaaacatcatgcttctctctcactagactgtgttctgtatttatccctcccacaatgctctcagtgatgggtagcactaagcatagctgctgaatgaataatgaattatttacaaaggagctatggcctgaaaaaacaagtcttgcatttcaaatgtgtctaacccacttaccattaaaataactttaagcacttggatggtctgtctcaaagtaagttgacctatgtacgaggagaccaaaattatataataagatcattccaggtaattcaaatgccaaagtacatttgctggaaatgactagttaattggaaccaaagtgggttgttttgccagagtttaaactccatctgccactaactagcaatttgacattgcacaagttatttatttaactcttctaagcctcagctgcattatctataaagtgggaataatgagaggactttgttgatgatgctatgagaaataaatgaaagcacagggcctggcacaactaagtactcactaaatactattgtagtcatttctattagtaattttatcaaatcttgggataaatatgcaacatgggaaagcaaccaatggatgatttaaccaattacttgcttcaatggggaaaaaaagtttatcttattgtttgatggaattagctgattaattcaggcaaacgtatcagtaggcccacattttgcatagacactatagtgaattaagataattaacaaaacatttgagaaaataaaacatgaaaacatatgtaaaataattttcttattgctctccaacaaggttatttccttcctgcagtattcattcaaaatgcattgcacaaagatttggcctctattgtatatccacatgcaaaaaatgcaaatctcagcccttcatactttacagtgacaagcctaattggactatgcacatctctacagtagatccttgcatttgcattcttaatatcccaactttcaaatgcttgtgagcaacagtgaggatttctgaatttaactgcagtcatgtgttgattaacaacaggcatacattttgagaaatgtatcattaggttatttgatcattgcacaaatatcataaacacaaacctagatggtgcagcctgctacacacctaagctatgtggtatggcttattgctcctaggctaccaatctatacaacatgttaccatactgaatactgtaggtaattgtatttgtgtatctaaacatagagaaggtacaacaaaaatacagtattataatcttatgggaccaccattctataggcagtccatccttgactgaaatgtggttacacagggcatgactgtatttgtattgagatcttgaatcttgcaggctgcaagactgttcttcaggagcaagttggtgctgtagaacatgtgtaggactttttgccttatacgtggagacaatcaagacttctgcctcttaaacatgtctcaatagcttcgttgccttttacacatctctgtgtggagtaaatcttccttcaaataagaaatgttttctatttgggaaaattggggaagagaataaagaggtcaaagtaaaggcattggaaacattgaggcttcccaaaggtatgaggctgtgtgtctcatagttttaagctaaagtatataacttttattcttaaatttgtacctgtgtaaactcctaagtcagagactaatcagatacgttgctacttgtccctatttgtgtcatagcaatcactttcctcaagtttggtgttttgttttgttttttgtcatctcagaaatttgacacgtctgagtacagctttaatgaggaatgtcaacactgtaagtttagtttaggctttctgttgtaaattaaatgaaattctgaaagttttctatttaaggacatggccgtttaaagaaggaaacactaaactttaaaataagcaaaaattgaagtgattatagcttttaaattttgatctattccgtagaaattctgtttttctacttcaatctgagaattatttttaactgttaaaaagtcacattatcagttatagaacactttctaatttagaaatattttttaacttggttttctcatgtggttctcatgatagccctgtgagatactttctgaagatagcattctgattttaccagtgagaaaattgaagcttagagacattagacaatgtccataaactatcttcctgcatgtggcacatagatgggggtgttcaatacttgcaattgctcttatcactactgacatttgatctcagctgatttgagggtaggactgaagttcagatccccccagttctcaatgcagaggactttctaatatagcattcagccttgcccacacccctaccttcaagatgggagagcaaggattcctcagctctaacctgcgtgaggtgcctcccctgcccaaagccgaaacatcaagatgaggtcgtcacagtagggaagactagaaatggagtcttcatggattgttggaaatggagggattcttggagactggggaaaatgttcgtaactgtaaacccttaaggatactcctagtcaaatagctccagggtgccccctttcttgccttctcagaaccacaaattgattttcttgcttcacttgtggtttctggcagattcctcttcttgcctggcccaatatgaaacagaatgtgatctcacagacatgttctacttccctcattccctgaagctagcacctaattcttctgagacttttttctgtgtttgtactgctagtagccatggcaaatcaacaagggtaaaaagtgtgcagttctgctcgtttgatgtggtttgcattcacctaaattggaggagtagggaacataacaaaagtatgtcaagcatgggggcaagctggaaacccatatggtaaagggctgaaatcacatgtagctattccagcagcctcctgaacatcaaggagctagggaggtggctaggaggtgggatcaggtcaacaatggttgcaaagtgctctccttcatcatttttctgtccctttcactctgtgttctatgacccatccctagtcctcttcctggccatccctagtcctgccttgttactatgaaatgaaacctgtactgtgaaaagcaacatttggggctgtaggagagttcctccaaaacatctctaagtctccaaaagaaaagggaaatgaaatgtttgaaagtggcagcaattacttgagggaaatgatagagagggaacaggggactcgtggtgatgaaggagtcaccatcactatatgtcacactgccagtgtgtggattagctactgtgacctaggcgagcaaaatttaccctgtccccctccctccacccacacacactctgttttctggaagatgccattttttaaatgttaatcatgggtttgtcttttctctagctccttttctactgtcctagaaatgtaatttgggaaatgcagccagatttaaatatttgagatcatttaggaaagagcaactcacccaacctcaggtaactactagattccaaggagaaaccatgaaccagcagaggtaggtcattccctcaggcgatatttatcaacatgtgatattttgcataaccccatcaaaatcacctagggtacttattaaaaactaagatttcaaggactaattcaaaccaagctgtgactgagtatctaggggtgggaacctggaaattgccttttaaacaggtcctccccgtccatacacacatacccatgttatttttatgcatcttaaatttgaaaactacacttcagaggcttaaaatgctatgtcataattttaactgaggcctaggtcagccaagttccaagttagaatttttttttttttgggtcagtaacatagaatacatcttttgctttatataatggaatttcctcaaataagaagttctatttctttcatcagtccagtatcctcttccctgaaaaatacctggcccacatgtctaaattattatctttttttcttgagtctcctccactgaaagaggaaataaaagcaatagatgtttcctttgtacattctgaagttgtttcctagtacccttgactaccacccttatctgtccttccactggtgctgaaagcacaacaaagaaaaacactccaaattcaattgatgtgaactaaaagccaccagtctgggagccgggccaataaataaaatggcaaaaacttatttgaaccaattagacagggatatgcaaattaattggccatgatatcagggtcaagcaataatatgcaaataaactggcatcttattgagctaatgggacaggaatatgcataataatttggctgtgatgtcagaagcttcatcataattttaggcatgaatgttacaatataatatcaattctgggatacttcaaaatgcttaattacaatattgataaaataatctgaattcgtaaaacatgaacagattggtctaaaaaacaaatgacaagtcttgaaactggatcattctagaaaatgagtaattagaaaggattatagccaagcccggtacaagttgggacccaggcacagttatccacagaatggatagaaatgctctgcctgaaggactaaaagttttagagaaatgagcagatgtgaaatcaagagaaataagtgataggctgtaatgtatttgttcagaagagttagcccaaaaactcctaagtagattctttagccagcaggtatatatccaatcagtcaacaaacatcatgtgaaaactcctctgtgccaggcaccatgccagtccttgagaatatgagtaaaaacagcagacacttgcatagcagaatgtgagcccagacactgttctaaatgctttacatatggctaactgatttaatccccagtacaaccctatgaggtagatactatttttaatgtgattttattgatgatggaactgaaggacagagaggtacataacttacccaaggtcacaggattactatttgacagagctaggatgtcaacccaagcagactgtcttcagactccaatgaataaaacctgatgtctaggtccttatcattgctcagcaggttcaacctggagaacaggtggataactacatgctgcagtttgaaagatgtccaaaagtgacctgattccaaatatcctctatactcaagctaaaattctatcatggaactcactaacataaatcagttggttgactgtttaattagttcttcagctacttagacagcaaaggtgagatcaacaagtccataacaccagacattgaatagttatagatgatttttatgctggaaaggactgtatcagtttctccctaatgtacagattggtatgttattttagtgacttattcttcacacacaaaagaagatgagacacaaaacagtgacatttcagctgtatctgtggtacagaagagaggttgccgaacatggtagaagagagtccaagtttaagggatttgagtgccttttagagattaaagaaaaattttacctacaactaaattttagcaagggctaattctgtaaaggagtatgtgatattattgggagaggggcagtatgatgtaggagtacaaaagcttactacccttgtaaattgttatgggactctttgggtcaaaattacatatataaatactaaaattaaagaaatttgaattgcaatagacaacttaccaggaaaacacatgtcagctagataattttaacaagagaaatctacagatgaagaagtagaaacagggagttccaaagaggtctgttctaaggcactttcaccagtcaccttaaaactcataattctgaagataagataaacgtttccagccattgaaatgcaaagctcagtggtaaatttaaaaaatctagctaagctgagtaagccaaaaaatgtggtagatgtgcttcatttgggtcaagctaaaaaataatacactaaaaggaaaacgtgacccaatttagagtatagagtaataggatcaattataaatcaagaaaaatgtcacatagaaccatccattgaagacattcaccaagtgaacatgtcttttttgctaccccaaaaaaggcttgatgttgtcacagaagattttataaataaaagggagggaaaatctcctacctttgtccaattccagagctcattcatgtgtacaacacacagagttttggttgttcacctcagaaaagacagtggtattagatgactatctgctggaggaaagcagctacaataaagggatgaaggggccgtgtgtgaggacaggctaggaacagcgggactttgtggtctgaaaaggatatgatgaaagtctgaaaatcatgaaaggtagagctagagtaatacctacctatttatcacatcccacaatactagaatcaggaagtcaccttgatgtttgaaagagaatagataaaagggatagctattcaggatgatctcaaaggcacctttctactcaaaaattctttgtcaaattttctttactactttacatttgggttgtaaatacgtgttgctctaggaaatggaacagattgaaatataagactgagataagtgtaggtctgttttgtgttataggcttacaaggagacatctctaaacctttgtgttgtcttgtaggaacccctcatgcctttccatgggtaaccataaatagcccacagctgcatatctcactaatccaacccagaatgcttacatttgcatccttcagttggccacttctattcccttctcttcattcagtatacagaaaaaaaaataaggagggtcagaatttctaataggtaattgcactgggaggaatagagtccccacaaattcctatttttaaaaattatgtttagtgggttctttcaggagatatttgggagtttctaataaaactattagaaacatgtagcaaaagtcggtgctattcccccttccttttacaaaggtataagattcctgttagtaaagcctataataggtgacaaaagcatgcaaagttttgagtctcaaacactataataatgctcagaaatggaaacatcaaagacagtcttttaaaaacaactgtactggccaggtgcagtggctcacacctgtaatcccagtacttgggcaggccaaggtgggaggctcgcttgagcccaggagtttgagatcagcctgagctgcatagtgggacccccatctctacaaaaaaaattaaaaaaaaaaaaaatagccaggaatggtagcgcacacctgtggtcccagctacatgggaagctgaggtgagaagatctctcaagcccaggaggtcaaggctgcagtgagctgtgattgtgccactgcactccagcctgagtgacaaagcgtgtccctgtctcaaaaaaaaaaaaaaattgtactttattataatcacttctgcttccaaaagtatatactgtttctacttggttccttaatcccttattcttaatctcagttataaaaatatcattcttgttcccttttcaccatagtcttgccacttgctgcaccatgagctactttgagagcagggattgtgtctacttatgtctgtgttctcagagcccctagcatatatgctgaagaaacagaccttaatataccctgcctaaacaatcagttttaaatttttaaattccactaatctaactgattattttgtcttcatcttccaaatgatctgacttaatttcatcacttaatgcaattattttggcatcatatagtagtaatcctattataatagaaatatcggctcataaataaaaaccagacaatggaattcttaaaaccaattggttattttagccatcattttcagaagattttacttccttccttcatttcccccctccccaccccctttaatggttaaacgaaagaaaaacagactatctccaagagataaaagagagtgacacagaaatgcacacattactgtagttatacctcaacgacagtcataaaggcattttcaagggaaaaagtaaagacagagaatgatcccttggtcaccttttgcccagcatgaacagataaggcaatgattcagcatcttacttgtccactgttttaaagactaactccttatcaaaggaagtcaaaagaccataccggctgacagcctttttaaattactaatggcctaaattttgcggtacatcattttcaatgatgactggacaactaggaggcttcctataattttttctttcagaaataaatgattttatttaacttaaaaaaagaattaagcgcatttattttatatcctcagaaccactgaaactgcttttagccaaaactaaagcaacatgattaagaaattaatagatttcaaactactgatttcagtcaacaatatgacagtgtaattaactaataaagtgtcccgttaacaaacaaaaagagccgaatgcacatttcgtgatagtgcacttgcagaattactacatatactacatatacatatgaaactgcaagattactcagtaatctactgacgcagctgtcatttttagagaatattatgaacttccatatccttattaaggaaacaaatgctttcacaaatagccctgtgtttaaatatttatctagaattttagttttaaaattataggaaagctcaagaaataaagttaatccacaaccccaccacttcttttcatacataagtaaaaaagtaactcaaatcagccccctctaatcctttcccattcctcagagttaattgactcaaggaaataatttgaaatttcatatccttccaggttttctttctgcttatatcaattctatacatatatatacaaatatatatacattttacaaaatgggattttaaacacattattctgtaattatttttaacctaccaatatataatggagatcctttgggccaacatatagatctgccatatctagtggttgcatagcatccctttgttcgaatgtatcatggtatatttagtaattctcttataaatataactatgagaaaaactatataaattcactgaaagacttcaaatgagacctaaataaatagaaaaataacatgctcttggatagggaacaatatagtaaagatgtcatgcttcccaaataaatgccataaatgaatttgaaagatgagtaacacacgaaaagaaagctttgcctcacataaacagatcaagtattaatatccctgtaatacaaagagtttctacatatcagtgagaaagaaaagcaataggagaaagtctctattttattaatgttcctaaaatttacttgctgctgcttctactactggctgctgttgctgagaagtaaaatgttacatttatacaatgtcattatgcatctaaataagaaaggattttaaagtaagatgcaattaccctaagttcaaaatctaaaaatgtgttgcttaaaaagacagcctagactgattgcaaagagtaccagaaaaaaaaaaaaaaaagcaggtcattagcttgtagattttcatattttcatcaactatatttgcaggagtctgaatccattaaaacactcaatccagcagcattattatgataacaacttgaaaagatatgtgacagtcactaaaagtcaaagtaaaaatacataccgctatgaaagtcattttgaagggaagttcccaatttctagactttataaaaacaattaagcatctgaaagctacttttactaaaagttgccaattcgtgtatctagaaaacactcctgcattttacagcactgtctttaatgtagtgaaaatattgcaaatgaaactagcctaaagggcaataatatatcacagtatatctccagttacagtaattaggaatctattctaatcttacctgaaagatatgttagtgttttatgtttataaggatttcaccaaaattttttaaaaatagcttagtagaagagattttaaaagaggcagtgaatgtttatgaattatgcaagtctgaactttcattttaataactccattaaaatataaaaaccttaaaagcctcccatcaggaatttaactttatagaaatgctttatatgtgccctgaccttgccaagaggcaggcctaaggcatgatttaacagttactacaaggcaaagcctaataataaatacctatctgaaaatgccagcatttgtccctgcctccttggcctccagtggagttgcaactcagccataaacaggccctctcctgagagacagcagggcgcagcagaaagggagcagcaactggccctggaaagcctggatcggaagcctttaacctttctgatcctcagtctgttcatctataaaactagggtattagagacagccatattgttgaataaacaaatgagataacattaggtgaaagctccaggtagaaagcactatataaatattggttatttctaagcaaaagacagttcttggttaactcttaatttttgtcaccatatcctggctccaggagaatgtgtgttcctatatggctgatataaataatactgtgtgtgtgtgtgtgtgtgtgtgtgtgtgtgtgtgtgtgtgtgtgtgtgtgttcaaagaatgcctcttcattatttggatggcagttaactgctttggctaacttatgttggcatcctgaagctaacagcaaatcctcctcccatctcctgtaacttgtggccacaagacccagcatattttataagaaatcagaccagtagtatatttctacgatcttcagtttgttaagctatttatttgagttaagacaccgagttgtcttccaagtacttcttttatgataacagatccaagacagacacagctaatttgggcaacaagtagggacaaagaggaagaacagagcctctgtcatcctaattatcaagttaatgcctggttgctggacaaactctccctctctctaaaatgaaccaccgcaagttggaacctgctgttgcaatgttaatttgactagaagtggcaggacctggtcccagagcagctcctggttgtctttccaaataattttgccccaggtaataaatacctaattgatgcaatatgagtcagtatttgttgttcattgctacataattgagtggtcaaggtttcatctttcacctgtctctacaaattcttaatctccacaagtagtcaacattaaaaacaagaaagttacccatgtaaatttctacatgcttgcatccaaacaccctttgactctcttcagcttgctttcctctcgatgaaatttcattttccatattaaacatatctccaggctgtgcccatcttggcatttcaaaaaaaaaatagaaaaacctggttggattatacgtctgccttctccttaaatcagatgaattgctccacttgccggtaggataaatagttcagttaaagcatatactaagaatctcagataagtagctcagttaaaacatatactaagaacctaggtaagaaatgtgaaaaaaaaatattgcttattagtcctacagcagagatgatacctttttttaaaaaaaaaaattattattatactttaagttttagggtacatgtgcacaatgcgcaggttagttacatatgtatacatgtgccatgctggtgtgctgcacccattaacccgtcatttagcattaggtatatctcctaaagctatccctccccccaccccacaacagtccccagagtgtgatgttccccttcctgtgtccatgtgttctcattgttcaattcccacctatgagtgagaacacgcggtgtttgattttttttccttgcaatagtttactgagaatgatgacttccaatttcatccatgtgcctacaaaggacatgaactcatcattttttatggctgcatagtattccatggtgtatatgtgccacattttcttaatcagtctatcattgttggacatttggattggctccaagcctttgctattgcgaatagtgcctcaataaacatacgtgtgcatgtgtctttacagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagcaggttgcaaaaattttctcccattctgtaggttgcctgttcactctgatggtagtttcttttgctgtgcagaagctctttagtttaattagatcccatttgccaattttggcttttgttgccattgcttttggtgttttagacatgaagtccttgcccatgcctatgtcctgaatggtaatgagatgatacttttataacactttgatttgtcattttactaattgctaaatttgcccatatcagtcatgttgaactgtgcctccctcaaacaactagcaagactgatctgaggttgaaccaattgcttaggaaacatcctctatgaagctataaacctgaaacctatctatattcagtctctggagatgaaagtgtcagagctggcagggcatggtggctcatccctgtaatcccagaactttagaaggctgaggcaggaggattgctggaaaccaggagtttgagaccagcctgggcaacatagtgaaaccctgtctctacaaaaattattagccaggcatggtggcatatgcctgtagtcctaattacatgggaaggtgaggcaggaggattgcttgagcccaggaggctcaagcccatgatcactcatactgccacactccagactgggtgacaaagcgagactctgcctcaaaaagaaaagaaaaagaaagtgtcagataaatttaagaggtacatttcagcctgatccatattgagattaagggctgctttctttttaaataaagatatgtttagtatttctacaataggattcaatacaatagaattgaaagtatgtgtaagtttagcccaaagctaaagagaaagatactattctcaagccaaattacatacagtatgtagatgtacctgtatctttatctttttttattttttttgagacaggcagatatatcttttaaaattgacttggcctcatacttttatagcacatgcagattttgattcttgtaactgtcacttgaaattttgttttttaaagctaaattagtccaatcatcttgcatgctgcaagaggaactagttattcaaactatgagaatttagtatttgcttacaagcaagataacaagaatggaatcttttttatcttgggtgggtcagtgagcaaaaagatatttctttttatttctgtgtgctattaatatgggtggttcttatcattgcctctctaactttccatttaaatttcaaaatgatttaatcttaaatgtaaaacaactgtgaaatcttattaccgagattatttatttcaaaaatgagtctccggcaacagagttcctatactctatgctgagagatctggaatattgcattcatttctgaaaacacacttaagaggagagacattaactttctgaagcaaattcagcaggaaatcagggtcatgcagagggcagatacagtctcagttaaggaacagttcaggcaattggagatgtttaagctgcaaaatacagaattcaaagaggacataactgtctgaaaaatgtgagaaaagaattgaacctactcttattaactataaagacctgaactgggatccatgagtataagtgatggaaatccatacttggttcttcccattttagttcccaaacaaaagctagaggaaagtttatcagaaatactgagttagggccgggcgcggtggctcactcctgtaatcccagcactttgggaggctgaggcgggcggatcacgaggtcagaagatcgggaccatcctggctaaaacggtgaaaccccctctctactaaaaatacaaaaaatttagccgggcatggtgacgggcgcctgtagtcccagctactcgggaggctgagacaggagaatggcgtgaacccgggaggcggagcttgcagtgagcagagatcgcgccactgcactccagcctgggcgacagagcgatattccgtctcaaaaaataataataataaaaataaaaaataaaaataaaagaaatactgagttagggatggtaccctacctacctgccataggttagggaattaacctattaaatccctccaatcttctaaagtttcattttaaaactctaaaagatcatgcccagcctaaagacaacatcagcccatggaagagcacatctattaaagacaaatgtatcctcaccaaaagtgattattttattttttccttaagataatacgaatgaaagactactactgctaataataattatagttataatctagtcagtgctttctctgctgtgcatttactaatttcgtcttgtttaatcctattcatactctcatgaggtaggtatggttatccccatatatgaatgagaaaactaaggtttggaaaagagactcgctcaaggtcacaaggtaaagaaatggcaaaggcccagctcctcactccagctgcatctgttacctaagcctgcccacttactcacagcttcccccacctagacagtgcacactgtaatttcaattggccataatccccaaatcatagaaacctcaactctagaagataatgaatgctcttgagcagcaaaatgatcatcagttgactcacaatgaatactctctatagattattttgacaaagtaacgctatccaactgtgcctgcaaatgccaacacatgcaaatccctgcgacttcataaacagcaaatgccctaatgagctaaagaaacaattgctctttattcattttcttcagtgtgtttcttatttctgctggaaaataatgtccagaaggaatttgtgttctattcaatgactataaaaaagaggaaggttagtgtttacaagtttacataatacaaaaaagagtggccgtgaaacagtgagctgtggcttcctggtgggaagacactcacatgcagcctgtgacttcctgggcagttttaatttacttttaatcatttcagaagtcatgcctcagaggtttgagataaaaagtttcatagcatcttacctttttcttttctgcccctccttttttagtttggtaaaatgtagtccagaaaaacaggtggagggggaagagccagtttaagtatttgctcctccaggaaacttcccacatatcctaaacccatctttgttcttctttacctttatactgtccacgttttttcacttgatcactgactgttgtgtttcttcaactgtgttctgtacataccttttctcattcatgagaatgaattgtttaatcatcagggttgccaacaccctcattatttctttttctgtgttcccatggtgcactggagttatctcgtcccatgatttatcacacactgtaggtattcgtggctctttctctgtgaactcctttaaggagaccaacttaattcacttttgcataaccgtcatctagcatcgcctagcacattgtaggcccccatgaagaaattaaattaaatgaaaactcgaatagttcacttaatccccagtgtttaacatatagtatgaactgaattgaagtaaagtgaattaaattcaatcagaacaaatcaaaatgaactgaaatgattataagacattattatgttggataaagttatccagattatatttataatttgtagaaaaattgattagcacagcctagctatgttgttgtgtgattcctatgatggacactcaggattgcccattatgttactaccatagaaaggtcagcagcctttaggcccaatattacagctagttctttaagctgaggccataagggtagacacagtctaaatcactgtgtattggctgagaaatgtagaccaaactccggaaggctgacagtatttctgaacaagcaaatgatgcttaaagtgaactgaagctgttgattatacaggaggattccccaacaagtagatctaaaatttcatttccagggctaagtcaccttcttggtccatggtttgctgtgatctcagagggagaggaaaccatacccacaacagcccctcatccctcccctctcttcttatctctagcttctaaatagttgtccatcagcacgcactgtgcaccccatctgagttcagctgtgtgttaggcacctgaaattcagtcaataccatgaacattatctctccacttttgggtcctaacttctcaaaaaggagaccaacaataagtaagtaccaaaaatattaatcataaatgatcacaaattctatcaggctgtgaaagagagaaatgacaagatatttccctcatccaaaaatgtagactctgatttaggagtataggcaattcttttctcaaaattatatctcttttcatcaaaaaaagtaattattggtaaaccagataaataagcattttgtaaaaatgaaaatgattgggggagagaggaatatcctctcctacaatttgtgcttaactagcttaggtttgtccgatgagatcagacatcttttaatgttgatgatgttcacctatcagtaaaactttgggagcacattcctctttatacatttacttgtaggtttgtaagtgtatatagaccactatagtaatataaaatggacattataaacttaaaagtcaaaaaatgtaaaagataaagcaaaagtaaacattttacaatttgctttatgaatgataaaaatgttattctccctttaaaatataattactaatttgttaataataaatatgcctcacttttctttaagatatctgtttaactttgtaatgtagcaattcacaagcataatattagattccatttatttcaacacttagttttatagatggtcacatcaaaaaaatgcctcacaaatgcacaatattcataatatttaatatgaacttagtttggaatttacagaaaatatgtcaatatatcacatcgactgaagttttttattttttttaaatcaaaacttttaaaagcttaaaacttttaaacttttagagaagcttttagccagcttctctaacctgaaatagatgatcatttttacctgtaggcatgactgacagagcacagctgaagaagaggtaccagctgggtcatattctcatttctcactcgtgtttgcattatcaagttttcttcaagccacagttgttgttcaggactcattttaggcaacatgctcattttgtgaagagtagtttggttacaattaaataacataatctataaaccaatttaactgggctcacataaagcgcaatacatagaaaaatgctaacagcaaataaagtgcaggcccctctggcaccccaccccacggtggcgcttccatgccaccctcaggaaaccttgagtactgcgtgtgaatcatgccagaacaggggcacctctgtgatactgtacatcagacctcagtaaatttccaatcctttatttttagaagaagaaaataaagtagaaactctggtattttcttctggggtgccagaagtaaatatttgaatttctactttattttttccacactggagatcagagaaactaaaggtttcaagtttataaaccaaaagtcggccagcaaatacattttcctttcctttctcttaccaaagagaaaaagatgatatcatgttgattaagttttgtctttatagaccaactattcattaaccagaaggacagatcattgttatttattaatgtgatacctaatttttattttaaaagggtacacattctaacaaatggtaatttcttcataattttcaaaaataatgccgggttttaaaaagaaaaacagatgatgtaaagaggcactaaaccagattagtttcaggacattcaatgtcaccagaaggataggaatggctggatgttgcacctataaagggaaacactggatgggtagcaggatggctgctcacaaggatttgaagaactaccctgtggacaaaagtatggaatcacatattcagcaaatatgtattaaatgcctacttactaagtgccacagtgaggagctggagagctggtggtagtgagatggattttgtgatacctgcctacaaagagcttggaacgagctcagggagatccactttaaaatactgtgtgatttagattaggagtaaacaaactttttttgtaaaggaccagatagtaaatattttaggctttgcaggccacatggtctctcgcaactaaatattcaactctattgcaacacaaaagcagccacagacagtctgtaaggagtagacatagctgtgttctaatcaaactttttatttatggatactgatatgcaaatttcatgtaattttatatgtcatgaaatattaatcttttttatttttttcaactctaaaaatgtaaacattttcttagcttacgacctacagaaacatgcagcagccagatctggtccacaggtagtaacctgccgggagctaattaacaggatttcacaagagctcagaggaagagtacttaacctccactggagatttcgtgggcgcttcctggagaaaccaagaaccgggttgagggattgtgcagggcaaagggataggccaaaaggacagtgagagctaaggcctggttgtacaaaacagatcgtgtagtgtagaggagctgctaagaaatgaagttagagaggcagagcccagtcaggaaagttgaactttatgttccagaggtggtgagtagccactgcagggatttaagcagggagtttgtgctgcaaactgtaacattaattccagctcaggctgtggaatcaaactgacatgattaggatcccagttctgccactcaccaagcatctgaattcaaatcattttcttatcctcttcaaatatcagttccatcatctgaaaaccaaagataatccctaccttgctctttgttattctctattcttgtacctgtctgcttcacttattgctcatagtgtcacaactggtaatataaatttcattgctaacttgttatttgactgatgccccctctagattgtggggccatgtcatcatccatataaaccaggtacctagcagggcgcctgactcaaaagtacctgatgaataaatggaaaaaaaaaatcaactcacaatgataaagccaaccatctcccaccttgtagttctatcactatccatgcttgcttcttgccttacaaggataaatatgttgtatcatttatttaaaacttggaataaagtcataaagaaaaatgattaatcatttctatacatctatcttatccataatgtttattttcttgagcaagttctcattacacttcattttgccacatggcttttccttcttccactgagacgcacttcctccaagaaactttcttaatctaaatgttacaggaaaggggtcccaatccagaccccaagagagggttcttggatcttgtgcaaggaggaattcagggcgagtctgcagtgcacagtgaaagcaagtttattaagaaagtaaaggaataaaagaatggctactccatagacagagcagtcccgagggctgctggttgcccatttttatggtcatttcttgatgatatgctgaacaaagggtggattattcatgcctcccctttttagaccatatagggtaacttcctgatgttgccatggcatttgtaaactgtcatggtactggtgggagtgtagcagtgaggacaaccagaggtcactctcggcgccattttggttttggtgggtttggctggctcctttactgcaaactgttttatcagcaaggtctttatgacctgtattttatgctgacctcctttctcatcctgttacttagaatgccttagccgtctgggaatgcagcccagtaggtttcagcctcattttacccagctcctatttaagatggagttgctctggttcacacacatctgacataaatgggcaattttctagtttacattgcagtgagctggaaatgaagcaaaatctttccaatgcataattcaggctaacttttaacttaaattcacaggtagggtaaatggcccatttcattaatgatttacaaacgtctgcatgcctccttatctaaattgccaaaatacctttatatttcactgcccgatatcacattataaattgtaaatatatgacttatctattcattagatttccagaactcttattctagggcaaacaagaaagcaataaaatccatgttgaattttagctcatatttctccttattgttcaatttcattcattcgttcaacaagtatctattgaatgcttactgtgtgccatgtattgttaaatcttcccttttagagatgtttatgtaacattttttgtttttttgttttgttttgtttttttgagacagagtctcgctccattgcccaggctggagtgcagtggcgcaatctcagctcactgcaagctctgcctcccaggttcacaccattctcctgcctcagcctcccgagtagctgggactgcaggctaccgccaccatgcccggctaattttttgtattttcagtagagacgaggtttcaccgttttagccaggatggtctcgatctcctgacctcgtgatccgcctaccttggcctcccaaagttctaggattacggtaacatgtgttttaaggtgtttattttctaaatagcttaaatcttaaccaccaatttatttttttcttctatatgtgttggtaattgtggcctagataaaagctctagcaattgtagtgacaggacaaaatataaaaattctcagggctatttaaattataaacagattttaagaagcactgtgtggtgtttctgttatccttctgctttccaagagaatatatctgcatcctgaaatctaatcacatttacttcaggcagagttgcttttggaaattcaggctttgcccatattgtctttgttgtataaacaacttagcttccctttctcccttttgttctagaattatttagtactaattatagattgagaatatccagggtcaggaagacctagtccaggtctagggagaatccaggttcaggaagagaggagagcatgggcttggttagggacatattaagcctatgacaccaattaagacaacaaatggagatgtctaatatgcagttagtccaccaaaattatattcttatttcttaagtttttcaaactgccatggaatagtccctttttcattatctcaaccatgacaaatttctcatatttatcactcccaatacatttaaaaggtgttagctagagtgtgtttctcacttattcctcatactatctaattcttaaagctcttaactatataaaatgcaggccataagccatggagttttcactcatccttatttttaattcacttgctagattatcaaattcaaattctcttctattagaaatctttgcctcactaactggaagaagctcaagtcttgattcctttatgcaatccttccaatccaaccccagtttacagatgtgtgcctttttccaggataaatttggaaaccttccgaaatatcacagatatgaccaacttttgaaggatcttctattgtggttatgtaatctgtgtcacataaacacaactcttaaaatttcaaagagaacagtccactggaaacaacctttttgattcttcttactaccaaacaggctagattacgtagcccatgaagccagtttacagaaatgaatttgtaaagaaaatcgcttttaaagaatcaactgaagagaggttagtttagtggcctcacagacttcattaaaaacaaatcttgctcctgatttggcagggattttcaaactattctgattcaagaaccacttgtgaaggtcaaaagcacaatttactagcctcattggctataaaaagaaacaaaacatgacccccagtggggtaaaggcttctgatgagacactagcattaaattgctaactcatgccaaaaacaaaagtataaagattggaatctaggtcagtagtgattaatccgaggaacaggctggaatgaaacaacctaaggaccctacttggggaagcattaaatgtcataaataaaaatggccattagatgaatttacagcccaaattaggaaagtttttctatcagttacttgcatacagaacttaggaaatttatggaagacgtgacagtgacttccaaaatcgatagaaaaattagtacatgtttgaaaacagactttgggtcaaagtgtttcttttcaaaataggggtgggagttggggatgtgttaccctctaaaatcttccatagtaatttcctcctgagaaaagaaattcatttcattttagtgttcctatcatgtttttgagaatttccatcctcattttctgttctgagagcatggtttagtaaatagtcctcagacccaataaacatatcaacagagaattttttagcaagttaatcaaaatatgaggaaaacaatgggatatgcttgaaataacaagtcacttgattacttaattaggttaacaagactgccacaaattgaaaccctgtcgttttttaaaacctcggtcgaaaatatttctgggtaatgattcaaggaatgaagaaaattggcctttttgaaggttaccaaaatgtaccagctgtgtaccattccaaggagtcctctgagaaccctgaaaatacatacgggtttttgttaatcattttaaaatctcaaagagcagtctgtgctacacaataatacacgaaatccacatgaagcctcccggtattttatggcaagtcctacttaggccaagctttttggatttgcttcagatctttatttccaagctcagtagcaaactcctgaaagctttgatttcaaataaacatctccattttgtcttttgcctcttcatgtagtaatcgtgtatatgtttatatactgaagaatcaatcatccaatagaaatctagctttgataactatgtttactaagaggatactaaaattacccataaggtaatttaagggaattcattacccaaataaaagactatgagcataaaaaactatagatattgctgagagtttacttactgtgcttaatacttcacatgtactattacgactaatttgccttcttgaaaagatgaggaaacaagcctaaggaaattaaataatttgctgaaggttacacccgagagcaagcaactgaaccaatcatctaacccaggccttctaactccatttgggtcatcttttctgatttgtggctctaaaaccccctttccagaaacaatctgacatttttagaaaccttcttttagaattgacgtattttactgaaaaagattccatttcttttgaagattaaccagagattttaaagctaatcttggcttttctttcaacatttcttcaccactgccacccccaccaaaaaataagagaaaatgcagtttctgtcatttagatattttgagaaaatattaactgcagaaacaaattagcatgctctgaaaaacaagtcccagagtttagagagactctgacaaagatgcaatttgagtgtgttcctcaagcacattcattgccatttataccttattcacaatcagcaaatctggctgtgcctgggatgaagaattttttgtttatttattttagagacagaactttgctctgccacccaggctgctgcatcctaggtgatgtagcctgctacatgatcatagctcactgaagcctcgaaactcccctcttgcctcagcctcccaagtagtcgggactacagatacacaccaccctgctctgctaatttttttaatacatgggggtctcactatattgcccaggctggtctcaaactcctggcctcaagcaatccttccacctcagccttccaggtatctgggattgctggcatgagccatcatgcccagctaaacaagttcttccctaaaagtgaagagggcttgtttaaaaggactgtaataagcttcccttgcaattccccaagtggactttgcaaaatgtcctcctcccctcaattcttccacctcctagaaacacctattcatgccttcttccttcctggaagccctaggagtttcctggggttccttgagctatggcaaccccatatgtatgattccaaatttagacagaggagtgtaacctgtgtcctagtgtgcaagcccaggaaagagaattagcaccaatatgtgatactaaacacttgacaatctttccctcatttaattcctacgacaaaactaggtaatactgtcattatcaacaatttgcagatagggcttagagactctgaaatctgaagtccatgcctttggctactccaccataatttctcctaggatttagtagtttttattccttgaaacattggcaacgaatggcctactatattattatgctgaattccctgattcctactttaaaacacaaccatttccattttcgaaagattatagatccatctcttgcttgcctgaaagtaacacattctttcttcaaaggtaaaactgtacacctaaactttgtaaaactctgtagttgagactgtctcaagttcctgttgaatcagataattgttatcagatccccttgaaaaagataaaaggaccaccactgttacaaagtacagagcaacaaaagccaaggcccagttaacagcacttcattgaaatgcaagaggcatctctgtgtacttacttcccatcttagacacaggagagcagggggtttgaaggatttgaattctgaatttctgttagaataacatctgccaagaataagccctgaatgtactacttttacctgtagagaaaaatgagcttatcactcaggtctttgtcgagataatacctacacctgttgtcaggctaaagatttagatagtcctggatgaaattccaggtctgctgtgtgagtgttagggagcatggttgagctacaaattgcgtggaagcaagctgattttaagttgccatggcaaagaaaatgcagagaatgagcagcttttacattaatgttttctacatcttgttaggataggattgtccagctgaggggtgctttttttgtgcttctactgacatgaacagataaaataataaacactaattatagagtattataatgatttctgggcttgcctcagaggggcgtctatctggctaggtaattacttccctgacagataggtttttacgtgagaatggagcatgatgagcctagtttattgcctgctgatgagaccacgggggaggaaggtcatgcggtatgcttattaagaccattttagtcaacgtgtttttcaatcagtcgtcagggtacccacccctggttaaagaaacgctacagatgaaaatgacacagtgattctcagtcgtgcgagtctgttgctttagggaagtgactaaatggtaagagacttctcaggttgaagtggaaggcatttcttgaaaatatgatgcctttgcctataatgctctaaagttgatccctagtgtgaaagagagtgctgctttctgtatgatacttcattccctgaaagactattttccccagctaagtcagattcaagttcctacacaattctggataatgtttaggaggtatcctgacttcaaggaatttatattcaaaaatacacaaacacatgcactcttctcccttctcccgtaacctaattgagtttgccaggaaaaaggggcaatgattttttccccttgttatttactaatagataataaagaatatatactaggggtaaaaaagacagaaaatcagagagtccagagaggaaaggaagttaaaaaaaagaaaagaaaaactaaatgaagcttttacaaaaatgcgatagtgtacacgtactgcccttcttgaaatgatccatcttattaaatgatgtggtttcagtgcttacctcttagtcctgctacacctatgggaatttggaagaaagctaggtttttcactttttaaatgatggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataatcttacaggaccaccatagaacatgtggttcatccttgaccaaaacattcttgtatttccacttcctccctaactatgaatattttcatgctgttcaatatggtacaatggcaaaataagtttatatagtatagatggctattcaagatatagttatttaaataaaaagtgggtttttttcctaaaaacaaaacaaaagaaaatctccttttgcttttctaactaccctttatgtccattttgttgttgtcccttgcagaatttacagtattagacaaaacacacagtggaagatcagaatttaattagatttgtttgttgttgaaacagctttcaaattctttcatcttatagggagtgaatccctagattactcacagacacatgaaaataaaaaactacagaagaatgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcacgttaatctggaaaatttttcataaattaaggaaattgagtttaatagttacagcaaattctccacatgcatcatgtttctgtactgagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttaggagggcacgtaatcagagtggctgtacctgaactaggtacaaaaatgcttaatactcagcttaacactagcatgtaaaatgtatgtgaattcagcaaaacatattttaaatgactttacattccatttctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggtgtttaatacccaaatctttgaattattgttagattatttactatcttttgctagtagttattcccaccaagcaatttataataagcagctaatggaagggaccactggatttttttttttttttttttgagacagtctcactctgtcacccaggctggagtgcaatggcatgatctcagctcactgcaacctccgcctcctagattcaagtgattctcctgcctcagcctctctagtagttgggattacaggcacccaccaccatgcccagctaattcttgtgtttttggtagagacagggtttcaccatgttggccaggctggtcttgaactcctgccctcaagtgatctgccagcctcggcctcccaaagtgtcgggattacaggcatgagccactgcttctgggcaggaccactggatttccatatggaaaaaactactatcaaaaaaagaattttttttccaaactctacatagataaggattgtataatcagttactggaaatgcattcttaggattgtttgcataatttattttctatgtatttgtggatgctcaatcaagctttatgtatattcattgattttttcaaatctgattgccctagttatgcgtgtttattccccccaaaattgtcagccacagttaaaattaaaattatgataccaaacttactggtggtagcatgctataatttataattcaagatggtatcagagccacattatatactaaactggttttgtatatgcaggttatcataggatttagaacaaatcagtgtattaggccagagttaccaactgaagggagcatcaaccaactgtggttatacaattacccattgttgttgttgttgttgttgttgttttttaattcaggaaaatgtgttgtatatgaatatactaaataaaggaaataaagctattaatagaatgtgccactggtgtcttaggtgaaaacatacaccaagattcataactcccctaaaattgttattgtcagttagctggataaagtggtctatgactaagttaaaaagctagaaaaatcttgtagtcaaaaggaaaacaaactttgttatgtatactcaggctggcccacagaaggtggtgcatggcagtgctggtgaatatcattgctgcagtctctaatactgctgcagtgctgcctagctgctactttaaaccaacactggctcatctggggccttgaattaccccttaaaggttgtatggtgcattaccctgctattttaaaattactttaaaccattcctaaagaaaggtaccacatccttctccagagaagaagttattagattctttacaaaaacacatatttatttaaataataaatttccaacaaaaaattcacaattataagattcctttgaaaattaccagggttttccccaaatacatttttgggtttttttttttccttccttagtattcattagttttcttttttctttttcttttttttatactttaagttctggggtacatgtgcacaacgtgcaggtttgttacataggtatacacatgccatggtggtttgctgcacccatcaacccatcatctacattaggtatttctcttaatgctatccctctcctagccccccaacccccacagaccctggtgtgtgatgttcccctccctgtgtccatgtgttctcatttttcaactcccacttactagttttctattgtatgaactatcttccatgcttattttgcttttattaaaaataagaaatctgtattcctggtattccctggtgtttcgatcttttacacacctattagaaccataatttctgtaacatcataacgcttttcaaaacgtctcagtgcctgttcctgaagttattagtttccaagtctcctcaatgcctagcctcgtgcatccatgggtctgtagttgcgcctatagcattctcattgctacttcagtttccctgtgacctcctacttcacttctctacgggtgtgcactctccttatctttcttgctttctctctcaacgttaaattcacatatatgaaagacattctatgggaagaataacctactccagcatttaatagagccattctaaacatatctgacatagagatgtccgcctgtcacctgcctattcaggaaatgagcttgagattggagatagatatattattgcaaaccacaatcaaggctaatatcttaacctgattttatcctaatttatctctgtttatcttcattttcagcatttctgctctttctaccctctcttacccaccttgtaatcttcaaatactatatctaactgatacccttcataaagggaatatttttgcacatattatgcactttcagttgaagagacagtaaccctccaagacagcaatggcccagaaaagagactagaaatgtagtgataattcataagtcaacatctgcctctcttttctaccttagccaagtttaatgcagagggcattacacttagttctagtctcaagtctaccataattagaaccataatcatgggcaaatcatttaacttgtctgggcatcaatctctcaatgaaaaaactaagctatttgacacatatggccccttttatgtttaaatcaattttattgttttttactaaatgaggtgtagaacattgacccatcaaatgaagtcactgtaaagaatataaaaattatagttaaataacatttcaaatatgaagctatttaaatgtcaactgtgcaggcaatttttaaatatttctagtcaatcataatcactgctttctcagtctttctattcttcctataagcatttgattaaagttgataacacagaattctcttttaatatgcattctgttggggataccaattaagatttctttaacttgtttattttagaaattgtttataacgccaggcaacagttgtaaagaggataacattcccagtagatggttttgaaaacttctataatatctaattatgtatagatccagactgtttatgtttggcatacaaataattgctgggagttagaatggtttgatcaatacatgcaattaagtgcacatatgttaacctttttctttaaaagttactttgttatatgaacatttattttttaggttatatatttaatcccaaatctttgctatctcatgaagaccagtttgtcataaacacttaataaatgtcattttgttcaattaaaacagaagggcctgtacatcctatgcatacatactttttcttctactgcattgtacaaacatttaaacctgtgtgtgtatagcttcaggaaactgtagctggagctgggccagaaaatgtctacagtagccttacaatagttttctagttccttggtcactactatgcatcacgagtgcctttacctatgtccttttcctcttcaacctatatacacacagactttttcctgcttctttaagggggaaaagtctgctaattcaggtgagggactatgtgtttgaaaaagtgttttcaaataaaatacttggccagtcacagtggctcacatctgtaatcataacactttgggagggtgaggtgggtggacaacctgagtccaggagttcaagaccagactgggaaacatggcaaaaccccatctccactaaaaataaaaataaaaaataaataaaaaaatagccaggtgtggtggcacacacctgtagttccagctacaagggaggctgaggtcagaggatcacttgagccagggatgtggcggttgcaatgagccaggatcgtaccactgcactccagcctgggcaacagagtgagactctgtctccataaataaataaataaattttgtagtggtagaagtttctaagcagggatttccatgttctactcatagaaaaacttacagaacaagcaggtactttaaaccccaacttctagggctaactacgtcatggaaattattctataaggacatgatctacatcattacatcacacatgagtccagccctctttgtctaagcctgtgacacatacttaaaccctgctgtttaacaaatcaactccaaagtaacccatctttgaatgtcattaaggatgagtatctgcaatgcaagaaactttgttatcccatgatgtttagaaaaatctgcttaataagtagatatattccacttgtttgttactctccataggtactctctctctacttacaacagaattatatgtaatcagttgttctcattcacataaacaaaccctgacaagaaataaaaatgtggtaatatcagttctctgcatcaaggaacatttttaataaactgtactatagaacgtcttactaatcagatcttttaacaaaacatatgttagccgtaatttctgtactaagacactgaatctatattacattgtaaaaatttgagtatgagctatctatacgttcccagcattgtatcctatgtaaaaaccctaaattaaataatacacccaaagaaattgagaccatttttagttaatttaagaaaataatgtcagatatttccagttgctaagcatttaatatgaatcaggcactgtgctaagaattttatagagagtagcccatctaaccctcacagtaaccctatatggtaggtactgtaattaatattattttacagaggaggaaactaaaatgttaaaagcttaattgtccataattgtaagtggagctagaattcaaaccaagtttttctggctcctgaattatatttttataccaccacctaccagtacatttatattcaggtttctttggctatctcaccataaaatgctgccaccccatcttaatggttgaggagattcaactctcagttctaccataagcagtagcatgcaattttagctatagctctagaagtatccaagattatttagctcaatttcccagctctgtaggttaaattcattgtctttaatgtgtttcactctagctacccaatgcaaattatgtcactaagaacaaaggaatagtcactacttgtttgtttccaataattcttttttttttttcttttttttgagacggagtcttgctctgttgcccaggctggagtgcagcggcgcgatcttggctcactgcaatttctgcctcctgggttcacaccattctcctgcctcagcctcctgagtagctgggactacaggcgcccgccaccatgcccggctaatttttttgtctttttaatagagacggggtttcactgttttagccaggatggtctcgatctcctgaccttgtgatccgcccgccccagcctcccaaagtgctgggattacaggcgtgaaccaccgcgcccggcctccaataattctttattatatactgtgctgtattgaattaccttggattccattattttgccaaatcatttatttataaggtaaattcctagaagtaacatttctgggtcaaacgacgttagtaatattgataggtacaaaggctttttgttattgtttgttttcatttttattaaagttatgcatacaagcacatagatttaagaatcaaacaattctacaatttttttaaaaggataagaaaagcagacactcccctcacagtgcttgcaggcacctcttttagctttttttttattttcaatttaccctcttgtctctagatgatacgctgcttggtgaattttgtttcagcgttacccactgactccccgccatggaaaatgagggtttagctcttttctatgcacacacatatttccaatatagttatgccataattttgtctagctcaatattcaattcacattattgggattatgtggaaactgcacaattgagccctatagtaacctttcaacacttttcctttctcatctagcattgtttaattgtcccattggcttaattttcatgtgtttattaccaattcaatcccaacctcactgctgattgtctaaatctctctcaaattgctcatccttatgaagtagccttccccagaacctgacttgctacagtctagactggttgctctctaactcatcctggagattcctgccgtctgtgtgggagcttctaatgtcttcctctttcagtgttggctccatcttggtggcaaacatccagtagtaactaactgcctgcaaggtgactttgggaaagctgcttaacaactccaaacctcagtcctctcatctcaccttaattgtgtcactacttttaagattagtcatagcctcttgacccagtggttaaagcagttgttttcaattggcagaatgcattagaagttctggggggcatttgttaaaaatgctggtgcccaggcccaccccagtgatcctgattcaatagctctgaaatagggtgtatctgaatattaaaaatacctggtggttattctgatgcaaagtcctgaagaatcactttttaagaagcaccagctcaaagatataaaacaaaaataacaagtcagcagtgattttcaaagccaacagtaaaagaagctttcaaaaatcccttcccagttctaaaatgtatacattgggggatgccagaaatatattgcttaagatttttgaaaagttccctaggaattttaaaaaaactaatttaataaagaataacacagtccataggtcattaacttcaaatcatgtattaggaagatggcgaagagctaaagtggcccatttttattattttctgaaagtggaaaagatgttgccaaaagcaaagaaaagaagacattatcttttgtaatcattgaaatagaatttttagttgattcccgccccccaacagttttgagtagacagtaagaattacaaatgattacaccacttagaaaagccagagaaaggaataaatagatttatttttgttcagaatgactgatttgttgtgatcagaaaccaaaggattttaaaatactgagtacaaacctgcatatgaggtttgtaagacaatgggtagaatactggatgtcacaactaaaaatgaggccagtatcacggtaattttgcaagatgtgtgtcaaatatcaatccattgttgaaaggtgtccaattcatatataccctaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatgttatttaaaaagtttttattttctagcatatctacaaaaatcacatcaactctttgctattgtgaaaaactacatgtcataggaaaaacaagtaatgatataaacagatttcataatttgaaataaactatcagctgaacaaagattacattaagaacatacccaataatacagattgtagatgcacaagtaagaatttacaccggtttacagcaaatgaggacaggaggatggaggatactttactccccatttgatcccacatatggtatatgatttacttggagtataaaggacaaagaaaaagggtatagggagactatcaggagaggtaaaccaatttaagctaatgcaaaacgaaaaaaaagacaaatgtttatgtctgatgacataaaattaaaagattactagttcagtcagtttaatgaagattaatctggtccagttaataaagaaaactgagtatatgtattgtaaccatgtctgaagaggcaatcctgaaagcattttttttttttctgaagcacaactctttatttttctttcttttttttttttttttttagttatactttaagttctaggttacatgtgcacaacgtgcagttttgttacataggtatacatgtgccatgttggtttgctgcacccatcaactcctcatttacattaggtatttctcctaacgctatccctccccaagccccccacccccgagcaggcccccacatgtgatgttcccctgtctgtgtccatgtgttctcattgttcaatttccacttataagtgagaacatgcagtgtttggttttctgtcctcgtggtattttgctgagaatgatggtttccagcttcatccatgtccctgcaaaggacatgaactcatccttttttgtggctgcatagtattccatggtgtatatgtgccacattttctttatccagtctattattgatggacgtttgggttggctccaagtctttgctatggtgaatagtgccaaaataaacatacgtgtgcatgtgtctttgtagtagtgtgacttataatcctttgggtatatacccagtaatgggattgctgggtcaaatggtatttctagttctagatccttgaggaatcaccacactgtcttccacaatggttgtactaattcacactcccaccaacagtgtaaaagcgttcctatttcttcacatcctctccagcatctgttgtttcctgacttcttaatgattgccattctaactggcgtgagatggtatctcattgtggttttgatttgcatttctctgatgaccagtgatgatgagcattttttcatatgtctgttggctgcataaatgtcttattttgagaagcgtctgttcatatcctttgcccactttttgatgggattgttttttttctttcaaatttgtttaagttctttgtagattctggatattagccttttgtcaaatgggtagattgtgagaattttctcccattcggtaggttgcctgttcacgctgatgatggtttattttgctgtgcagaaactctttcgtttaattaaatcccatttgtctattttggcttttgttgccatctgaaagcatttctttaagcttctctgtcagcctccctcttcttttccccactccatccttctctctgatttcttctgccttctggggaagaaatgaagactgagcaatttcatcagtatatacccctctactaagcactagcatcctgtgctgttccctcctgggacagagaagaccagaaacagctgctatgtcaatttacaccttgtctctgactaacctagaagctatagcaggggctgcattaaagacataatatgtcatttgtctgtaatctgctctaatgctttggcatctggtcacatgtattacttaaaatcagacaaatacataaactcttcacatagcccagatagctcggtgatagcacctggtaaatgctaggggtatgtagccgggtattaacttgaattgcaatggaccagcagatatgaaaatgatttgggatattaccaaagcagttgttaaaatggaaataatattgctcttactgggaagaaaaaattgaaaacagtaaaaatgcagctacaaaaaaaattacaggcagaagcgctatagtattttagatttaacctgtgtaggcaactgacaaacactgataaagacagatggccatgacagcatataaaacagtcctcaggatgattcagtatacaaatgtgaacccatttaagctaataaagatcaataccaaccagaagttgatgatgcataacccaccctttattcttatgtctcattttaaaggttaacacatttcaaaatttatacatttaaagatgcttaacttttaagataggaattgatttggcttattttatgttaaagaaaactgtttcagctcacatcaataaaatataatacctaactagaattcatcaaaaacaggtttctactgcaacatttcaacaaactagatgatatgttttacgcttattaattactcaaatgctaaaacatctggactgtaaatttaatcttccaatgaaatagctacacaatacagttttttcactattaaatacattaggttattaccctgtttacctaaagttacctccataattaccaatagaattaaggttaagttgataaatttcatgagaatcccaaagtttgaaaactattttcacacaacacacacataattttattatcttatattattttttaaggccaagataattttaaagaacttgatacataataagccttaaatacatttgtcaaagagatgagagaaaaagaggaagggaaagaggtagagaggaagactggttgtagaagagacatgaataaaccatggctgcatttaaaaattcctctgaatgatttatgaattcattacagagatcaacttttttggttttttggttttttggtttttgtttttgagatggagtcacttctttcacccaggctggtgtgcagtggcgcaatctcagctcactgcaacctctgcctcccagattcaatcaagtcttctgcctctgcctcctgagtagctgggattacaggggcccacgaccacgcccagctaatttttgtatttttagtagagatgaggtttcaccatgttgaccaggctggtcttgaactcctgacctcaagtgatcctccagccttgacctcccaaagtgttgggattacaggtgtgagccaccatgcctagccccagagctcaacatttattacggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaatatcaaagaagagaaaaattgatttaaactgatgcatatcatatcaaaataaatttaaaataacatactcagtaaagaactatccagattttcctaattttctaaattaataaatttagggagacatctttatagtttataagatagccattgactattttgttatcatactatggctgcaatatacccaataatactctgtatcctaaattagttactacacctgggaatataatttttaattgcttaatgcttacatacaaaattatctataaccatttctaagcagaatattttaatactttagaaattgagtgaggtatttagtatgctgaccattttataaggtccaaagagtatgctaatggagttccaggtgagaacaagaaatttttataatgatggccaattttcatctgggaccaccctcaatgcagaaggattggttgatgtcatgtctgccctaaactgaaactatttcacttgaatacaaatttagaaaaatatgttgataattcttcagcatattgcaagtaaatattaatttaaatattaaatgtataagtattaaattaaatattaatccagtctttctcaaccctcccagtacatcagaatcaccttagtggatttttaaaatacagatgccagggctctatcccaagagaagcagttagttgaaggtcataggaaataattattttttgaaagttttcccagatgatactaatccagtacaaaacaggattaaatgaagtcatcatagtccttttctgtcagaataaaggaatagagcttccattcaaagaatggaagttttataaattctatatctaggctaaggggacataatcataggttaagtggagaaaactgtgactcaaatactttgtgtgacttgattgaaggatgatatttttctgacagtgtgtcaacaaatatttattgagcatttatttggtgccaggcattataatgttggtactaggaatagagagattaacatgatattttcccttcagcaatttatattctggaagagagagttaaataataaacataaaataattttgggtgctggtaagtgcaacaaagaagacaaatagaataatgtgaaaggtaaatgaaggggtggacttagctctggtgaacagacaagtttctttaaaaaggtaacatatgaaaacctagaggaagagggtttcaggcaataagaaatgtgaatgctaaggtcctgagatgggaagaaactttatatatgttcgaggaatatccaggaagctggaatggccagaacttggcccagcactgggagagtgaaagggatgaggtctcagaggcaggcaggaaccagctggtgtagaggtttggaggccactggaagggggttgcttgtattccagttgcaccagggaactagccatcagagattttgttttattttgtttgagacagggtctccctctgttgcccaggctggagtgcagtggcacaatcacggctcactgcagtctcgatctcctgggcttaagcagtcctcccacctcagccttccgaatagctgggattacaggcctgtgccaccatgcctggataattttatttttctgtagagaggggagtctccctatgttgcccaggctggtctcgaactcccggctcacgtgatccttccacttcagcctcccagagtgttgcgattacaggcttgagctaccatgcgtggcccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaaaggaagcatcctgatagatttttccgagtatatgtgaactcctaatccaaacagcttttcatccaggaagtttccatcatgctctccactatccactgtaaattccatatcactatgcagaactgaggttcctgacatttttgtgtttctcagaaaatgttggtgcagctttttagtcttgtaaccgaatgaggttaggttatgttcatgctacaaacattagattccaaatcactgcttaaagctgaaagttaaccttctaattgaattaatttctacatatgtttttcctgttccaccaattatattccatttgtcatttgttatgtttcaggaaaagtgttcagtatgaaaggccagtctgatccacagaataagggtaggagggctcttgctgtaacataggctgagctcctctgaactaacagggaaaatgtgatcaaatgctattgaatgaattccatactttaagaagacagaatactaagggccatgctctgagttcatagcagtagttatctcatatttaataattgacttggcttttaaatactgtcttaaaatatcttctgaattattatgtttaattcttaatttatcctggctttgtactgttagccaacttaattttaaatttcctgataacaaggagtaggtattatatggggcccatgtgtgttaagcctattatgacataaaatatgtaataggaagtcagtaaataggtgccgaataaagtaaacgtttaacagaatatggtccttatatggtccttattatggtccttgactctagaagtcaagaataaggtccttatactttagactttaaaatgcatttaaaatatgataaatgttaacttatacaaatcaacatatataaaatttgtcaacagtagacatgtatcaaaacatttgcaaataggatttattgatgaggaaaattttctgggaaaacatctaaattgctattttagaaggaaaatgattgtaatatataaaatggacatgttttttaaataatgcattttgagtaggagagggtacagaatctaatatcggggccaaacaattttctattcaacagtaattccttttacagtatttttgccatggcccttgtagctgattcttctccaacccctgctccaagtcactgtccagctcaacacgaccatacgaataaccagtacagtagatgaaaataaatcatgtagtcctcagaaagtcttctatatttctgtctgcttagtcagtcaatgttgacaacattaatacatagtccagtattgttgtccctggtttcctttgaaatgctacaattttagaatcctattatttcagtgacatttattttcttaggggattggattagggcatgaataagaaggaatattcatcttttccttgttcttttcaagttttaaaagggtttttaatattgttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatatttccaaaaatataattccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtgcccaagaatttccatttctaacaagtccccagctgatgctgaccttgctggtatagggccacaccctgagtaccacttgtaaaaatgatgctcatcagttctctgcttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatatacctagtcctattcttggaacttcactttttctccaagaatacacaagtcattccctctccttcaagttcaaacttcctactcggctttctcactcctctatgcctaacttgtcctttatgtttatggacatagtataaactatagaaaaaagtaggtactaggacccatggcaagtcattaagttgagccacgatttcatcaaaatgtaaaggtaatagtacctacttctggctattgtggatggaaaaatgagatgatatgcacagaatcaagcaccatacccagtattcaggacgtctcccctcctactgcctgcaaaattaagttttttcctatcttcctagaacttctggcttctacagttattgatctccctgtcaactgcattccatgaaattccctgctaatcctagagtgtatcagacggaaactgaaaaagtgaccatatcagacagcattttcagttttctagaaggcagaaaaacacaaaggggataatttgatggctgcttgccagaaagtagcaggacagaaattagagctatggaaatttgtaactgtcttaatcacctctggtgaaacacaacatccggcagaacataacaaatgagaccacgccatgtctgatagtaagttttagactgagggcacattgctgaaaggcaggtgttgttctgatcacctttgtactcactgttgcctgtgctattgccatgttttcataagcctcagtagcgcatttggtttccatggagtccatccatgaactaaaagaacaaaacatctaatcccaaagcagaatatagatctcttgtagtttcattcacccttttaaacaatatcacagtaatttttagattcaaataatcattgagagaccctgtactagcagttagggacatgtcatctgggcattggctctattgaacaatatgatcttaaataaaccttttcagtgccttgggtctatggcccatctgtaaggtggacataatgctgcctggctaatctgcctttcattgttattataatacatatcaaattgcattgtagaataaaaatgtcaaacaagggccaatggaatactggtgacaaagttgaatagcactagtaactagaatcaagtcaattatcagctttcaaacataccgaatatcaagaaagtaccataaggccaggcacaatgactcatgcctgtaatcccagcactttgggaggctgaggcaggaagattccttaagcccaggagttccaggctgcagtgcactatgattgtgccactgcactccagctggggagacaaagcgagacccggtgtcaattacaaaaaaaaagtgtgccataataatctcataatgctttcacttcgtattcatgaagctagtaacataagcccccttgataatacagcctattacaaaatcaaagttggccccttctactttggaacaaatgtattttatgagtgctttggttggctaatgaatttctgtagaaagaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactacaggcaggagccaccatgtccggctaattatttcatttttgtaaagtcacggtcttgctatgttgcccaggctggtctcatactcctgggctcaagcgatcctcccaccttgaccttccaaagtactgggattagaggcataagccaccaaaactcaaacatttgtaggccaaaactcaaacgtttttaggaagaaagagattaagaaggtgggctgccctgggacttactgattgtgtaagccagcattgttggcctagtgagtgttttagcactttcagaatctcagagcccttcacagatcctctgacaggagttgaccctttggcttgagtcaatctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagctttgggagataaaatctgggtttcaagtttgataaaatatttttcacagtagttatctaggattgatcaattctgaaggctctaatttctgttcttcaagctaatttaacacaaggcagcctgaacaataccactcttggatgggcagcctaagaaacagattttcgcaggtgtttcctctgtgctgcaaacctaaatagccccctacattcaatcacatcgatgccagaggcaggaaaaaaactgcaacaaaagaagaaaagagagcaagctcagtaaagctgaggactgctcaagagccgttttgatgtagagatctctgtgaaagctcattaaatcctcagtgtgtgaggcagggcttagggaaaaatagaaatagggataataagacaccatatccatccatactgacatatttgcaaagcattcattagttaaaatcctccaaggaaactccatgtgactcctcagcatattaaggacctgaatcagctcttctggttaaaccacagtccagattaacagttacatactggagagatacagttagtttttgttttgttttatttttcataataccacgaacaaacctattgcaaaagcaattcaaagcatggttcccataatgaagaaccagttgggtcctcttcaggaggaaagatagccccatataccatgaatatctaatacatctgaataaatgataataagtcattagatgacgggtgtatatgagaaaagccaaacttactaagttaggtccccactgcttttattttctggaagacattcataaggaaagatgtatcttcatgcttcagccaaaacccagatgggaataagaccttctattatacaggattccccagagaaacagaaccaatagtgagggggtcaggggaagaggcagttgggagagagggagaaagagagagaggctttatcttaaggaactggctcattcaattttagagtttggcaagtccaaaatttgcagagtagcccagtagactggagacccaggaaatacttgatgttcagtccaaaggcactctgctggcaaaattccctcttcttcaggggaggtcttttttctcttaaggcttctaactgattggataaagcccacctagtgacctcattgtaatttaattacttctttaaagacattgtctccaaatacaatctcattctggggtgctaagggttacaacttcaacatatgaatttaaggggacacaatttcacccataaaatacctcagtgggttttattatgatctagatattagaaagagagagagagacagagacagagacatggggaggttgataaatagcagatgtatttctcaaagcagtgattctcaaagtataggcccaggcccagaagtatcagtatcatgtgagaattggttagaaatgcaaattctcagcccctaccccaaatctgctgagtctgtaagtggggcccaggaatttgtgaataaaccttccttcctggtggttccaatgaaggctaaagtttgaaaacaactctcttagaagttgctttattaaaagaatgacgccacctaagaagttttccaacaaacatgggtgtaaatatcgtttaatctgtgtgttttcattaaatatatcaagataagtcatattttataagtgagccttggatctattttactcttataaattgaaaacaaagccagagctccaaggataagcaccacaacactgcaaagaaacttggcctctgagtacagatttcacagggtaaaagcaaaactgtgagtacccaataaagctaatatatcaaataccagagcagtctaattgctgtctgtctggttggaagcctccattaccttatgtaattcccatgaatggcagactaaattataatggtggtacttaataaaattcattctaccctcttcttaaaaatgaaaaactataaatagaactactgagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggcagcctgtatgtgagtgaagcttcagaactacttgaaaattgcattatttaactgtgtccagatggaatagagaacattctcacactgagcaattataccagcaggccattgattgggaagttgatgtttgtctttttccacatgaacaagggcagtcccattgctggaagctagtgctctatcatttttaaataaacagaatgtttgtcattagcattttctaaagtattggagatatctgatctggatttgcttttatttcttcttgatcaaatgaaatctgcaaagcctccatatactcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaagtttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcctcatggtgcaattgaagacagtggctgtcccaaccaagtttttcctctttaccagtaaagcaaagggtttctcagaaatcccactcagactttccttagatcttattaactggagagtcaaagggccacttttatctaaaagactaaatgagaactaatgggacaagatcatcatggctggcttttaagtacaagaatgacaggaaagtaatggtttaaaaaaattaatatggaaatgaaagaggagaaagggagtcagtaagaccaagtggagcattgctaatataattctgtcataagaacaagaaggtctaggtaatggatcctcttatgatggcttagtttgtaatacctttcatgaaagaaaaaacattatggacaggtggtcagatacttcctaaacaacagtcacaagttgcactgcactgtggtgactggtatgtctgtagctgcaggttaagcactatctcaagcatagaggtgacccttggggcaagatagtgcctctgagcttctaagggttacatgttataggtctgatttccaccttattctatacactctctgaaacttccaaagattctgctacataaatcaacctcatgcccaagttggtggcagcagaaatgaaccttaacttagcccaaaagggtttgaagagaaccaagaaataaagctagaaccagatccagcactatcattattctcatgctactttttaaagtcttgtccacattagtcagtgatagaaaactgatgttaggaacactgagcacctaagtgtcactcactctgatctctagttgctgcttctgataaatttcaccaattagcacaggcttagagtcagattatctgggtttgaataccagttctgctacttgatagtggtgtaatcttggggaagtgcttaaattctctgtatttttcaataaaatattgatcacaatagcacctacctcacagaattgtagtgagaaagaaagtgagttaatatttgaaagtccttgaaaagtgtgtggcacatgtcagccctcccggaatgtctgctatttttattactgcagccattattattctggtgtagaggtgaactaccctgctttggaggtcataaagaccttgattcaaatcctgccattatcacttactatccctatggccctggacaagttaattcatggttctgagcctcagtttatttatctgttaaaaagggataataatgcttgtttcatcaagctatggcaagtattaagatggcatgtgacagtgcttagcacaggccctgacaaataagtaatttgtattcttttttatcctccatgatacactcttttctctgggtttatcactagaactcccccgggatgatctgttacttatgactaatcatactctgtgtacttataccactaatattatttgagtgaaacaaacttaaattcagcatcaggaactaccttgaaaggaaaatagactcataagagtagtctcttccagttttgagaagaaaagatgccatcctacaagtatggtaaaggtcttgatgagggaggtaagaccatgacagtaccaccatgccttcgtctcacttccccaccacaactgagtgatctagccaccctctagagttgctaccaccatttgttgggaaggcatgaagtcaaagaaaagtttgagacctgggatagttgtccccatttgtcataccattgggatagctctgatcgtcacattcttagaaatgcaaatactaagctctgagaagatacagtcttctttgtgaatcacctccatcccaatttttgacctcacttttaggtgggatgtatctacagcacagagtctgtgactctgagatacatcaaagactatttggtggcccctcctgaaatcagaagaggatgtaatttgctgtggtttttgcaactctcttacgcacagtccaagcaaagaacattatagttttagagtggatgtggctgtccttactctggtatactcacaggagaaggacattgctgtcttctttccttccatctttgatcacatcactactgtattgtgacctcttcttcccagaagaacaacagttttatcctcttaatcttgttcaaactgccttctaacactgaccaccaccaaaagatgttgcttcgagaagaggctgaatggagaaccttaaatgcatggggaatattcctgagtctcattgaaatcagtttatcctgggtattacacttgaatttaaagcaaatgtatgcacaggcaatcctgggtgagctactctgaacaggagatggcagtagcagccaaggatttgggcagccctttctagtcctaacagaggggatttcctattggttcattgtcgattctggactgcagttttgcctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaacaaacagatatgcccacttagattggcattagtgggtttattggaaggagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggcacacaaattactttgtaatagctctaaattctttgctttatcctgagtctacaattatgcacttatccatgctcctgtcatctgtggtactgatttatggaacctctgttctctgatctcctcatttcttacctctgcctcctttaaaactcaagaaatgtggcagcaaggtcaaatttctcatcgggccagcattacattctcaggtgtaatcattaccgtcttaataaagcaagcagttagttccacaatggtctgtttaatccactagataattgctaagccttaattatataacccagcatactgtcccttgctataattccagaaccaccatgttgtggtttgaaacatctattaatttggtgcaaatattaattaaaaatttatttctagccaagaatatgatggatcaagtgccatgtattaaaaaaggaaaatataattaatcttaaccaatttcacttggagcaaaaacaatgtaactggaaagttttctggtaactgccacacactcacagacttttttcaaaatttgaaaaaaggtatgtctaaattttaaagtattgcagtatcagtttggtattatggtagaggatttataagccatgcaactgcacaaaatttttgatatcgttaataaggcaaagatatattacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaatcctacagagatgaaaacatgaacatttgcattgattaaagagaaaaatgaaagaaagaaaaagtatcactctaaactgttttttttccttttcttactctgttcacttcacttctaataatgtcttacacttttgggggtgggaggaattaatgctgtgtgttcttttattgctcatatcttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcaatacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaacagaacgacaataataacaacaaaataaagcaggttatacaagctcgtatgcatctcagatgaagaactttcctctagtaataggctccttttccctaaatgtatttactgaaggcctctgtattttaataagctatattttcactggttttaaaacttcattattttcaccattattcacatccatttaatgtgttacttttctataattaagcattacatttggcagttatgccctcaaaactgactatatcaacatttaaggtcatgtatttgtaggcttattgggggctgtatcaaaaaaaagtcactaatgagagatcatctacaaatccaagaaattcagcatgctagtgtagatgtgaaagtgtggttttcataatgctccaaatattttctttttctggataacttattttaaggagcccttcagtaaacagttctgatttgacagcaataaccaaccacaaacacaattagtcagtatattagataagcccgagattggttgaagaataatgcaaacctcaaaataacaatgatgtaaatgacatagaaatttatttctctggaatatgaaataatgtaaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctcgatggtcatgaatctagtcttgaccacctgcaagggaagctgggaaatgtagtcttttattgtaggtggcaatgtgcccagctaaaaattagggtgctaaaactaagggaaggaggtgaaatgggtactgaaggaggcaacacctagttttggtcatggtcaggttctctggctccttgacttgctatcattgtcagatcatacagtgacttagctttccatgcatattcatatttatttatataaatcaaaccttttgtgttttactaacataaatataaatatttgaaacaaacataaatatatgtgtttacatagaaatatatatgtaattgtagaaattttgaaatgtagataattagaaaaaagtgctaagcaatcataaaactcaccacccagaaataagtgcagttaattttatggtacatttttccaggttgattttcatatacacatgtgtatctatatacttctcttaatacaattgaaacatacaaagcacatcatttttaacctcttttttttttagcaatgatatattgaggcgtccttctgcaccaatattcttttcaacattgttttaaattgctatagatcatttcatgatatcattccacaatttaaccaacgtcctattgttggcatggcgagtctgtacaggtctgaaatgttacagtagatagctagtcagacatgaacagggcagtagaaagtttattaaaaagctttagagcagaaagaagtaaagtacacttggaagagggccacacaggtgacttgagagatcaagtccacagtttgaccttttgatttggggttttatacactggcatgcttcctgggtcttgtgtcccttctgccatgattcttcccttggggtgggctgtccgcatgcacagtggcccgccagtgcttaggaggagccagccacatgcagagtgtgtttactggagttgtatgcatgcttacttggggcactcttcccttaccagtcaagtgtccctataaggtaatataccagttaaactccaccatcttgcctcttagtttgcatgcttcagcccattcgcccaactcctgagatcttatcaggaagctgatcactagtctcaggtttttctatgtattgggagactactttccctggggctggctgcaaccaattattattttagagagtcagttaataattgcctgaccatcatctgatggttgcctgacattcctgggtgggggacgggacgatggtctctcctgtcctgctcatgtctgaccagccacctactgtaacactattgttaatcattttgagtttttctgtattataaaccacactgcaattaacatctttgttactaaatctttgttcatatccacaattacttttagaagatagtttttctgatcaaataatatgcatatcttaaagctttgatatgccaaattcctctccagaaaaattaacgttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccttttttattattgtggaaagatatgagaggagagaaagaagctcatgggctcaaatttggaaacactaacttcagactgaaaggaaaaagcctctggttctgaagataagtcatgtatgctaactcagaatggcaacataaaaggagaggttatccttccatttcaagaggcagtcaatgaagttgtcacctgacctcttccaataaggtacccagatattttcctcctttgaagaaagaagccaccatgatcttggctcgcattgtgttgagtttgaaggacactgcttcatatgtgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcatgtttcactacatttaaagccaatacagtaagtagccagatcacaatatgccaaatagctgtttgtagcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaaaacttcaggtaattgcatgcctaaatagtaaggtacaaataaaaacaggaagaaaaaaataatcctctaacagcaaaatcaaaaattaaatattgaaccataactctcttttcctctataagcctaacagttcttttccatatatgtaaggaaggcaaatatgcattttttgtttacaatttaggctgggactgctacagtgactcacctggagtacaccccaatgaaaatttagtgggcaataacacagaacaccatgcccataaaattataaaacattattggggtttgcccatcctccaattgtcttgctgaagtctatttttcttcctctataggagaagctatttagagtcaagcatcattaaatcaaaatgcaaaggaaggagaaattgaatgtgggttaattgcattctgaatgcaactgaaccgcagttggtacaaattactggcctataagaatgcattgtgcctaccaggaagacaagtattttggtgaagccggagtatgggtgtgtaccaggaagtggcagcagatgaggattctgagtgtgtttgtgtgtgtgtatgtgtgtgtgttggcaggtggggacacattagatccttgtatgttgtactaagcagttggtactttgtcctgaagcatagctctcccaggagaattgcagctactgtccaggaggatcccagtctatgcaatttggcacactctgtgtaatcttctctcctttatcgcacaaagaagtcctatacctgcaatcttgctagagaagtaaaacctgtattccttatcagtagatctacagggtaataaagggaacactatgatgggagcagctgtaatggaattgaagacctctttcttcttggcatcaactgcctgaagataaaaggaatacaattaatataaataaagggcagaaaggcactgactctaaggcaatgaaattttgtaataggagtggaaagaaagcagagatgaatgagggctacaagaatcacaacaggctcctgggaggaggtgatacttgctgtccctgccagatgtaaagcataattttcagggtcctcaagaattaagtggcaataggactcaaaaaaccatttctccaataggaatatagtgatgtgcaaaacagacaaatctctggtctcatggctcaccacagaaaacacaggtacttgtatttttttgcagggccttgttaggttacctgtacccaaaggatttaggtaactcttcctttatatattttccattttatttatttatttatatagaattatttgcttgcttatttacaatttgtttgtttgtttaaattataaaagtaatatgtgtttatgacagagaagtaaaaacagaccagaagtataaagtttctctctcccctgccctacccagtccttccattaagagataaccaatgttaaagtgttgcatgtgcatcctttcagaaatttttcatacatgtgcaagcatagatttatgttatatataaatattatcacactattttactttttcatgtaactgctgtagtgatagcaccataatgctggtataaaagggactccaccagggcaatctggttggaaagatggtcttgaagctccattgcaaaacacttatgtaaaatagaatatcaattgttcatatcaaagaaaggaatgtgctggaaagtggagacagtaaagccccagcaagtaattccttggttttaccacttaaacatttttgtatgatagcacataaatagctgcctacgattccctcgagtgaatggaccataatttattgatcattccccaacagtagacatgcagattatatgtagagtttttgccttcataaacaatactattttgaatccctttgtacaaagcttatacttaggcaagggaacctataacataattcctataagcagaattcctgactgaaagggaatatgcattttaaatgttaatagatgttgccaaaattaagccaattttccagtttgcagttaatgggagaggatgttgttttcttaaggctttccttgtagaaagaaagtgctgagtaatgcggccacagaactagttctgctagcttaagtttcaaagtctacctacccatttgcaactaggatccaagccaggctttacatgttcagctttctctgagcttttgataacgaagctgtttacattagtaatccagctaaactgtggagtggcatagtcccatttacattgagaatcatttttgttttagcttgtgggagtgtaaattactattaaaggagttccatttcaaatccaaagaacattctattgagaagaaaactaataagagagagggaaccacgaaggccaagtctgagctgctgacagcaatgcagatagaaagaaacaaggcaaggcagagaaacaagttcagggaattgaataagaaacggtgtcacagtcacatgatcacagtcatatgatcatgaaacaaaaggtatggtagatatttgcctggaagtcccttaggaaatgatggcagcaagaccagacggcaaaaacaaaaagttgaacatctttgccattttcatttcatgtccaaatgcttcttagaaacatacaaccttattggcattaacattttgacattttatgtatagatcctcttctaaatagagtttaggtttatattcatattattgtagtaaaataacagatgatcactattttttcaaagattaaaaaatatgactcagaaaaatgcgagcattggtaatttagttttgggctttgtcaaatatcttttaaaaaactcagctaataatacactaaggcttctcatacataatttgtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatgtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggccaggtggttggtttctcttcatccaattgcatacaatgtatttctaaaaggatttttaaggaaatgtggaatatcatgtagtaatatgccctgttgctcattcctcctaaatctctctcttatctccacctctgcctcctttcccgcaacctgccttggtttaggccctcaccacttctctactgatgacaacagcctctcaaagcccagcccccttggctcctgccttgacgttactaccaatggcctcatcctaaagcaaaaatctcattatgcctctctcctgtttaaaatatttaattggttttaattagcttctcactaccttcatgatgaaattcgaattccttagaatgctctgcaagccctttcatgacaaggcccaggcctgcctctccaaatggcatcacttgtaaatggcatcatttaccctatgctccagcagtaataacactatgcattcacacaggggaggttttgtgggtgtcagtgctctccctgaactgtcatcatagtatccccccactcccaccccccacttcaacctggagaacctctaaagttgtgcttttctgtttttcttttgcatatcatgtcctgagaatcttgttaaaaagactttacttctgtgggcctaagatggggcccgatgttctgcatttctaatcagttcccaggcaatgctgggaacacatattgaagacaaagctgaaaaaccttactctaccgttactccctctgtgaaaaactctcctgcaaagctgatctacacaaagcgtcctctttctaatgtttatgacttgtatatagaacatgtacaggtcttcttagatgtctcatgtcttatttaattacttggttataggtctgtccctgtaatcacttgtccatcatcaagggctggaacagtgactgctgctccttgtagtcccagcgctaacatttggtccagatgtataggaatttcctagaagtattttgcatggaaattagcgaaaatttttcacttggtgcccgaatgatcatttcataaggtgttgttaaaaatgtccactggatggaaggttacactaactttttagctctcaaattcgtggtttttctttatgttattgacaatctctccaatggggttttggttagggggaggcttaaaagtaattgatttatgattcttttaaccaacatgtaagtcaagaggctggccaagagtttgaagagcccgaacctgttagacagtaaaccaattatctttgtgaccttgtgggtgacttcaccacccccactgcatagcacagccctgcctgtttccaaaacacctggccttgcacaaaagaatgaagaaagagccaaggcacagagaatattctccagcagagagtttgggcaagaagtcttaaagatgtctgagtagagagacaattagtggaaacaaacatctgtccaaggtctctcccatcatgtcatgaacttgacaagaaaggccagcagtaactcttccaaccgtggtaaccaatggccctgaaatgtgttcaatatcaggtatatcagagcccgagagataagagtggttttcaatgctgtatgcacgttagaatcacctgggaagtgatatttgtaaaatatgaacacctgaggccccaccccagaacagctaattcagaatttctgggggaatggccaaggggtcagtagattttaaaactcaggtgattatactgtgaagccagagttaacaaccactgatagagggtagtaccttcttcccctataggtgcctcagaagtgaacatctaacttcagcttacacatcccactaattgaccactgagtcttacttattttaggcaaaacgaaaccaatagaaagttttgccttttctctatgtagaagggactaatgattctataagaatttttaaatttctactcacatttcccatcacacagttgttgagaaattggtaagttgagaaaaaatgtgaggtgtagaaagaaggaaattgaattcatttagaaaagagaattccaaatgagcttaatttccttttttctaaatcttaataatctaccttgcttttcttctccttccactgcaccctttctccatgaattcatcagtcatagtggtaagctcacagtatccggcagcaggtcaggtgggatcacactggctaacaaaggatctgagggtacaatgcagaagttgccagataatgggattcaattacatttctaagcatagacttctccagtgttggctgttacactgcccaatgtggaaaagcactgctttatctacatggcaagtgcttcatacattttagttgaatctgactcggagtacctcaatttttttaatgaaatatttgaggtctacaatagtaagtataaataataatataatgaagactcttgtacctatcacactaaagaaataaaacctaacatctataatcaaaatagcctatgtcctctttatctcctttctctcattctctcctcagaggtaactgttaccttgaatttatgattcccaaccctgttttctcattttgtttgtcattccaatgtatgtttttatgacacacacagttttggttttgtatgttttcagccatataaatggcactttactgtatgtattttgtgcattttcaagctttatataaattgtatcatatatccttctgcaacttgactccatatttcattcttgggatgtatctgtgttgattaaagtaacgttgttactttttattgctgtataacatgccatggtaggtaaataccccagttggtcagctaatggatttttgaattgtttctaatctcttgctgtcacagacaatacaacatagctccttgtgcaaatgtgggtgagtatttctagatatttacataagagtgggattgctggaatgtagggtatgcacaatttttaaatttcctagatgtattaaataacaccccaaccagaagtgtgtgagctttcctattgctcatatccttgccacgttggcactgttagacttttaaatgttcagccaattttaactggtgagttttcccttaaaaaccctgaagagggcagcatatcctggtaattgctgcatcttatacctgcattccagtttatgggtccctcccttctttactggttgaaatcctttgacctcagttactcttcaacccactctctcacctcagtcagctctgggcagtatcttagaaggacagacaatataacactatctcaaagctgaaagttacctccagctttttcattccacattcctggcacacttctgtcctctgacaaggaggaggtagggaaacagaaacaagtcagtctggaattaaaacactttttccagttcaaagtagcacaagagagatatgatgtgagtagagagtagtcttccaccattctaaagcagtggtttgtaatctaaatagaagggcattgcacactatcaaaaactatgcttatgtaaatgggagaaatactgagaagtaggaaaaagtattgcaaagtggtagtagcattgtttttcttctagaataaaagatatttactcctttgccttctcagttacattgttcctggttccctaaggaaaaaaaaagtgttcagcttcagaacatctcctagaatttctctcgtttaataccaagctaaagtcctgccacttccagagttccacagtgggaatgcaaccttcacaaagatgctttcctttaaacaaagcagatgtgaaattgagccatgcttaaagatttgacatggctgctttaggagggaatttattgttagtactttcaaagtagacctaaaaacaccactctgctttttttattcctgaactggattttaagatcgtattgctttaaaataaatgaatgaataaataataacattttattttggggaggaggaagtagaaaaataaatatgaattgttttggaattgattgctattttgagttattaaattgttttcccatccattgtggtagatgaaacttcctccaaatgagatctgctgctttttcattactgtcttgaactcttttatatgctggtgtgttttataaatttctaaggtgcgccatttagagagtctgtgcttctgaactgtttgaccatagtttccttgttcaaggaacacctcactggagttcaaaggtcacactttggaaaaatgctagcatagctattctaaaggtggctacaccatcattactaaccattctggccagaaattcacaagacccaattatatgtcatcttgactgaaattctttcatgatagaatatctgtcttgacatgttggttggtatacatattgctcttgcattgaatgctgttatggagacatttgaagccagtctaatttttgctttatccaatgtgacactttttttgtttttttgttttctgttttttttttttattgttggtggtggtgggtgtttttgtttgtttgtttgttttctcaaattcccaaggaatgtctttatacttgaattgtaagtattcaatcagggctgtgttaagcattctgttaccagtatttcctagaacatggtatgttctttcaatctataaatgtggttattctttctctttagtgaaatttccttgtgtggtatttgtgaatacttttcctgttccatttattgaaacttctccttcagggacatcaatttcctcatgttaagtgcttttgaactccaatctgtcaccttctaattcctttggttcccttgtatttacaagccattcctcgaggccggtaattttatttgcagccatgtttattttgttccttgctctgtcaccttttaaaaattcactctataatattgtttttgtactcagcctccttagttctgtaaccttcctggggttctgtcaactcatctttgagctcttgtttttctgagttcatgttctcattaacttgattcatagtacaaagcacttctgaggaattttgttttgttctttggactatgttttctttaaaagagggagtttcatctttcttttgcatgctatgttcctttcttttaaggttgattggttttgtttattttcatttgggagcattgccttagcatgtttggatgtttgtcactgatttcccccatcttactcatacctgaacgctttatctggatcttctctgttctatctagtataggtgacttattgactcaatttccatagactctaacttttttccccaaagctatggttaaagaacttgattttggataccatccacttaactgcagcctaaggaaatggtgcagggagtagagagggaagggaaagctctgctgaagctgtgtgacatctgagttagaactcctgggctctgcacttttggttgctcgtgctctctctctctctctctctgggatttgttagatactttgaactacattttaatccctctctttaatcagaatacatatccatcctgaaggggaacactctaggattttttaaaatcattcagcaaatttttattgagcccctctcctttgcaaggcacattctaatctaggtgctggaagtaagctgtgtgaacaaatgagacgattcccctttctaatgagtttatatgcaatgtggtatctttaccgatacatgctctgtcagaaagaagcagcccacttctgtccaatagccaatccactacccttcagacaaaaatgagaaaaataaggatagtcatttagttagtttctctccagatctgaagactatagtgaggtcttgagagttcagtaattcaccagtaaggttccaggggcaggaagggagttcagggttagaagctacactgtaccactccaagatctgttcttttgtgagccagcattgtatgtgtgtgtgtctgtgcgcccacacatgtgtgcacacgtgcatgcatgctttgttttgttttaatgtccatattattaggttacagtcttttccttatttcattgctgacttattactagaaaggagggagctagtggttttcattgttggtatcccttgtttttagttctgagagaaagagaaagagagagactctataatctgctttcattctatcacctgagcctggaggcctcaactagttcttttaactctaattaagccttagagtctgcaagtataagacagctgtgaagtagctctgccctcagaattttgtaagtactttaagacatagacaaacacacatacacacaacaaaacaaaacaaaaacataaagctgaggtggtttggttgggttccttgccagcttagcctcttactcttggctaaaaaacatttcaaggacttaaactgtggaatagttctaagaaattgcttagtcttatccctggacactgcaaaatggattgcctcagatctaagaaacccatttatcagaaaaattcttcaatttcatgatatgttatggtcgagatgttattgcacaatcccacagaaatctagtccctctcctaaatatgccgaacacctatacagatggaggcaagcagagagaggaaggtgagagtgaacacttgttcctgaaatctcccaagataccggctctgggttagcattagaaggcctaagcacctggatctattaacctaaatagaaaaaagaaataaccaaatacttgttgaaataaccaacaagtatttggttatttcttttttctatttaggttaatagatggagcattacctaaaaatgagatgaagcatcacctacaaatgtccctcaaacaagtcatacttagttcagattataaagagagtatttgataaatgctgtacgtataagggaattcgaatggcactagcttacagcttcttgtgtcactaccatgcctctaatgcaatttcccccatctagaaatgtaaccctcagccagttgccttgaaagctggttaccgtggagatgattatcagtattatgatgacctatttagaagaatttgtgcatcaccagaaaacaaataaccacagagagagcctttcaaatgaatcatgctctttctctgaaagtgcctttacaaacaaatgccatggatgtattgtgtttgtgtgctgtgtgtggatttgttcattatttgtatttgcaaaggttttagtgaaattccagttgtctttaggcatgccaagagtagagagggtagtacaaacaacaggcataagcatatagacatctgtcctcttcctacaatttgaaatgcatggccatggctgtattgatttctcagcaatgttaacatttctttcatttgtacagtttttcttgctcatccactgctttttgaggctttttaaggactgctggaatgtggttggcaggtggttggtaaagactggtttttacaaactgattggccattaatagttcctaaacacactatgactacttgatgactattttgattttctcaaaattatgtcatgaaatattctcttaacttctgtttggtctcccatttttctataaaatagttttgtgtgtgattgtatgcagacctagtgttttgttttttttttaagtttttaaatttgttatccattaatcattgccctgctccttataggaaagactgattttcagctgctgccctttttggttttgttttgcttttgatttttcttcttctttttttttttttttttttgagacatttaatttgcacttgtaaaaatttcagtgataaaaattaaacctttattatgttcatagaagcagcaaataacaatataagccaaatgttaccccaaagaggtcaaacagatctaatattttccttccagtctatgaaggtcgtgtattatggcatttttatatttgttcttattggattttcaggcacactcctttttctactctcatccttccacccactgtcacttcttctaaggtaatggcaggaatgttcatattttctgctgttatttcatatcatctagcaaagtgctggataatcgatgtttaataaacctgacccctcatataacctcaaaagtttcaaaagttctttaaccagataaactccatttttgtctgttcatgttcacaatggccttccagtctaggaatctccattttttaaaccatgtacaggcagtctgttttccacagaacattttgggtttaagtcaattaactaattttggccccattttcaatttctataccatagacttgtccttatgcccaaaatcacattgctctgaactgagggcaaatatcaaattcatattaatcacctcactaatattcttaggctggtctgaatgctatgtaaatcccaataaaaatcttagtgtgaaaaaattttcttcaactaaatataactccttctctttcaatattttttagaagtacattgacattttaattaacaagttcttacttaaattttaactccaaagagtctagcacaatatatttaagtagtcaactacacagtcagtgtaaaatgttgacttctgtccatctaacacagttgtataggaacggttttacctgcaaagcactaataatacttattggcgtatggcctttgactcatttataccatttcctaaaagaggcatgaaggacacagagagcttttccatgtaactcagagcccataaatggtagctcctcttagaatattatgtctactctcttattcaattattcaataaagattgttaactctccctctaaagtggccttcaaattaagtaaaaagttgtgagttgtttgaatcatattcacatccagcactgtttgattaaaaaaaaaaaaaatagcctttctgaaaccaaacttggagtcctaatcacccagaatagttccagacaagattcagaatcagaactctgactctgcccaacaattccactaaattaattcactctgcactctcttgaatggatttggaaggcaaatcatgagcttgctttagagtatttcctctttgtctaatcttcactcctagaaatgatagtgcttagcatttagcacttgcaatccttcccaccctgaagctaaactgggaagaatgagagcagagtgttctaaccttattcataccacaggcaattattcaaggaaaaaaaaaacatatttcacagcctttaattagataaacttgctttgtgaatagaacacaatcttcagaagaatgatgtggaataacttttctccagaaacattccatggctttattccctcttctctaagaaaattcatgtccttaactgctagctatccaaagcaaatgattaacaccccatgtgtcttgcaatattgtatgatagcgataatctaatattgataacctgcagaactgctcactccaggaagctatcaaaaaaatgataagccaagtgaaaaaagtacagccacacaacagaatgttaatatttatgtttctaataacattttttaaaaggtttctaattaatgtaaatatattatgatatggtttggctgtgtccccacctaaaatctcatcttgaattccagtccccataatccccacatgtcaagggtgggaccaggtgaaggtaattgaatcattgggggagtttcccccatgctgtcctcatgacagtgagtgagtctcaagatatctgacggttttataagcatctggcatttcccctgcttacaattctccttcctgccaccgtgtgaagaaggacgtatttgcttccccttctgccatgattgtaagttttctgaggcctccctaagccatgctgaactgtcaattaaacttctttcctttataaattacccagtctcaggtatgtcttcattagcagtgtgaaaacagactaatacatattaactcactacagttattccagctaataatttttgtcatgttctatccaatctggaacagtacctgttagggtattcctgatgagaagctcagggagggcactgctggataaatcagctgtttacaagtttcattcaccattatgttagtgttcagtgagtaaattatgccatttaagatttccagggacaattcttatgggcctgtgcccaagaagtccccataaggtttagcgccctcactccaacatgctaagagaataaaccaaaaaccatgtattcattaaagaagtgatcattgaggacccactgtgtgccatcaggttctcagctagtgctaaagatatggtgggaagaaaacaataaaaacggaaatggttcctgtcttttgaggcttagagattaggagggaaaaagacatttataagtcacacaaatagaaagaatgaattggcattttataagaattatgaaagtaaactctgctttagaatgaggagtcaaaggagtttccgtgaataaatgatgttggagctgagcttaattgaagaggtatgggaaagggacatgaggaggaggcatcccaggcatgaggcatgaggagtggaacacattcaaagggctaaaaggtcactgaggctggagtggaggcagcaagtgggagcgtcctgagagaagaaactggagaggtagagcaggagccagatcattcaggctctatttgtctagctcagacatgtctgcatttaacttatggtataattactggattaaaaacaatataaggagttatacaatgttttaatccttctttacacaatgtgtataatctaagttgataatgcttatgaatgttgaattacaatgaatgttcaaagtcacaggacttctgtgataactaatattaactgtgtgactgtggagtgataacttttagtcttaagtacctcatctgtaaaatggaggtcatagtacctacctctcagggtagccactaagtcttcatagataaattggaaagactggatggtacagtgcctggtcaaagccttttaaaaattagaagaaatatgcagcacagcccttatacctgggaaagaatgaaccctatcctggaacccagagtttagagggccctattctggttctcgcctagctacactctcaaagggtggagagtcttcaagtccaacagaatacactcacctggaggccacactgaactctgtattctagatgatgctctggatacctgagaccccaaagtttcctaccaaaatgatcccatgatgattcacgaggcctttaagtgtcttttccccaagcatgcaccatctgaagacagatgcataccccatgtctgaggggtggctagggagcagtggtgaatagcacttgtacatacaggcagagtgtcctcaaatgtatatgtgaaacttcttgcaatgcacgttgtagcttagtgtgagaagaggagggggacgggacagggccagaaataaactttacccacactaccaggttctattgtgggaccacagtctgagaattataaatgtaaagctggattctctggtcattattaacatttatttgtcaagatatgagaacagaaaatacctattgccttagtccacttgcattgctataaaggaatacctgaggctgggtaatttataaagaaaagtggtttatttggctcatggttctataggctggacaagaagcatagtgccagcatctgcttctgctgaggacctcaggaagcttccaattgtagtagaagaaagggagcaggaatcacacaacaagagaaggtgcaagagagagagtgggaggaaagtgccaggctctttttaaaactcaaatttcttgggaactgatagagcaagaactcactcattaccataggatgacaccaagtcattcatgagggatccacccccatgaccccatgaccaaaacacctcccactgggacccacctccagcattggggattaaatttcaatatgaaatttggaggggacaaatatccaaactatatcacatatgttaacagttggattttttgtttttgtttttgaaacggagtctcgctctgttgcccaggctggagtgcagtggtgtgatcttggctcactgcaacctccacctcctaggttcaagcgattctcctgcctcagcctcccacatagctggaactacaggcaccagccaccacgcctggcaaatttttgtatttttattagagagatggggtttcaccatgttgaccaggctggtcttgaacttctggcctcaagtgatacgcccgtctcggcctcccaaactgtggggattacagaccactatgcccagcctggatttttattatgatttttttgtttgtttgtttttgttttttgagctggagtctcactctgtcacccaggatggagtgcagtgacgcgatctcggctcactgcaagctccgcctcccgggttcacgccattctcctgcctcagcctcccgagtagctgggactacaggcacccaccaccacgccctgctaatttttttgtacttttagtagagacggggtttcaccgtgttagccaggatggtcttcatctcctgacctcgtggatttttaatttataacttttaacaattagacatatggcacatggacttggatttgtagtgttaatctgggcaagtaaaacagggaggtctgagcctgtgatttacaaaagtctacatatcagagaattccatttcatttaaaccatcttaagatatatggatttcctatttatgaaaatcacattaggttaatcacgaatttccattatgcacaggaagactagagaaagccaagggaaatagtaagttcaaaggaagacagtccctctagtgacctctttccctctctacctaagcataccgctatccaaatatcactgaatgtatgtcttatgaaactgtatatctctatgtagaggtggaaggagaaaaaaacatgaaagatgatgtttagaattaacaaaacgttagttctctagctgtaaaacttgtttgtactccctgactataaagcctcaaattcaaattgagcatttccagctgagtgaaaggtgcctgcctgctctgagttcctgtcacagttattgctgtacataagtcatttggcaagaaaacacacacggtcttaggctatctttcctactacaaaaaatatggactaatttaaatataacttttttaggaattgatgtcttctcttcccaactgaactataagttctttgaagaacaaattggaatctgctgttttctgtatgccttcattctcttgcagcccctaagagttgcttaggaaagccgggcatggtggctcatgcctgtaatcccaggactttgggaggctgaggcaggaggatcacttgagttcaagagtttaagaccagcctaggcaacatagcaagatctcatctgtactaaaaatcaaaagaattagccaggtgttgtggtgtgcacctgtagtcccagctacttgggaggctgaggtgggaggatcacttgagcccggaggttgaggcagcagtgagccatgattgtgccactgcactccagcctgggcaacagagcaagactcttgtctcaagactaaacaaaacaacaacaacaaaagagacgctcagtaggtatttatacttaactggttcattcaggtatctagcaaatattgactggattcccaccatgtgccaggctctgtgtcaagcatggggatacagagttgaacaagacactggctgaaagataaatacctggcacataacagacactcagtgagtgagtgaataaatgaatgaatgaattctgtaccacaaagttaagagaaaatatcaagaaaactggaatcaccatttaagttgtcttacatccgaagttatcaaggtgaaagatgtcagcctggcagaatgcccacaattctagaaaatctggggaaaacaagacagtcctagcatttgttcctctggatcatctccatgactatttagtatgtggtgctagaatcttgcaaagaattaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgggattacaggcatgagccaccatgactggcccttgagccaccatgcctggccccatagtttatttttattttctccttctaatattgtaagaaaactagattaccaaggtagaagttgatctctccctcaaagctatttatctccttgatgtgcagtatgcaaactgattttaaacagaattttgcagctttatgaaagagaatcacatttggtcatcaatgaattaaaatgaaatatctctctggaaggataaggaaaatcaacattcaaatataaaaatttaataataaaccaactaacatgttcaaggtttctctttttaaaaaagggcctacattattaatactataaaatttcaaaccagatattatagatcttaaaaaaattgtcattttttctttttttttttaattattatactttaagttctagggtacatgtgcacaacctgcaggtttgttacatatgtatacatgtgccatgttggtttgctgcacccattaactcgtcatttacattaggtatttttcctaatgctatccctccccctgccccccaaccccacaagaggccccggtgtgtgatgttccccttcctgtgtccgtgtgttctcattgttcaattcccacctatgagtgagaacatgcggtttttggttttctgtccttgaacattatcactttttctaatgggagaaaacaactgcattgttcatcctcttccaagtccataggctcaacaaagtcacttaaggttaggaagggggtagcacagggaaagaaactcccttaaaaaaataagtttcttttcttttttttccagagggagtcttgttctgtcacccaggctggagtgcagtggcacaatctcagctcactgcaacctccacctcccaggttcaagcaattctcctgggccagcctcctgagtagctgggattacaggcgtgtacaaccacacccggctaatttttgtattcttagtagagacagagtttcaccatgttggccaggctggtttcgaactcttgacctcatgatccgcccatctcggcctcccaaagtgctgggattacaggtgtgagccaccatgcccagccctattttcttttttaagcagagaaagaagcactgagacgttttcagctaagaaaacttagaagcattacccaaccccctaggaaatatactcaaaaactttgaaaagtactagaaatagttcaaaatgaggaaatgagagtgatttttttcactttttagaagcatttccaggtctccctcagttatcctaagattatctcagtccatacactgcctaattcttagatggcagaatgtttaaaaaacatgcagatatcttaaagcaagtgcgttcaaggaatagagagttaatgaaagtaaaattgattctggccaaaccaattgtagaactgagtgagcctgagtaagccactgaagaccaggaacccgtgtagtcatatgacgtataagataccctctattctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtattgtacttgcccctctactaagggtggtgctccaaccctcacactgatatgtcaactgcccataaccatgccccacctgagaattctttctttgccatatccttgttttccagcttttgtatatgcatccctacatttttagtcaagaagctggcagtcacatgctgtccatttgccaatgttggaaatgactgttggaattcaatggtttcccccaccactaagaaaaatgcttttcatttaattcataataacaacagtttgcatttatgttttttatctgtttcaaagcactcctctgccaccattaatgaactaaatcagcctttgctattttatgatctgtctcattaaaatggagttgattttctctgtggtagtcacttgcataatgttgttttcttctagcaaaccctgcacttaactaatgtaaattcatttttaaattgtgtgtttacacagaaaattttccccaaatatatttttaatgctgcatcctttcaacagcattacagggagtattttattctatatagacattttaaactataaagacacttaaatgctttaatgtagtcttctctaagtacttgtaaattatttataaagaccccctcaagtaaatgtgttgaaactgccagtggtagaaacagaaattgtttgctctgtgagccctattaatacttaattatttgtatagtattaaatgattggcttactgatgaactaaggcttaataagtgaacaagaaaacttgcagttggcaaagaaactctgaatgttaaatttattatggtttaactctgtctctgttactactggaccacttatacaagtgcctgatggctcattcctagggatttgatctaatgtgggaggaagatgtctctctgcaaataagtgcaggcacacacaagtttaggcagagatggtgttctagtgactctaggttgagaaactataaatattggttggttgccgcccaccttccatcctgccttcttttaggtagagacttctggcttctgcttgaggaaccaccctatcctactctagccttgtgcttagaataaaattgagcttacccccaattccaaaggtaggtctacctggccttcctaatgatttaaagatagacacataactcaacctagctcatcacattcttttagacacagggattaatatagaataagcatttcatctatgttagtccaatcagaatacacttaggacttgccctgggaattctggatgtagactgtcttttcccttgggtggtatagtgtgatgatataagacttgtagctggtgcagtcatttgcatccataagaggaaagcctagaatggctggaaagcaatggctgggaccttgctgatactgttggatttatgttagatagggaacagaccaaactgctgtaacaaagagattctaaaatacagggactgaaaaagataaaatttcctttttagattctttttttgtcttttgttttccttttagtggagaatggggtcttgctatattgcccaggcagatctcgaacttctgggctcaagctatcctcccacctctgcctccctaagagctgggactacaggagtgagccactgcaccctgctaaactttttattttccttacgtctctgtctatctacctcataactatatggctggccaagagtgataggcagtttggggtcatggggtcagttagggacccaggatcttcctatcttgttgttctgctgtcctgctagggtattgtcttcatgttgcaaagccagtgatgcttcaccaccctcccatcacagccttgtttcagttacaagaaaaaagaaaggaatagtggagggcaagaagcttcttctaatgcagggcttatcaatctaagctctattgacattttgggcctggtaattattttctgtttggggttgtcttgtatattgtatgtttagcagaatccctggcctctagtgcctaatgcctatagcatccctccctctctcctagtaatgacaatcaaaaatgtctcagacattgccagctgtctgggagggaaaacagccccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgatttttaggggacaattcaaaatctcttccacacagctgtacttttgaagctttctatcatattagccagtaagttacctttacaatttaaacaatttggaataggtttttcggtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaagagaaatatggtagaaacggaaaggccatggtcacaggagcccacggtcactgtagtagttaagaaaaaaggcaatataattatgctaaattaccaaaatgaaaactgcaggcatcttgcattatttggctttgaactgctactttctagttctcattgtaaatacaaaaagcgtttagtggctcccttatatctcacacaaaaggatcattgcttacagccagctgtttggcaattatatttctatgaagttagcataatttgagattagaactgcctgagaagaggggggtggtgataacattctagtgtattgaagtagggtatggaatagtgatggtggaagctctgattttagaagtgaatggcctttccaaagttcatctcgaagccaacagttctgaattcaaaacatattttgccataggaatcttatttttttaagttattagattagcacaggagtcctccaataccagaaaagaaagagacatgtactttacggtagtacagaagaaaatgctgcagggcaaaggaagatttgtctgaaggttcagactgaggaaatcattagtaaaatcttcagggaagtggtgacttttaaactaagctttagatgaggaaagagagaaagggcctttcagggtgaaggacggccagttcaaagacacagtatttaaaattctccatgaggaatagtaagtgcctaccatgagtacagcataaggtttatggagatatgacaataagttaggacggggctgtgaatgtatggtggagtttggatttttttagtccacaagccactaaagagttttaatgaggaggatagtatgatcaaatatagctttaataattacatgaagaatgctttgaaattgaggacattactgcaagagaattggatttctgatcttgagacatggcagtgggttagaaagagagaaatcaccagagaaacaacgtgaaggtaaattggcatgggaggtagagaagaaagaatcaaatatggctccaaatttttaggtctacgaggttggaatcatggcacaaggataggcttaaaaggaaaggaatgagctcagtaggtatctgtctgcaggataagagaagagttaaggtggtcatggccttatcgtatagcatatgggctacatttacatttctgcaaagcttgcccattggggtccctataattggagaaaaatcacttactgaattttgtacctagttccagtcttcctccaagtttactttatattatttgtttgggatatagctccacatgttgaaactgtgcctctaacaccagtgttggtgaagacattgcattccagtgccagattctgtggtcagaaattttgtttaacagaggtagcaataatattggaagcataggttgcattgtagagtgtctgagaaaaggggtgcagagaaaaatcctatcaaacatgtgttaaaataatgtcaaatctgatatactcataaaaacatgcccttgaacatcttggggcagaggaagggatgggagagaataaaggaggatcatctcatgctcaaagagagaaaaagaagagagcaaaggagagtttcgcaggaagggtactgtggaaacgccagcaaaggtgggatcaggaattatctggaaaagagagaatttctggggtgtcttttgatccacatcctacttccttatttctattccatccaggcagttgaagtcatcaaaccaaccaagcctttgtatagcatggtaggtgatggagaaggacagtaaaaggaacagtaaggaaacagaggcatatctcatatgccatatatgcctgtatatcatatatcatctcctcttactccctggccaaaaaaaagatggcagattcattgtatccaggatatactgatggaggcaagtaggatggaatgccatgcctgaaggactaggtggaggtgatagttcatgccacctagagctagatattggagcatcagggctagatcaacgtgctaggtactgattgctggaaggaacccttcagaaatgaaactcctaccaattaatatgagagatctatgtttcactcaaagtttatgccagaataggactaaatgaacaaaaaagaatggcaccaggccgcaggtgtctgccccatgaattgtattcagaaggggctgcccatttggcagagttgtagaattgctagttcatctttagagttgctcatagactggagctgatcaagtaattacaaaaccagtcaaacaaggtctatatcctcttccttgaaaatagctagtgagaccaaagtagtcatctggtcaccatgctaggatcctctgcttccctctcacatggcatagtcagtgttctaggtctccactgtcttggagctgaggaacaatttgatttgatttggtaagtcatatccccgtagctttaacacagtgacttcctattcctcattctgaataggaaagagtttggggtgcagggtagttttacagctaagtggaaaccagaaagaagaaaacagacagtatagagttttctcagagtagaaaggagtcacgagaaaaagtaagggaagaggtatggatattacctcactccaacaaccaatacatactaccacatctctaacaaaaataaacctcaagcctgagggattccttttctctaattcctcattttcagcagaataaggaaagtagatacttcaggcataatatgcctaagtgtatcaacattagctggcctcagaatctggaaagaagctcagtaaatcagttttgatttacactatcctacagcctcagtaataagattccacctggaactctgagtttaacttttcagctgtgtgtaatttgatctattgatgtcaggaacaggagcaaactgtacaggatgttgaatcagtttcccatctcacgctgcgagaccacctcatataggtggtaatgaaagaaatgttccctttgtcttttatctcatacatgatgacattcttcaaaatgaaccagttgtttagagcgggtatgcttctttccagaaataaattggtactgggatagcttggcttacttgtgcagcaaatgggaagactctttcccatttgctaatggtggttaccaattcagcaaagtgagttgaaggagagtctgattcacagatgctgacttagatgttagccctctcataaaaccatagtaataattaacaatgaaatgtgccagccacactttgaatcactttccatgtggtaactcaatttaattttaacaactttatgagctaggcattatcattttcactactttacagttgagggagttatgccacaaagaggtgaaataacttctccaagaccacacagctagaaaaaagcagagccaagatccaagttaggttggctctagagtctgtacttgtaaacactgtactaaattgtctctctgacatatcacaaagagcagcaggtttggagtcaggatagactggcttgaattctttaaaaaaaaaaaaaaatcagcctttctggctgggcacaatggctcacttctgtaatcccagcattttaagagtccaagacaggtggatcacctgaggtcaggagctcaagaccagcctggccaacatggtgaaaccccgtctctactaaaaatacaaaaattagctgggcatgtgcctgtaatcccagctacttgggaggctgaggagggagaatcgcttgaacctgggaggcagaggttgcagtgagccaagactgtgccactgcactccagcctgggtgaaagagcgagactccatctcaaaaaaagagagagagagactcaactacttttttaagataagttaaacaaaagaagtgaagtgtcccatgtcttgcatctatttcattggcaagaaggattatctaaatgacattgaagacggggtgtcagtatttagatgatgaaggtttccatgagttcttgttttggggaacagaatgaatccatacatgagttcctgttttggggaacagaatgaatccatacagttacagagatatagagtgcctagagacagtagcccaattttttggttgcaggtttcctatgctatttacatgtttcagaaaacctagtgaatgtttagatgctatgcatgttgtccagcagctgtactcaggaaaagcaagagcaacatttgtgagtttcattacatcttattttattatttccataaaattgtgttttattatgcaatcacaaggacttctaagccaccaagagactgacaaggatttcgctttgcagaacaacccctaaaacagaacaaattcaattatccagaggcctattttgtaggagaggtaatctttgctttagaatttttaaaattgtattcttaaagcacaaatgtgactcataggcaggtgtatttccatttagagaactcaaccagtagctgaggatataggagcaaggtctagatctcagaaaaagttacgaacaagctaagcaagagattagggatatcgctaaagggacccaagttcaggacgagacttcaatacagtgaaagaactagaagacacttagttccttggcaatcaagactggagaaaatggagactcaatctaagacttcagattgttgggctaagaagatgctcaaatgtgcccatcccaggtacataacatatagtctaggcttatcgaggcacaaaagctgataaagaaccctaagtttcttccagcttttgttttgactaagttgggaattttgcctgcaacgtaagtgctttggtacctgtatcagggtcaatctgcgaaggcaaagaccgagacttcccgtttatagcagttccaaacctgctccgctttcagccctgttttgttgttgttgttgttgttgttgctgctgctgctgttgttgttgttgttgtgagattctgcctctgttgcccaggctggagtgcagtggtgtgatcttggctcactgcaacctccgtctccctggttcaagcaattctcctgcctcacctttggagtagctgggatcacaggtgtgcaccaccacgcctggctaatttttgtatttttggtagagatggggtctcaccatgttagtcaggctggtctcaaactcctaacctcaggtgatctacctgcctcggcctcccaaagcgctgggattacaggtatgagccactgcacccagcccccaaccctctgttctcttttttatgtatcatgaaatagtagaatacatctgagtcatcagaactgacagcctctgcttacaaaagcaacagatcagcaggtcctaagttaacgctttgacctcaccgtctacctctcttccccctgccttcattgtttctcaaacatgcagaaggaggtgcaacttagggcctttgcaggtactgctccttctggctggtacaagcatcaccatacagccaaatgactggttctttcttgtctttcagttcttggctaaaatgttgccttctcaatgaggactttcctgatcaaccttttttaaattaccctattctccccaaggcattaataacatcatgtcagagctcttagcaaaatctgaaactatcttgttgggttttaatttgcttactgaaatggcagatgtgcaaggttttttcttatcacttattgtgttaaatgaatcaagatactcagagtgcttctcttgagaaaacctatgcctcacttaggttgacaaagtttcaacacatgaacacaggaggcatatatagtatatacatgtatttcatcagtcccaaagaacaactggcgacatgactagctttataaaattgcaaggcgttggatgggggagctagggaactttacaaaacacacaaggtctctgaaccaaaaatcaacattggctgtgaacagtaacatggattatcagtgacattttttgcttccatttacaactgtttacagtggatttttttttaactgaccaactctttagtttgtggagttggttttacatctctaggcctggtttttaaagatattcttaattttgatgaaaatcttcattatgatctcctggactggatgtaacatttaaaaaaatctcctaacaacatatatcctagtaatgcagtctctggggtagtgggaaaaagtcaggactgggagtcacaagacccaggctgaggccctaaataagttccacttattcaacaaaaattgaatatgtgccaggcactgttttagcaaattcaaatagtgaatatgacagacaaagtgtctgtcccttaggaattatgttctactggggatagggagagggtgataaaaatacccttttttcatctgcagttttctcttctaaaaataggtgggcattagactagatcatctggaaagtttctcctagctctacatgttccgagagagaggaaagaaaatttgaaaggcttcgcagtagttattttagggaagtaaaatcctagatttaaatttttttttctttttggtcatcattgctttctgatattttttctataatgaacatgcattacaatatgaaatgaaaaaatgtttaagaaaaacagtagagattttcctttcaaccgtgagcattggtttctagtgacctgaaggtacaacattcatccattagtaatgggagctgtaaatgggaattgtcttgcctctccagtgacttattaatctttgcctaatggggctttagggaacctgctcaggggatctttatgctccttttcccattacttcagtgtgtaccggtctcttctcttttcctcgaacacttgaagttcttctccacctaggaatatttaggctcagttggcctcatctcacccttcaaccttcacatctcagcttaaatgttaattccatagatgccttaacagagcaatctaaaacctaaattcccttcctactttactactcaccatatcatccttggtatttcctatattatctctattctgcttttctcttacagagcactcttgtcaacttgtagtttcatgtcttttgtttctatataaacttagtctattttcccccacagtctgaagtttcattgtgaagacagggatagtctgttgtgttgaggctatattcctagggcctaacagtgcctgtcacatcatagatactcaactaatattgatggagtaaatgaataaatgaatgaatgaaatggctcctttgtcctctctctgttaagtgttttattcccatacagtgttgtgctgcaggcaagccctttgccagctcacaagagtgaacggttaatttttcagggattttgcaagccaattgttaagcttagtggcttgacattggccttggttggggtatatatataccatagacatagggaaatgctgcatgttaagactttttattcccacaaagagctggtttaccagcatacctctactctcatcttctaaatcaaactataaatattgagctatcatgcaaaatcatgcccataggttatttaaaatatttcaataaaaaagtattgaatttaaaaaatattaaatacatgctatataattatttacctgtgggaaatagttcttttataagctaacttataatctaaaatatgtgtctctgatctcctaaagtttgtttcctgtttttcattcagatccttatgtgaagattcatctgatgcagaatggtaagaggctgaagaagaaaaagacaacaattaaaaagaacacacttaacccctactacaatgagtcattcagctttgaagtaccttttgaacaaatccaggtaatgtcaaacataactttgtcttcccactcaatttcattccttcagaccacataaattatacacacagaccttgtaagttatcagtgcacatgccttcattagaactgccattctttctccccatgcacatttgatgcttgagctacatcaggaaggataaaatatacagcacaggatgtgctgactcatcagcccaaaacagctggcactgtgttgagcagaaataaagtaggaaaaagaaaatcaacagaacaactctgctaactcaaaaagtgcatctataaaagttaaaaagcccagagaaaactatgagctttcactatttactcccaggccataaataagtctccccatgagatctttagagcaaaaaatagtgataagagaaatatttttggttgatgctaaatatgcagcatattgagtctttattaaaagatgattaacaatagaaaaattaggctaagttgtgttttcaattatttaaatccagcttcctgtgtctgagttggaatggatggctattttattaaaaatggagccttaatatgccagacaataattatgaagggaaatattctattaaatatccttgtagttaatatgttcatattaagttgctatatgtagccacaatgataacatgcaatcttatcatttaggggtttttgaaaatatttacattttctcaccccatctccatagttagcctataagaatctaaagataatatccaataattttgggccatttcttgcaaatctttaatgggcatcagagagtcaaactgcataaagcaacactatttttacattttattaaataattggcgcaggtgtatattttcagtgatacacaagtttgcccataacttgaaggaaaaacaaagagcagacatcaaacctacaacaaagaaccttctaaaggtccagaataacaaatactctttatttattttattttatttattttaattgccaaatagtagttgtacatattcatggggcacatagtaatgttttcatatatataatgtattgtaatcaaatcagagtagttagcatatttatcatctcaaacatttatcatttgtttgtcttgggaacagtcaatatcctacttgtagctatttgaaattatatcatatgttattgttaactatagccatcctgtagtggtacagaacactagaattcattcctcctatgtagctgtgattttatatccttaaacaaatctctccctaccttccccttcccagtctttagtatcctttgttctaccttttatttctatgatatcaacttttctttagcttccacatgagtaagaacatacagtgtttactttctgttcctggcttatttcacttaacataatgtctgccagttccatccattgccacaaatgacaggattcattcttttttatggccgaatagtattccattgtgtatatgtaccacattttatttatccattcatctgttgttggacacctaggttaattctgtatgttggctgttgtgaatagtgccataccactctttaatatgccaaatttgtgtcttcatttacctttaatcctattctttagaagacagtatcttatgaattaatcacagctttattcctagtagaaagctaatataatagctacacttatttaatatatataaaatatatattttatatatatatttaagtatagctatataatatatacatatataaaataagtatagctattatgttagctatcttcatggaaacattaatccatagacatatatatatatatatatatatatatatatatatatatatattatgcctaggtccaagttaaccactttatgtatgtaatctcatttcatacttagaagaactttatgagaaaagtactattgttattatcctaattttatatgtgaaaaaactgaggcttagaatttctttacatgtaaaataagaatgataacagtccttgtcaaagtgacattatgcatataaaagcacttggaacagcgcccaatacataggaacacacagtaaatggtcctgtcatcatcatcattattattcacatgctaatgtcctctctttttcaagttaacattttattagaaaatagatctaacaataagattaaatcagtatataaatcagtgctgtctaatagaactttgtgatgattgaaatattctatcatccatgctgtccaataatatgatagccacagctggccaatgagcacctcagtcactaatttgaccaaggaacgttatttaacttccatgtatttaaatttaaattgatatagctagatgtggctggtagctactctgtagtatagggcagtcttaaatgaccaaaaataaccaataactctaccatctttgtattggttgatagttttaaatacaacctttatcatataaattttcacatggtgtcaaattatacatacttatttactttcaacatctgttacataagtaaatgcagaggacactggttccctgttcccaataactttttcactagcctgaaccagcgggccccctgctttggacccactcacaaaccctcaagacatcaattttttccaacgatttattttgcaatatttattcagtgaacttttttgagttctaagaccttattcctatggaaactaacacctcctggcatttaatttttttaattccacaaaataaatataaagcaaggcattgagatgaaaactcccattgagctacaattctatgcctttaaaataaatatccttttcaactacaaactgcagaaaatgcaggtatattgaaagtgaagcacattaaaaataagacacatgctaggtttctggggcagcatttcagaggcaatagcgttttgtcaggacagacagaaactatgcccaatatagaatacattagacatggaaataatgagcattcctttgactgtatccctctttctctgctccttgagtcactttgttcttttttttttcctttttttataggaggcaacttttctagtcttcacctttttctagaaaaaaataattgagtatttcacatgctaaaatagggtcttaagtttgccttatcctgaggttataagacaatctgcctgtccttctgtctttctctatccctatgaaatgtattatgaaagaagcaaaatatgctaatttccaaatgcatgtgagaatgtaagcccttctcccccaaatgtagaaataaactacatatgcagctggaaacattaatccaaaggcttcacaaggatattttgtcttgaatgctactaatcaatgcattcctaagtggaataatcaaactctaaaaacttctgttacctttgtgtgtcatgtcccccaccccattcattacaatatgattgcttcctgataaatttgcttagaacaagctctaagaatcagtatagccctcttctttgttccagaaactatccagtggatagttaattcctttcacaatggaatcactccaagggaagattgtccgttttattgacaatgtgttgcatttcacattctaaattccacttgcagaagtgattgttttctctgctctgaagctgtatatcaatgacatttctcatttcattaatataataaaccagtctccagcatataaagtccactaaagggccctaactcagctggttcttaatctggccctagcttttataattacattttctgctactttcaactctggcaataaatgttacatattccatttattttaaactcttacctttacactcagctgctagattgaaaccatcacatattctgctaagtaaattcattacttaggaagtagaactgaaatttgcttttaaaaagtatatattttataccataatggtataggtttgctttcatcagttcaatcattcagaaaaggaagtcatcaaataaactttcaaaatctgatggaatcattgaataaatcccgtgtagcctaaactgatatttccatttgatatcaatgccagatacattgtagttactcagtaaatgtttactaagagaacgtatggatgagaaaaaaatatctttattactactttttaaccatacttttcactatactatcatgttttatgctcacaatcatatgattagttgaaattctatattaattctatattaatttttttgtaacatgctgtccccccacccttaaaatcagattattgcacatggttgccttgggaattgtaatcaaatagagtgggctgaacaccaatgccagaactttcactgataagacaactgaagcaaatgaatttagaggttagcacaagttgacacagactccatggcatggaggttcacagcataggctctgaaaaccaaacaactcattccttaaacaacctcagacaggttatataacttctcagagcttcaagcatccttacctgtataatggcaatattaataggatctattatgagaagtaactgagttcattcatgtaaaagacttagtgcaaagtatataataaaaattaacgtttgagtattaagattcaagtcattttcatcctcatcctagtgcttggagattgattcttctatttccaattctttagcgctcaaggacgctttatagtcgggccttatctctagagctagatgattcatattcatttcatggcttctttcagaaagtgcaggttgtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttgatgttgctgcgttcccactcttttccttgcctgactctggtggtaagccaatggcctattgactttgggggactcctggaagcagcagcagctaaacaaaactgcactgaatgccagcatctgagtcacatctgagtacagaatagctagagggaaaacaacacccgggagcatttggccatgaccgcgtggtgttcctgggcagtgtcattctcaacatgtgtttctctattcctgtgtgtcatcagttcatctggcgtactctgaggcttttcactttgcccagcatgtgtccttcagggttttcactccagaacccaagtcacacagcttctccagaatgggacggaaaacaaaactatttaaaccccagtttcagaggacagtatgacacattaaattctatgcctactacgatcgctatgggaaacaagtaaatacttttcctccactaaatttaacatttatcaagtgcctactgtactggacgctgaagcccacagtttcaggctgatgtaaatacgctatcccaatgcactgtgatgtgggcttaaaagtaagggtgttgggtccctgaggactttttttttttttttttttttttttttttttttgcggagtctcgctctgttgccaggctggagtgcagtggtgcgatctcggctcacggcaacctccacttcccggcttcaagcgattctcctgcttcagcctcccgagtagctgggattacagaagcccgccaccacgcctagctaatttttgtatttttagtagtgacagggtttcaccatgttggccaggatggtctccatctcctgacctcgtgatccacccatctcggcctcccaaagtgctgggattacaggcgtgaaccactgtgcccggcctatccctgaggacttttactggatcaatcgtagtagataccatggtgtatcaccatgatcccccttcagcagagaggtactcttgctgcagctgctggaagtggtgcttgctgacagctgacagctgtgttcctctgcgctctacagaaggaagctgtctcaccta

SEQ ID NO: 14274 - DNA, 15251 bp, Human
aggacgcgttttgcattcaggaaaaaccaatcgctcccctatcgtacataaccaagagaaaaggtggcggacgaggggcgtggcaaagtgattagtgcggcctggaccctgcgtgccttgcgcgctgcgggctctttgcgtctgcgtagttcgctcacctccctttctaactccgctgccgccatggctcctgtggttagtatggctccgcgtgaggcctcggctccaggggaggcacgtgggcctcgccgagcccggcatctacccaggctcgctggggacggcgccctgcagcgtcctgctggggtgggctggcaggtcggccggagcgggccagagcccctgccgatcccagcacgttgtaggcggaggaggccgcggcccgaggctcgtgagggagatccgggaggtctcggaggcccggggccccagctaggggctagcggggagctggagcctggagactgcggtctgggccggccactggtcctcggaccccggccgggggcctgattacctgggtggagggcggggaagaagaacgggacctgctaccctggggagccgcgcattcggaagtccacggccaagactcggggacgaatccgcggaagggcggcttggtcggcgtgctttcggagaggaggcctgggtttgaggagctttttagcgtccccagaggaaattagtttatcagggcgcactgtacagacccaaacgggtgttgcagtggtgtagggagaaggctctcattgcattctcctttagctatgctgggactgggctgtgcggcgccctcctcctaggttatttgagaaagttgtttttccgtgttcttcgtcccaagatcctacttttcctcttttgttgggactccctggttaacatttccggttcttctgctctttctgtctggttgggcttttgaatgccttttggtttaaaaccttgatggagaagtatcaagcccgttgtgggtaggtctcttgattgattgtgtgtgttcggaatagatcttaaagtacccctcttagattattactgcgaagagacgttgtaaaaaataaatcagtgatttttgtagtggccaaatgtttgaaaagttgatccagttaacacaagttttagatgaagttcttttaaacatgaagggaggtaagatgtgtttttggaaaagtctatttagttctgcagagcttttaaacgtgaaagtacaggttggtacgatgcacaagtgcattaatggtgtcaagtttgtagagagataagattaacacaagcttcttcgtaagagtgaagaaactggaaccttgtaggatgtgctttgccgggtggtttggaagtactaatgcatagatgaagcgaatcaaaatgtcagaagttcttgacggtagtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttagaaaaagcttgtggtgaaggggggcaaaaaaaagaagcaagttctgaagttcactcttgattgcacccaccctgtagaagatggaatcatggatgctgccaattttgtaagttacatccttattgccactcgggtggtcacgaacattttgagatactgttgagaaaacctactggggtacatttctgttttcaggcttataggcagcttcacaggtctggctgtatcatctcaccctgggaatgtgggcagattacttgtttgtttccaagtcttgtttcttcttgtgtgtgcaacagttgtgaggagtaaaaggagatgggcttagaataagcaagaagggctctagcacagaggtgttagaggactatcttgtttttctcctttagtttccacaaatgattttacttaaaagttacccagaaacaagccaggcacggtggctcacgcccgtaatcccaacactttaggaggctgaggcgggcagatcatgaggtcaggagttcgagaccagtctggccaacatagtgaaaccccgtctccactaaaaatacaaaaaaattagctgggtgtggtggtgtgcacctgtaatcccagctactcgggaggctgcagtagaagaatcgcgtgaacacgggaggcggaggtggcagtgagcagagatcgcaccattgcactccatcctgggagatagtgcgagactccgtctcaaaaacaaaacaaaaaaagttactgagaaacagacaaatttcactgggtccatggcatcccccttgctgtttggtgtgtttaagcataagtgagggaccctgatcctgactatgggctgcctctgtcctgggtctcactgctttgatgtggagctttggacaggtggcagcagttcccgaagcttttctatattatgaagcatctgagcttcagtgtttaaagtaccctgcttgctgaattgtaattggagcttttttttttttcttcagatcttgctctgtgctgattttttgcccctgtatttggcccattccccaatattcctctatcctattgcaatctagaaatattaaataatccttccgccacattttgactcagcagtttggttttgacattttattctttttcctctaatagccatgtttgggggattcagacttcgtatttgtgtgtagaagtctcctaaatttgcatttgctctaaattctccagaaggttgaactattgccaggatcagtatcattacaacaaaaataatttttaaacacaaaataattatggtcacgaattatccagaatggaatttaggtaacctcttatagtttattgcctttatgtagatgctgtttgcatctgtgtccttcaagaaatcccctatttccttagttctttctctatccagtgacttctggcttttctgtggcctcctctttttcaactttggtgtcttccagtttggtattcacatggtggccctgttctggcattattcctgcctccctccctctgagccattccctcagcccactcatctgtttgtgtgattgtctttccttctggaagcctccttaggatagaaaacttaagtcatttatgaatcttgagatgcagaattcaagatttctgacctaatcactctgtgccccatctatggttaatgtatactttttgtttattttattttatttactttgttttttgagaccaagttttgctcttgttgcccaggctggagtgcaatggtgcagtctcggctcaccacaatctccgtttccctggttcaagccattctggtgtctcagcctcccgagtagctgggattataggcgcctgccaccacgcctggctaatttttgtattattagtagagatggggttcctccatgttggtcaggctggtctcgaacccctgactttaggtgatccacccacctcggcctcccaaagtgctgggattacaggcatgagccactgcgcctggccattttattttatttttatttatttatttttgaggtggaatctcactctgtcacccaggctggagtgcaatggtgtgatcttggctcactgcaacctccaccttccaggtttaagtgattctctttctcagcctcccgagtagctgagattacaggcgtgtgccaccatgcccacctaatttgtgtatttttgtggtagagacggcgcttcaccatgttggccaggttggtcttgaactcctgacctcaggtgatttgccagcctcggcctcccaaagtatcgggattacaagcatgaaccgctgtgcccagccaaattttttttttttttttttgagacggagtcttgctctttgtcacccaggctggagtgcagtggtgtgatctcggctcactgcaagctccgcctcccatgttcatgccattctcctgcctcagcctcccgaatagctgggactacaggtgtctgtcactatgcccggctaattttttgtatttttagtagagacagagtttcaccgtgttagccaggatggtctcaatctcctgcctttgtgatccgcctgcctcgggctcccaaagtgttgggattacaggcgtgagccaccgcgcctggccccaaatttttatttatttatttattttgagacggagtcttgctctgttgcccaggctggaatgcagtggcacgatcttggctcactgtaagctccgcctaccgtgttcatgccattctcctgcctcagcctcccaagtagctgggaaacaggcgcccgccaccacgcctggctaattttctgtatttttagtagaaacagggtttcaccatgttagccaggatggtctcgatctcctgacctcgtgatctgcccacctcagtctcccaaatttttattttttgagaaagggtctgttgtccaggctggagggcagtagcatgatcctggctcactgcagcctcaacctcataggcccaagtgatcctcccacctcagcctctggaatagctggcaccacaggcatgcaccaccatacctagctaatttttaaatttttttgtagaggaagggtcttcctaagttgcccaggctcgtcttgaactcctgggcttgagcaatcttcctgccttggcttcccaaagtgccgggattacaggtgtgagctactgcacccagccagttaacatattttgtattggagtttttaaacagaaaattataggaattttgagctgaaagggacttcatgtcattgccatagcaagaaaacaactaaaaaggtcctttttgggcaaagctttctgaagcacaaggaggtgaatgtcttgctgaggcccacacagtagtttgcagagaatatctcaggctcctgagtggctgctgcttctgctgtaccacacatggccctggaccaggtctagaattgtttcagtccctatgtctttgctctttctactaggttgaaggcttattttctgatagtgctgtgaacagtgttttatactccttagattcagaagttgcttttagctttggttgcatgtaccttgtaaaagtttgttttatttatttattttttgagacagggtctctctgtcccccaggctggagtgcagtggtgtgatctcggctcactgcaacctccgcctcctgggctcaagggattctcctgtctcagcctcctgagtagctgggactacaggcacatgccaccacacccggctaatatttgtattttttgtagagagagggtttcgccatgttgcctagcctggtctcaaattcctgagctcaggagatccacccacctcagcctctcaaagtgctgggattacaggcgtatcttgtaaaagtctggccttgggtttcctgtctagtgttgtccttctaagcctttcgtggcgaggcccagtcggccttgtgtggaagtagtcaagtacgtttacactgggatgttgtctcatagtatgtatgtaaatgggatttgttaccatttttaaaaaagactgaacatttaagaaaccgatattagggccaggtatgctggctcacacctgtaatccccacgctttgggaggctgaggtgggaggatcacttgagcccaggaatttgagaccaatctagccaacatagagagaccccttctcttaaaaatgttaagccaggcgcagtggctcacgcctgtaatcccagcactttgggaggcagaggtggacgaatcacctgaagtcgggagttggagaccagcatgaccaacgtggagaaaccccgtctctactaaaaatacaaaattagctgggcctggtggcgaatgcctgtaatcccagctacttgggaggcggagcaggagaatcacttgaacctgggaggcggaggttgcagtgagccgagatcgcgccattgcactccagcctgggcaacaagagctaaactccatctcaaaaaaaaaaaaaaaaaattgtaaagtcagctggggccaggtgggatggctcatgcccgtaatcctagcactttgagaggctgaggtgggaggatcacttgagtctgggaggtcgagacttgagcttgggaggttgagactgcagtgagctgtgattgcgctggtgagactctgtctccaaaaccaaaacaaaaaatgatattagttcagtgttgggagacagataaaatattctgttgagacagatgaacttgtcacttcattggtcaatttaatgatttctacaggagcagtttttgcaagaaaggatcaaagtgaacggaaaagctgggaaccttggtggaggggtggtgaccatcgaaaggagcaagagcaagatcaccgtgacatccgaggtgcctttctccaaaaggtacaggagggaagtgtgtgtgtggcctgcgtgcacccagtgcccagcccgccttttccctgcatgggagtgggggcacccgcagagtgattggtttgcatctgttaatttctggaactatgctcagtgcaggaggcagtggatgaatgctattatggttgttaacaatagtcaacttttggtggttttaaaattttgtctttcacaggctaaagtgttttatttttttttgagctggagtctcactccatcgcccaggctgttgtgcaatggcgcgatctcggctcactgcagcctccgcctcctgggttcaagcagttgtcctgcctcagcctcctgagtagctgagactacaggcacctgccaccatgcccggataatttttgtatttttagtagaaacgggggtttcaccatgttggccaggctgctctcaaattcctcccctcaagtgatccacccgccttggcttcccaaagtgctgggattataggcctgagccaccatgcccggccaggctaaagtattttaaacagtaaggtactcagacttgctttcaagactgttttctcaaaaatattcttggctgggcacagtggcttatgcttgtaatcccagcactttgggagggtgatacaggagtattgcttgagcccaggagtttgagaccagcctgggcaacatagtgagacccccatctctacaagagttaaaattagctgggcatggtgacatgtgcctgtagtccagccacttggggagctgaagtgggaggatggcttgagcccagcaggttagggttgtaatgagctgtgattgtgccactgcaggccagcctgggtgacacagtgagaccctatctcaattaaaaaaaaaaaaattgcctcctgtctctagatcacagtaagagcttactttttttttttttttttgaaaccgagtcttgctctgttgcccaggctggagtgcagtggcgccatcttggctcactgcaacctctgcctcccaggttcaagcgattctcctgcctcagcttcccgagtttttggaattgcaggcatgtgccaccacgcctggctaatttttcgtatttttagtagagacagagttttgccatgttggccaggctggtctcgaactcttaacttcaggtgattcgtctgcctcagcctcccaaagtacaaggattataggcatgagccactgcgcctggcccacacccagctaattcttgtatttctttttttttttttttggagacagagtctcgctttgttgcccaggctggagtgcagtggcgagatctcggctcactgcaagctctgcctcccgggttcacgccattctcctgcctcagcctcccgagtagctgggactacaggcgcctgccactgcgcctggctaattttttttttttttgtatttttagtagagacggggtttcaccgtgttagccaggatggtctcgatctcctgacctcgtgatccgcccgcctcggcctcccagagtgctgggattacaggcgtgagccactgcgcccggcctcttttttttttttttttttttttttgagacggagtctcactctgtcacccaggctggagtgcagtggcgtgatcttggctcactgcaacctccggcttctgggttcaagcgattctcctacctcagcctcctgagtagctgggattacaggtgtctgccaccactcgtggctaattttttttgttttttagtagagacagggtttcaccatgttggccaggctggtctcgatctcctgacctcgtaatccacccactttggcctcccaaagtgctgggattacaggcgtgagccaccgcgcccggcctaattattgtatttttagtagatacggggtttcgccgtgttggccagactggtcttgaactcctgacctcaggtgatccacctgccttggcctcccaaaagtgctgggattacaggcatgaaccactgtgtctgaccaagagctttccttttgaattccagttgtttcccttgtaagtgctactttggcactgaacaaggaatctgaagacctcagtttagacagagtccactctagttaattcctgggggcccattttctttcatttcaaaatggagacattaatttgctagttccctcctctgttatgtgttggtttttgaggatgaggttaaaatactttaccagttgctgaagaattggatatgcatatactcagctcctagcctggggctgtggcctgttaggagcttttaatcatactaaatcccagcactttgggaggccgaggtcagaggatcacctgaggtcaggagttctagaccagctgaccaacatggagaaactccgtttctactaaaaatacaaaattagctgggtgtggtggtgcatgcctgtaatcccagctactgggtaggctgaggcaggagaattgcttgaaccagggaggcggaggttgcggtgagccaagatagcaccattgcactccagcctgggcaacaagagcgaaactctgtctcaaaaaaaacaaacaaaagaaaaccaacatactaaatcaagtggtgggaaattttaaggtatgttagtacaaattggttgtagttaatgcttttatgtttagctatgtccgtgaagaagagactttgaagcttaagtgaagtcctcacagtctgcctgggaagcagtgagaatggggcttctggtgggggtacaaagcgtccggcctgctgggctgtagcagagcccttggggaagattctgctacctttctgtgacctgtttaccagggtgagggtatctcctgacatgcgtcacttgcgttttcacaaactttctgttctttatccagtggagtagggaaggtgccttaatcatctattacagctttcctttcttgatgataatagttaattttcctgaaaggttcaaggtgtcccgaatctagaactttttctgtctctgaatttgtacagggtttttatttatttatatttttgaaaacgagttttgatcttcttgtctaggctggagtgcaatggcgcgatttcagctcactgaaacctccgcctcccaggttcaagcaattctcctgcctcagcctcctgagtagctgggattacaggcgcctgccaccacgcccggttaattttttgtatttttagtagagagggggtttcatcatgttggccaggctggtctggaactcctgacctcaggtgatccacccgcctcggcctcccaaagtgctgggattacaggcatgaggcaccctgcctggcctgtacagggttttttttttttttttaacctgatttttttccccagtgtactattagggatttttttttttccttttttttagatagggtcttactctgtcaccaaggctggagagcagtggggtgatcatagctcactctagcctccatctcctggctcaaacagtcctacctcagcctcccaaatagctgggactacacgagtgccccaccatgtccggctatgtcagggaacatttcaaccacctgaaattttgaattaacctcatctgaatacaatatggtggaaataattgacaaaagtatactttttagatggaatgaccaaattgatttatctttgcttagcaaaaagtggacagttgaattgagatcttcacactttgtggcgattgctttgttggtgtggagattgctttgttggtgtggagattgctttgttggtgtggagattgctttgttggtgtggagcactgtcacagtgctccttttttggagatggtgagtctgttggttcatgacatttgggtcctgtgaatatgccagggatccatgctgagcgcggtggctcacgcctgtaatcccagcactttgggaggcccagacgggtggatgacctgaggtcgggagttccagaccagcctgaccaacatggagaaaccccgtctcttactaaaaatacaaaattagctgggcgtggtggcacatgcctgtaatcccagctactcgggaggctgaggcaggagaattgcttgaacccgggagacggaggttgaggtgagccggagatcgtgccattccagcctgggcaacaagagcgaaactccgtctcaaaaaaaaaaaaaatgccagggatctctctgagcatctcatgtaatccttgctatggtctgaagagatggttagtagcagggatcccctttcactgtgggagaaacagcttgggtagatgaattggctctgctgtgggtttgtgtgttgtgaaattccctctttatggcttgggaagattcggaatagcctcagggccacggaagcaagccggtgagagagctgccaagactgtggtgcacttcatcttttttttttttaattaaaaaaaaaaatgttgtgtagagacagggtcttgctatgttgcctaggctggtctcgaactcctagattcaagggatcctctcaccttggcctcacaaagtgttgggattacaggcgtgagccactgtgcccagcccttaggtcatctttatgtagttagggtgttgggcacaaaagccagtttttgcctttccataaagaatgagtgttttggctggtcgcagtggctcacagctataatcccagcacttcgggaggctgaggtgggcagacacttgaggccaggagttcgagaccagactggccaatatggcaaaacccccatctctactgaaattacaaaaattagctggacatggtgttatacacctgtaatcccagctacatgggagactgaggcatgagaattgcttgaatcctggaggcagaggttgcagtgagcctgggccacagaaggagattctgtctaaaaaaataaataaaagagtttttaaatgatccctgttgtggtgagtgtttagctctcacctggctaaagcagcaattgggcaggctgactgaaaggctttgtgctctctgggcgtgagcgcagtggcagggtggcattctgtccctgtgtgttgggtggtgagcaggagcgagtgtgtgcacacccctaagaagcagtcctcatcatccagacaacctcaaaagggggtttgactccgtgaggtgatgtgtgcgcagcgcttacagctctttggaaacccactattttctgcataaaaggtattgaggttgcgtacttaactgtaaatttctatcatgttatctttctccagtggtcactaaaaaccatgttataggtgtttgctgcattttcatggacaactggtacatctacttatctacttatctgctcttgttttttttttttgtttttttttttttgagatggagtcttgctctgtcgcccaggctggagtgcaatggcgccatctcggctcactgcagcctctgcctcccgggttcaagcgattctcttacctcagcctcctgactagctgggactacaggcgcccagcacgacgtctggctaattttttgtatttttagtagagatagggttgcatcgtgttagccaggatggtctccgtttcctgacctcatgatccgcctgcctcagccctccaaaatgctgggattacaggtgtgagccagtgcccctggcctagttttttttcttttttctttttttggaggcagtcttgctctgtcacccaggctggaatacagtggtacaatcttagctcactacaccctccgcctcctggattcaagggatcctcatgcctcagcctcccgagtagctgggattacaggcgtgcaccaccacgcccagctaatttttttatttttagtagagatggggtttcaccatgttgttcaggctggtctcgaactcctgacctcaagtgatctgcctgccttggcctcccaaagcgctgggattacaggcctgagccaccatgctgaggctattctaattgttactgccgatgtcgatggtacgtggctgataactcagagccttggctgggtgtatttgccttacctttgccatttttgaggcttgggaaaacaccttgaattgtaatgattttgagtgctgggttttataaatgttaaaatgttttagaatgcaagcaccaactgtctagtggagttcttgtgtcctttctctgcaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtacgaggctttgttttttttaaggactggcatgtgaagaaaagctttgtcctcacgaattagttgctgtaccaacagttacgttggtctttattaggcttagaagaaaagatgtcctttatttccacttttcttcccttagttgtgctgttttgccgcagtgagattcaggggttggctgtcactgaactctgtgtagaatttctccagatccagagcctggggatcaactttgccagcaaatgccgttttctgatggggaataggtagtgtgaacttgaattccatcacaaccatgacaccagctgcgcccaaagcacactgtagaccagtttcctttgttttgactcacacctcacttgcctgatcgaaaatagttgaggcacaggggctgactggggtcgtggagagtttcaagccgtgatttaagttcataagagtccggaaacaggaggttggtctcgtctcagccaatgccagttacacaacaccttcacgcccttccctcgagtgtgct

SEQ ID NO: 14275 - DNA, 17455 bp, Human
ggctggaaccatatcttatttttttaaattaaaaagtagtacatcctcacaatagaaaacttttcaaatacagaactatataaatgaaaagtgaaagtcccttttctgtctgctcctatttgcaatctccctcctctccccacagaagaccactattaacaatgtgttgtatacccttccagaactttccatttgctagcctaatagtgctaataaaagtgttaacagttattgagtgtttactaagagtcaagtgctatgctcagcatttttatgcacgttcccaattaattcacaaaacaagcctatgaagtaggtgttatttttgttcccatttcacaaaagaagagactaaggtgacagttactaaatggtaaagccagaatctgaacatggccaggctgaattcagagctcctgcccttgaacttgttctctcacttgcttccggaccttgcaatatcatagacacttccccatagtgacctaaaaatggtttctccctttttaaaagttgcttggtattctacaaaatgaatgtattccattcattttgccattctcctactgaacaacttttaggattttgtagtttttcatttccttatttcaccaagtgtaagattccattattgtaaaaagcatccagtttcagaaattaaaatatatgggggcatggggggtgacaagtgcatcttagaatatatttttgcatgtaaatattttgtagataatgcttgtaaataattttcatgtgtgtatttctgcacaagtttcctaggagtaaaattgtgtgtcaaaatgaaggtgcatttttaaattttgatgcatactgctgaattccccccaggaaaccttatcttagtcatcttgtgttcctcatttccttagcacaatgtctggtacttttttaggtactaaataaatgttcagtgggtgaaatgcatgacctgacccggcaaatgcaaagtattttgagatattcacacaccaaaaaacccacaaaatatgacaatgactgacaatgagaagatgagaatattttactaccgtatttgtatgcacttcttgttgaagcactgaccagagtaaatgacaaacgctaatgcatcttatgcagaaggatgtttccgaagtgattacaagatatcttgcaaaattacctatcaaaagattgcacactcaataaaaatacacgaataactccagcattttacaacccccaacctactagacataagaaatttccagagatcttatggtctgccattttttcaaatacctgcaagactgcctgcacccccgaccctaatctgtagaaatcatgattctgcaggtctgcagtgggggatgcatttaacaagcgctccaggttaacctaatgcactgtaaagcgtgagaacacgtgcattaaaagggctttaagaagtggagtttctgaatcagatttgcattttagaaagatccctctggctgcagagtgtagaatcaactataagtgagcaaagatagctaaatggcattattcagcccagcgcatgaacggctcagattgcccgcgcgctggggtgccccctgccggccctcggcagcgcctcgtcctgggcctggccctgggcggccggctgctgactgcgactgcgcgctccgaggcctgcagagacggcccggggcacctgttaccgcaccgctcaagaccggaagcggaaatggaatcgagatagcctcgcgcgtttagccggccgccgccacctccacgccctaggccgggccgacttacggagtcgccggaagcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggtgcgagcggtgtggaggaacccgattccccttgactaatgttgaggagaggaaccctccactagattcccgtcacatcctttcgaaaaacaccagaacggagagggaggtggtacattacccggtgcacttaaaagccagatggtcctgtaagagttctcttagcggtccaagaacctgtgtctaattaccaatatgagaaagtcaccctgagggaggaggtgctcacttggtttaacatcattaaggagaaagcagctctgggacagagtttcaaattcttaattaattcagagtcgagctaacagtaattgagccccagcttctgcttttctcttaggtgtaattaattgcactgctttgagacaaattccctcacctttacacaaactggagcttttgtaaaagttagtttgggaatttatccattttggaggcaaaccaggtacatatacaagctgaaagtagagcggaacagctgacggcagttgccagaggtgtttagttctgcccaacacttttgattcaccctacttattttttaaaagacggtggtctcactaattagccgggcgtggtggcgggcgcctgtggtcccagctactcgggaggctgaggcaggagaatggcgtgaacccgggaggcgcagcttgcagtgagccgaggtcgcgccactgcactccagcctgggcgacagagctagacttcgtctcaaaaaaaaaatataaataaaaataaaaaagacggtggtctcacaatgttctccaggctggtctcgaactcccgggttcaagcaatctttatgccttggcctcccaaagtgctgggatcgcaggcgtgagctacggtgctggccggttcagcctacttttttttttttttgagaccgagtctcgctctgtcgcccaggctggagtgcagtggcgcgatctcggctcactgcaagctccgcctcctaggttcacgccattctcctgcctcagcctcccgagtagctgggacgacaggcacccgccaccacgcccggctaattttttatatttttagtagagacggggtttcaccgtgttagccaggatggtctccatctcctgacctcaggagatccgcctgcctcggcctcccaaagtgctgggattacaggcgtgagccactgaacccaccctacttattttttttttttccttctttgagatggagtctcactctgttgcccaggctggagggcagtagcacaatctcggggcactgcaaccttcgtctcccggactcaaaccatcctgcctcagcctcccgagtagctgggactacaggcgtgtgccaccatgcctggctaattttgtgtatttttggtagaggtggggtttcgccatgttgcccaggttggtcttgaactcctgacctcaagtgatccgcccgcctgggccgcccaaagtgctgcgattacaggcatgagccaccactcccggcctcaccctgcttttttttaaagcgtacatagaaaagtctttcagcttctagaggtcagtgggcggtgagggtctgtctgaaggaggcagccagcagctactgaacttctctctagtgttgtttaaatatgacttaatcgtgcttaagcaggccagtgcaaacatttttcttcctgctgcagcctgtttaaattcaaaaactcaggtgacttaactcctgcttcaaccacactcctgttaaccaccttcatatggtggatatttccagccgcagggctcagtccaaggacacttagtgattctggcagctggtatttatgtgttatgtccaaaaggaactaattgtttcaaggaacaaagtaggtttaggaaagataaagctgccctctgcccaacataccctgttagtatccaatttcatgttaatcatcatccatttaattgcttggcagctcattccatctgtgtttgtcctcatgttgagcgaggtgatcacatctcacaccttcttttggatcttagttttgagcctgactacaaagaggctgcttttatgtggccctacaacctgtggtttgaacttgctctctgaatttgttgcattcttgaagagctgtgtgcaaagtgaactttagaatcatgtttctctaatgacttgacgtcctttccccaggaggtaattttggtccctggtcccaagaaggctatttaagacaccaaaggaatcaaaactactttcttcagaagtatttgttctgttactattccaaaactcctccaggaaatgttgagcacacacatcatctatggggaatgatttcaagcagcgtccattctcacttcattagaagttactgaaatccccagataccaaaaaagtcgtgaattcttttaactacactagggtgctattttggtcataattagttatccttagtgtgaagtgattccagtctgttatttaatatgtagatcttgttagaattcaaagaatacaggcatcatttggataagctgaggtcggtatttgagatgaaggtgctagaagcctgcttaactccctgaagagtcttttccagcctgaaccttctgctctttttaagtctttggcttctgactgggaaaaaatctaaaaggtgcatgactacatatgtcatccagatagatttggatgagtttatttcttattctggaatacctcagttatacggagcttaccacactggaggttatcatttatcctaatgagggttcagtctttgtcttgctttattccccagtccctagacagaactttgtgagtagtttttcccttcctcaaaatctggatttgcctattttcaagttgacagctctagaattgttcctcttaaattttcatgtacagtcatacatcacttaatgacagggacatattctgagaaatacatcattaggtgattttatcattgtgtgaacatcatagagtgtacttacacaaacctagtctgttctcatgctactatgtagaaatacccgagactgggtaatttataaagaaaagaggtttaattgactcagttccgcatggctggggaggccttaggaaacttacaatcatggtaaaaggcacctcttcacaggacggcagaagagaatgagagcaagcaggggaaatgccagatgcttataaaaccatcagatctcatgagactcactcactgtcagagaacagcatggggaaaccgcccccatgatcgatacctccacctggtcctgcccttgacacgtggggattatggggattacaattcaaggtgagatttgggtggggacgcagagccaaaccgtatcacctagtctatatggtgtaacctgttgcttatggactataaacctgtacagcatgttattctactgaatactgtagacacttattccacaagtatatttaaggatttgtgtacttaaatgtatctaaacatagaaaagataacaataaaaatatggtataatcttatgggactaccatatacacagtccgtcgttgactaagacatcatgcacatgactgtacttcaaatcttgcttgattaagggaggaacatgacattaagctagtcttggattcgtagtagccccttccaagtgtgtttcatagcttcttctagaattttgatgtcaacttctttaatgacaacaatagctaataattagcactcactgtgtcagacactatatagagcacttacatggactgtctcagtcttcacaaccttaaaaaatatatttctattttgcaggcaaggaaactgaggcaccactagtaagtttccgatcctaaccatgaaccaagatagtaacagctgcgtctttagaatgaattgtcaatattgtctgttgtagggagctcgcttatggctttctgagtaaactgctctgcttctaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaaggtaattgcctggggagtgttcacatatttgtcttaacataaattctcttctttctaaaacatctctgagagagaacagaaaatggatgtttctataaaatggatgcctagtggaaaaataattttgcttaataagtcttaaggttcaaatgttaaaccttggtggtctctaggtttagagtacagaagaaagagaatatttctgtgtcacagacatctttcacttcagatcctcagctatctgttcggtcaggacttttccacagaaacacaaaaatctgtcttaatgcagtaagggagcactgggctggaatcttagaaacccacatttgagcccacattggccatgctgtcagtcacctaacgttagttaacctgagcctcagcgttcgtttctgtaaagagggaatattggaccagatcatctctgaggtttcatctaactttgactctgcgtaatactttgtttgaaaagtacatgttggctgggcatgggggctcatgcctatgatctcagcacttttgggggctgaggcaggaggattgcttgaggctaggagttcaagaccagcctgggcaacatagtgagacccccatctctacaaaaaaattaaaaattagctggacatggtggtgcacacctgtatccccagctactcgggaggctgagatgggaggattgtttgagcctgagaggtcagtgctgtagtgagcagtggttgcaccactgcactccagcctgggcaacagagcaagactttgtctccaaaaagaaaagaaaaatacatgctatgtaggtgtcattagcaaggattatagtaagacattttatcaggaaccccagcatggacttctgtcttaagttgtcagtgagagaacacctttagtgagtattcttgataaaatgagggagaaagtgtcaggcctattgtcaggggctgcctgctttccagcgtttccattggagaaggagggagccactcagcacagcagtcacaggtcagttcaagccaggggacaaaacaacccagtgaaggggctcttccggagtttggtttttcagtcattaggcaagtttctttagagaacatttgagcttcctattcaattgatcccttctcctgcccaaggcaaagtgacaaagggtaaaacgaggcagcttctgtttatcttgtgttgtcatcctccttggcatccaggagccttgcgagcttgagacgcacaaatgcctgactgttgaccttttaacattagggatgtggtttcctggtatttgagtaaggtgagttttcaggaaactgtgtcgcactgctgcttccttatagccttttcagattgaggtcattatgctgaattgtctaaatgggctaaaaatgtttgttctcctgcagctgaactcttggttttatgtggaaacgttttgttctgtagctggtttggcaagtaagctcggggggcagcccaccccacggaagtcctctgcttcctttttccttgcagccacaataactttgtagccatcctggatctgccggaaggagagcatcagtacaagttctttgtggatggtcagtggacgcacgacccttccgaggtactcttcctcccacctctggtcctctgggtgcccgcacattccaaacaaatcaccttcccaagagattgccgctaggtccctttgcccagctagtaaaagtccccgtgtgtggcagagctgagtagcagcactacctgtcagacagttggcatacttgaccaagatgagcagggtggctagccaggagatgaggccttccagccaggaattccaagtcctctgaagaataactccgcagaccttccacgttatgatttctgcctatctgtctcttcccagcccatagtaaccagccagcttggcacagttaacaacatcattcaagtgaagaaaactgactttgaagtatttgatgctttaatggtggattcccaaaagtgctccgatgtgtctggtatgaacacagttattttataccacatgcgtgcaggtgggggctgtacagtctagacatactcttgtttctcttgcctctcttgagctgaagctgcccagtcagataggcatttatagcccccacttaaaggccacagaacttaattcctgtcaggttgttgaaatttagccctaagggagctacaagtcatttccctggtcatctcaggtattcagtaggtctgcttggccacagaacgcagacagcagaaatggaaccatagcttgatctcgtgccaagggcagggctgaagaggccctggagggtggcactgagtcagtgacagcccagcactggggaagcctgtgtctcatcccacttgtggtgcctgaagaatttcagcctgacaggtgtaaatggacacctcagtgaccttagcagtcacttatgtggtacattagcaccttgtcagaatccctttggggaggatgcggctccccacgggaaacagcctgcacagcccaactctccttgatgggaagctatttggtacagaaatacagacccagtaaaacttctccatcttgtaagagcctttcaggcatcgaggtttcaataaattgctttccctccaagccccacaggaagaaactacctggaacatgattcatacagttcgggggaagagggttgcgatctaaagtgttccccttcttggaggcgggggcttaacaattcctggactctgagggaggcagtggaaagatgccctggcagaatatctggcgccctaagaaaacagattccgttcgttgacaggagagttcttcatcattgtctagttaggcctggaagttctgccaccaggatttcttgttaccagttcagaaatcacagtggtaaaatgatcacaatgggctcactgtggttgacagtttgttgagcaggacttggaaatccgaaatctgtgcttttatctgggtaattagtcttttagagatatcatctagtttttttgcagatagttgagaatcagggaatggaggaagtgtgcccaaatatcctccaaaatatataacttactgatacatgtaattttaagccacttacaagctttttagtcaaatttccacctagggaaaggaaacggacccctcactgatacgaagctaattccacgttctctacagacttctgtttctacacttacttcctcaaaatgttatttactccttatggctcagttttctgcacttcatgcttttctcagtttcttgctgtgatatggttgggtcacataaacggggcttgtcccctgaaaaatgacattgagggaattggcagagctggggcatagcagattttccctggaccagtcccaggatctggcgaccagaaccatcccacgcgttctttggatgatggcttggtaccttctggctggccaaacgtcactatccagtgttctagcattatgaaatcctgctcttgtagcagcttctcagtgtatctgaataatccagatactcaagcaagagtttggaaggaacttgagtgtaatggagttaaagagcctttagatattgggctttcaattttcccccccattttgaaatgtgcctcgtttagcctgttttctccacggcctctgtgtaaacagactgcctcatcttctgttgcattgcggccgggggtgcccataacttggacttagctactcaatcctcacttagcctccagcttctttgtggttttgccagcccagcctgaagggagaaggaagtcttattctgccgtgcgtgtgggattaagttatcgagaatagcctccttgtgatctgacgcagactcactggctgggccgtgtcttccaccagggcatctgagttgactactgagttgtatgctagtcacccagattccaaaagggttttctcctctcctctattctgcactcttggaaccagtgcatccttcaagagaatgtaaatctgcattgagggaacaagagacaaggaaaatgagatgatgacaacataagtaaggctgctcctagaatgcctgattttcaaagtaaagtcctgttaccatctcccaacagagctgtccagttctcccccaggaccctaccatcaggagccctacgtctgcaaacccgaagagcgctttcgggcaccccctattctccccccacatctcctccaggtcatcctgaacaaggacacggggatttccgtaagtatgtgggcatctgcccggaccatccgccgtgggtcatgttcagttgctttctttcctgtgtccacctcttgcaaagcagctggtgagcaagctcagtgtcaccccctagtgtgaactgtgccgttcacctctgctgtggggatgggctgataacaagaggttcccagtgtggacaccgctgcctcgtcttgcaaagcctttctgcactactcttccttgtccttcacgcctgcctcagtctaagccctgttcaatttacatttcatgacaaactgtatcaccatctcttcttagtaagctacatgctctggcccccacattttagaatctagttttaatcattcaattgcttttagaaatatcagtactcctggatcaaaatttgggatatctaggtaacacacatttctcctccgggaaattattacatgcagaaaagaagtgtgtgtcctcctggatcttgaagaacagccagttctgttgtgattctgttttctgttccatctaacctggattgcctgcccagtccgcctagctctgggatgcatggcacagccgtaattcttgggaatccaggaattcagcttggtccaagctacctcttaagaggcattgtttacgaggtgcttaaagtaaccatgctgctactgaacactccaccctgaagtggagggcatgtgtgctgagacgaggaatgcacgtgtacacatgcaggtgtccctacagtggtccctgccgggctgccaggacagggtctcagtgcttgttaccctacagggtacccaacagggcttgcctttctcaggtcacctcctgtgctgggagtgcccctgcagctgggtagccatcctggtataggcccagaagaggccagtggtaaggacagcacgcctcagctggcagggcccaccatctttccagcactgagttggcaacagtctcaaataggtcacaggtgaagagtttcaaggacatgtagcttctgccttagaagcacttagttgacactgcttcccttagctctaactttacaaaggttggtgggtaagatgactttcagtgccctcctaagctagtgaggtttgtttttttttttttttttttgagacggagtcttgctctgttgcccaggctggagtgctgtggtgccatcttggctcactgcaagctccgcctcccgagttcacgccattctcctgcctcagcctcccgagtagctgggactacaggcccccgccaccacgcccggcaaattttttgtatttttagtaaagatggggtttcaccatgttagccaagatggtctcgatctcctagcctcgtgatccacccgcctcggcctcccaaagtgccgggattacaggcgtgaaccaccgtgcctggccaggttttgttttttctagaaaagggaggcatcactagccatcttctctgatggagactgctgctgggaatagacaagctgagagtggcccagggggctgggaatatgagaatgtcaggacccctctgtccaaggtagcactaagctctaatgtaaactgtggttacagttgtcactactaaagggttaacatttattttgccccaaactaatcttaagtgcttttcgtgtattcttattcaagcctcacaacaaccatgtgaagtaggtgcaattattacccccattttagggatggggaaactgaggcacagagcagtagggagaacacttaaaatctactgtcttagagattttcaagaatacattgttactaatagtcaccgtgttgtacagtggatctcttgaacgtattcctcctgtctaactgaaatgttgtattctttgaccagcatctccctacccccaccactcctagccgctggcaaccaccactctactctctacttctgtgagttcgactttcttggattccacataagtgacatcacatgggatttgtctttctgtgcctggctcatttcacttaatgtcctccaggtttatccatgctgtcacagatgacaggattccttttgtaaggctcagcagcactgcattgtgtatcagtacctcatttctttatccattcatccattgtggacacctacgttgattccacgtcttggctattatgaatagagctgcagtgaacgtgggagtacagatatctcgacatgctgatttcatttccttggagtatctaccctgtagtgggattgctagaccatgtggtaattttagttataactttttaggaaccttcatgccattttccataatggttgtactaatttacatgcccatcagcagtgcactaaaagtagcttttaagtgttctcaccacaaaaacatggtaagcatgttctgcgtgtgttgatgagcttgatttagccattccacaatgtgtccatatttcaaaacaacatattgtacatggtaaatatacataattttatctgtcaatctttgaaattgattaattttttaaaaacccctcttaggctcacacagcaactggctgagccagcagtcacatcaggcttggctggtgccagatccttggtagttggtgctctcagcagccaccctgaatggcctcccagcgggagcttgctgagtatttgttgacacaatgattggcccagcctctgggatcctaagcctacagcagttgttctacacttttttccatttgaattgcatttataacagttgggggtatacaatgaaaaaataaatcccgatttctggcttctcttaaaacataggaaggtgcggcgggcagctctgagtgccagcccggtggcagattttccagagtagtggtgtcttgcccaggtatccgtttcattcttcaggttcattgagtcttacagatacaagttttgaatccattgctcaggagcgtttagtgcagatggtctcttcctgtgttctctgaaagtgctgttaatagctgctttcttcctgccccaccctccataagaggacagggccgtggcccacacttgaaagaggccggggtaaatgcctggccagagacacacaccgatgcctccagcaggcatgcagggagctcccttcaggtcagaaggcgtgaccttcatctcacctgtcgtcttggacaagcccttgcgctgcctgatttgggaagagaggtcggcctgagcgctgcctcctgtcctttgatatctggcactgggaagtaaaggggagaatcttggtttccaaatcccaaatgctcaccgctgcctttgttccctcacagtgtgatccagctttgcttcctgagcccaatcacgtcatgctgaaccacctatacgcgctgtctatcaaggtaatgacatgtctgtccccatgagagctgtgttgcccagtgtgtgctctgaggacccccagcagtggaatgacctggcgggactgacttaaagggcagcttccagggtctggcacaggccatcaggctcaggttctgaagctggcccgggaatttgtggttttatgaagcccttaatgattctcatgtcctctgaggcttgagccccttagtccagcctttgatcatttccaccttgttccttaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattggacatgtgcctggaggagctctgattttattcagtcccttggagaagagactggaactcttcgagagttgcgtttcagtaccgttcttgtggctctgagcggacagggctactccagctgcccaggcctgagaaccagtcctgtgactcacacccattcacacagtttggaaccttaagggacccctaaaactgagcccctctgaacagctcaagtcacaaggggaagctgaagaggggtaacagcagaggctcctggcttcggccagttgttggtgtccccaggccagagggtttgtttccttttgctcctaaacaagcccggtgggacagcctgggatcgtgaccctggcgtgtgagagagcaggacgttgtggagtcagagctgttttcatccactaaaagaggccgtgtccctcctccaaaaaggtggaaggttatgggtgttcctttaagccttctcaggtatcaggaaacattttaaatttagcagaaaagcatgctaatgagctctacccactggtgcagaaaacccaagctgaaaatgctatgtaaaataagactggtttactggagccagtcaccccatgagttctccaagccctggggccacaggggacttccaggtgaggtcactgctgagatgatggaggagacacaaaacaagaggacatggtcagagacaacacatctctgtgcgtattcaaaggatttcattttctttaaaaagcacattatagtcggaaagcctgcccaccaagtgaaagcctccatacccaagaagctaaaggttaatggtgattttacaaaggtggaaaaggagaccttgttttgcccaaatcacaggggcaaagccatatgtcaaatcgtgtcctatgaccaagtaatcctttcttcattagcatttcctttatgggtgaggacttagttaaagcttaactcaaattgcttttcaatgaagatacatttttccctctagaagctgatatacagatgaatttatagagccaaattaaagcctaaaaaattactaaaatgtaaatcagtattgcagggctaaggccacaaacaggaagtcaaaaggccagacaagaaaattgtgcctgcacctcagctagctcaattaggaaatctccaaggctcctaaaagactgagagaaaaaacctggaacatcatgatacgatctgtggctgaggtcagagactgaacgagccagtctaggaaagaacaaaatttcattttaattcagttccttttgtatgagcacagtttcactttcaagcatttacttcccatatctgatcctcctctgctattgtgtcaccttcaaaattcaaatgtccccaatgtgatagtattaagaggtagggcctttaagaagagattaggtcatgagagcccctcctctcatgaatgaaattgaggttcttatcaaagaggcttcaggcagcattcagctcatgtgccctggcaccttctgccatgtgaggacacacagcttttctcccctgcagaggacccaagcacaaggcgccatctgggaagcagagagtagccctcactagacaagcaaacctgcccatgccttaatcttggacttcccagcctccagaactgtgagaaaatgaatttttgttctttataaattacccattctcaggtattttgttaaagcagcactaaatgggctaagacatccaccaatgtttacaaatggtttgaatgaattgatgaagacccaagacatggaccactcatcaaatcataaagtttctgaggaataaaagcttcagcactcatcttggccagcaaattagtggagaaacaaactagagccttctgccctggtatgccaactataattgtcttcaggagaaaacatggaagttgtagatacgtatacatttcttctaaaaccccagtcatccctattaattgtaaaaacatccacaggatcctcctaagagtcatcgtcactatagtgagtcagacatttgg

SEQ ID NO: 14276 - DNA, 7544 bp, Human
  misc_feature (1)...(7544): n = A,T,C or G
tggcttcctgctgaagctcagtccctagtgcttttctttgaccttgctcccctgaaatttaacaatctgcagttggttcttgcagcactgctctggagagagtaataataatacagcagaagctagttagtcccaggaatagtgtccacttgcctgaatctgagtgcgcgctcaaggccacactgagcgctgcgccatgtgaactaagcttgtgcgcctccttgggagaacagtctgggttggactttggccgggcgagcaaggctgctgctgccagctgatctgctcgggatccgccggtcggatctgggtgcttaaggccgaccctgcctttcgcgcaacgctaaggannnnnnnnnnnnnnnnnnnnccctccctgattgttactctctggctgaggcctggtcaggtctcgaagaaggtctcaccaaagaggcgtgggtcagctaagacccccgcagaaggtggaaactctcaaacccatcagcatgcccaccacagctgggcttggcctcaccatcctcagagtccgggctgctcggcctgcccgaggcctcaccataattgccagacttgtctggggaaacgcgacggccgctgtgagtgccagtgttgacaaaggctgtgtcaggacgtctaagcagaggcctacctggaccaaaacctgtctggcttattttcaccaaatttgctagcttagggtgcctgacgcaaatgcgattttgtgcccagggcaccgaacgcatttcccccaagcgccgcgggctcctaggaagccaagagtcgtgccaaaagtcacacagaagggctttcaacctagcagtgctgtcctgcctgccctaccatcccctctggtggaaatggaggccttggacctgtccgcgcccaggacgccgcgccgcgagtgcccgcagctccgcgcgctcaccactcactcccagagcgcttttcggagtaactccacagcaactctttaaaattaaaagtaatttctgtaaaaatatgcagacattcctcttcttcataaacccctatttgtaacaatcctcactttggcattagagtaaaagcctttcaaaggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaaggtggaggaaggtagtggaaggtgctcgctttatgaagcggtgttactgctgctgcagcctttgggggcggagggcggagggagggagagatccagcaccgggttgcctctgagcgattctcctttcgctgtagggtctggtcgcctacggatccctgagtccttctgtaatattggttcctggagtaaactgatagggcgctaaatagagcgtaattgagtcaagacagaacgcttcctctgcgagcccgccttgcagtccgggcggtaggaactgaaatcgatcacagctcgttagagtacgtcactgtcgtcacgagtaggaaaaaaaaaaccggaaaacaaaaacaaaaaacaaaaaaccctttgagctcctttaggtaaagataaatctttttaattttccaagacgtggcgatatattttcaaagtttgaggatccctagatttctagcgtgtgtgaatttgtaatttctgcttttttttgcgtttgcaatacaacacgcgttgaatgtttgttaaacactaaagcacactaaatagcttcgggcaaaccatccccggcctaatcactcattcccagattctacgttttgtatttttatgacttcacattaaaagtcacctaaggagtctttggaatgcttctgggtgaaatcttcaactttgaatgcccaagtatctccaagtcaaaatgttatcaaaacaaaccatctatcttttctatcttgtaacctaatactaacctattatttcagatcgcgacagctaaagcacgtttacaattccaagagaacttctccttatcattgtatatattccacagttaagctataaggggcgggttgctttaaaataacaaacgaattaagtgtgaaatatttacaacaagccccctgccccctattttatagaaattcaaaatctgacaaaacactggcctgtagaagctcattttctaaatattttgaacacaagtttttttcttttattaatctcatatttaactaattttatttaacgttgcaagtaacttttgactaagggtaaatcaaaaataaaggtgcaaatgatagagaaaataatcagctaagtcgtttcagtcatttatttagaaagattcgagcgtatactttttgttattcttacactgagttgttggttttctggcctgcgtttcagacctggtatctgtatttgtggaattcttaggtgcatgcctaacgttatttgaattgacaggtctttctttaatgannnnnnnnnnnnnnnnnnnnnnnnnnnnnnnnnnnnnnnnnnnnnnnnnnnnnnnnnnnnnnnnnnnnnnnnnnnnnnntttctcttgagatgcccttagcctctctgatgcttcccctcccccatccctaattgctgcagttccccctttaattttgcccaaggagatagaaccgtttgttaatcagtcatggctcttctttatatttggtttaacatcacatcttcgtttgcatgaaaaccgttaatttaaaaaatttgttatatatatatatagacaaattatagttgtatatatttatggggtacaaagtaatgttaagtttttttaatgcaatgtggaatgattaaattacgttaattggccatcacctcaaatatttgacattttttattatgagaacatttttgagagttactccgttagtgacattgaaatgcacagtactcaattattagctattgaagttatatgcgcattaaacttgaatatatttgtataatgatgaaaagagttgtaaaaatacattatgggggtaattttaaaaaaagaaacaaatgaaaaaagtatgatcatctattggaaattattattctggctggtttgactttactttttaaaaagtgcttcccatttcactatgtgcatccattgcatttgtgggtgtttggcattatatgatatatctttgttttatatcacactgcaagcatgcaatcaaatctgaagaaaattactgaaattaaacatcccttaacagaatgccagatgtcatgctctgtaatgttttaatagctgttttaatttctgtgtttcagcagagaaaatagaaaagttttcaatcccaaaacttatctaactagctaagcagaaatatgaaatgttttaaaaagaactgcgtaagtttttaggtaaaaaaaaaaaatgctgcttaaatctaatttccgatagaaagcgtattcaaaatttggcatgaaatttattttgtcaatttagtagattatttttgaagaaaaagtgtaaatgcagacatggatataaagttgaaatattcaaaatttagtggaaataatgtcacatctgaaatctatcatcagtacgttttacgtggaggaggataataactttcagatattagtacagaggtattatttaagattaaaatatattttctgagccacattagtagcttggttttatctgctgtgaataaaacacatgacattaaatttgcttcagttttcaaaaatcatggacacttaaagtttctttcatgaaacacccagatcatcttttaattcgagtacatgaatttaagtaaaaaacatgtgcataaacttataaatcctgtaaaatagaactgcggattttggcagatcatagcagttgcatgaacacattttaaaatggtatttaaacctgtcctacaatgaattaagtatagaaatgtggtaattgaattaatactagcacaataaattattaataggccaatttcttggatactctcaattacttctacttattgatttaattgagatgagtttcacaatcctgagaactgttgtttttcctcctctgggtacagtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtaggagccaaaaagaggccttgatggatgggataggaaaataaatggtgttagaataattgaataagtgcattttgccacaaagaaacaaactgattccctagctgaagatgagaaacggagtaatatatatgaatatatgtctactaaaattattttttaattgcaaaaattttgacaactcacgcaatatgtaaaacaaaagaacacaagttattacagagacataaaaattaacaatcattcaaacataacaatatgataatatatctctgattttcaaaagcagtttttaaaggatgaaaagcagaatcatgactatttagtaattggtatatttatttgttttttttttttcggttttattagccactaaggttcttttttagattatatatcaggtatttgtaaattatttgtataatagcccatacatctagaaatttctagatttggaggcataataaaaaaaaaaacaatcccacaaattcccaattgttatgtataccatggaatgttttcactatggataattaaaaacaagatcaaatagtgctcatttacaattttatagtcctagtagttgtcaacatgtaaatattccattataatggttaaagtctagataaatcatatgaattttgcataggcaataaaaataatggctttaaagtaaatttttgtgtatactcaattatgtttataagatatattctagttattaaattggatgatccaatatgcttaatttttaaaaataatttgagaaagaaaaatcataccaggtaaaattttacctcttaggagtactttattttgactacatttgatattcttaaactatattttactagtttccaagtagtaagagtttaaaatgcaacaataattcaggataatggccttggtctttgtgtgtgttctgactcctctacaaaagtattgatttttgcaattcccataaactgctaaaatgggggaatgaataaaatagtgaaaatttttgttctaaatcgagtaacggtatttcttcttaaaattgtaaggctcttacatcattagagacaacatctggtggcacacggataacaagcagcagatttttacttgagtttgtggaagcaaatggttactttatcttggttcaggaagtaaatatgtagaaagttcatgctaacaaagaattttagaattgtcgagtattaacacccgctgtgtaagtttgagatttttgtctttgtctatatttaaattagttatacttgtaaccataaacaaatatgtttgcacacagagtgaccaactgtacataatgcatcttttccccttaacattcaccaagtcttgattaatttttgtctgagaacatgcacagagagccaacttgaacttaatttactcaggtcgttctctttcctgctttgcacataagagtggtaactattactcattttaaggaaattgtcaagttctttttgtcaatggaaaaaaaaataaaacccaaaaacgtattactaaattcccttagtgtgttcctggggctcatctgcggagacagcaagaaaatttgatttgtttttttgttgttgttgatgtcttgagccttggcataatggataatatgcatttatcagcagtgtactaaaactataatgaacatgtagctctctggctcatttcaattgctgaaaactctgcaaagtgccatcttaaatttgtaatgtgtactaaaaaattaaactgagtattaatatgttgccataatggtgaaggtaaagatatacaagattagaattgagtatgaaaaagagtgaaaatttcaagtaaacttcaacaaaaggcttttacaacttgcattttttatatttgatttctagcctttttcctaaatattttatattctgaacataattgtgtgaagaagactagattcccaaaagctactcctataatgttcatttaaaaacatccaagtatatatattgaatataatcttctgc

SEQ ID NO: 14277 - DNA, 94873 bp, Human
  misc_feature (1)...(94873): n = A,T,C or G
tagaaggttttaatgagttatggattatagattgattaaaaagagaggtaatttacactacataatagccctaacacatccctagttcttatatataactggtaaactttatttttcagttatagttactagttcattctggggctaaaataagaatgactttcctggtaatagtaagatttgccttaaatgttcagttatatattcttctctgtcctttgaaacttaaaactggcctattttgaacatgaaaggaaaagttataccatttaacaccacaagatgtcacttatgtaaaaataaagttggtatcctaatactcaaagctagaaagctacaggtaactaggtaaatgaagacacaggtaaattaaaaatgaatatatttgaaacaactattgttttcagcaaagagttgaggaaaatattgctaattcagcattattttgactcaaatattgatatttaacaaaatagtatctaagatttatgcagtaatacatgttaactgatcatatttgaatctacgtaatgaagaaggtagacctaaaagaacttaataaaagttaatgtattttgagggtaaagtaggtgttatggtattaactttcctaaatctttactgttttggtgacaggcaaagaagaatttgggaagaaacatgtaatttatatcagaattttaaatagatccttatgacatacgtgagaagctgcatattacatcaggttgaaacagtgcctaggatttttcttgtctcttccctgaacctcagaattattagtttctcttcctatattaatgcagtatttgttgttgaagactagcttttctgttaaccatgaagagcaaaacctttacctttaatattgagattctgttttcttgtttttagtttcagagagcaggtgcttgttctgggcactctgggaatttgggctttagatgagcaaaccaagtttccattagtttacgagtaagactatgcctggaattagaggttgggctgttctaaaaattgacacttcattcctcttcattgctcacttctctctccagataaaactggtagaggagaataatgggacactttggggaacagaaaaggggaacaagcaggagaaaattgttttcttttttggcatgtgtgtatgtgtgaccacatttcctttctatttagttcctatcgaattctttttttttcttacctaacttcagtaagatttttttaaggtttcttttagggtttaggtttttcattataaaagtatacatagtcattaagtaaataggaaaatacagcaaaaagtagaagaacaaaatacagttacatatatagttccattaatttctctcccttttctgttacctgtgaaatctgaaagagcctgaaaagttttatgcagggatcctaaattccttaaggtgaacatttatagtatgtgtagtagttgtatgttctcagagacagtttttatttattactacctctactgtttaaatattttcaagctgtatttttaattaggaagaagtaggtgttttaattatttaattgtattttgtcttctctactggtcaccattgcatttaattttatgagctgtttggaaagtaaggctcatttttttcataataaatttcattgcatttattccttttgaaaaaaatgtgcttagcttttacttatttttttcttgcaatgacagtttgtaacatttaacccttgtattagtttgctagagctgccataacaaaatgccacagactgggtggcttaatcagcagaaattaattttttcacaattaatgcctgggagtacaagatcaaggtgttggcgggtttggtttctgctgaggcctttctctctggcctgcagatggccaccttcttgctgcagttatttaacattgcccatgatattacttctaattcttatgaaaatgatatattttaagctatctaatataaaaatcaaagtatggattttttttcttctcttttgtaataggaatgaagatctaaagcaaatgttagagagcaacaaagattctgctaaactggatgctatgaagcggattgttggggtaggtaaaatactcatttacttcaattttggaaaaatggacaagcagtgatcatattattatatatatatataaaaatatgttaaataccaagtctaatattctgtttgcccttaatattaacttagaatttcctgtccaaaaatgttaaagaaaaaagtacattattgaagtgtcaaaaatcaagaaacttaggttttaattttatcttttctctgttttaatttccctgtatctaatttcaaggtatttctactatgagaatgaggtagttagtcattttgaagacaaaataagatgatatacaagctattttgacttcctacacagagggatactaaagaatgattttttttgtcctttcacagcctaaatgttctgagcatactttcatctgttttttaaattctcttactaccaatagaaacactttattcagtttagaagcctagaacttctaataaatattattaaatataagagcattcaccagtgttcagctgtaaagcaaaacataaacaattgattaataagttatgaggattctattgccagagaattaaagatataatatagttccttaattatttttaatgttttaattttaattttttatttttccagggttctagttgtatataccatctttagtaaaatagttttgcaatttatgttgcactctctgtacgtactcatttgattttccacattcacagagaaaaaacttgcttaattccactgactatctgatgctcaggagttttgcttttgtttcactggaatcaaattcataaaactgatttttcttattaacactatcctttttatcaccaccattgctgattctattttccacttaattttatataataaggtcaaaattgaatacatttgcataattgcttaaataaactactgtaataaggcgatgacacaactaaaacaatactgttttccagcaggcagtgccatcgtatgagagcttcagatctcttttcctttcttgatatattaaagtccaaataacaggtatcagcatgctctgttaaaaagtgaggtggtatgaaaatcaaatatattaaagtcaagtactaattgtatctgtaggacatctgtaagtgacttgatccttgctttcatgtttatgtcatttggcagtataggggcaattttgaggattccattgtaaatttttgatttgttaatgttatgctctatacataggagtatttatgggcaggcagttcttgctttgcatggcttttatacatatgaatttcagttactacagtttagttaagtgacaccaatcccctaacaatatggttcaaatttcatttaccatggtgtattaattgtgtacttggataatgtacaaacttgactgctagctcttcattctacaaataacttgtaaattacaaacatgtatcatgatccatgatcaatcatgtcacttctttcaaaatctgtcagtgattggtcactgtgcatctgttactcagtttatgcacagacaacaaagcatgtagttgtgttgcctctttgtctcccagtaagaaacacatgtgacattttacagaaatgaataattgaaagaggcatttgcccaacaaagtgaaaatacagcaaagaaatgaaaagtgataacatgtaatgaaaatcaggtagaatataaatgaagttatacagaagtagctggctgtggaactactgacattacacgtttttaagagactgaatttatagctggaggaacttggtaaggtgagattttcaaccaacataaatgatgaaagtgattttgttgaagagcatgaagctgtctcagaggaagtgatgctgtcagaagacctcacattcattaaaggaactctaggagatagttgagaacattgaaaatgcaaagggtaaaatgttggaagctgatccagacttagaaaggagcatgataatttactgaggaatacgaaagattcttcctcagtatcatgagttaaacactgataagagaacaagttctgttcaaaccactcttgataagttcattttctttgcctttttttttgtttttttagagacagggtcttgctctgttgtccaggctggagtacagttgtgcagttgtaacacattgcagctttgaactcctgagcccaagcgatcctcccacctcagccttctgagtagcagggactacagatgtgtaccactatgcccagctaatttttttatttttattttttgtagagacagggtcttgctatattgcccaggctggtgtagaactcttggttttacttgatcttcccacctcagcctttcaaagtgctgggattataggtgtgagccaatgtgcctggccaagttaattttcaatttttccaacgttttaagttatagtatactaaatattgatttttattattttttcactttcctataaatttataactgacagtaaaagagttattaatgctttgacagaaattttaaatagtatccagggatttagtgaaataaattaccttaatgggatgtaagagccatagtttaaagaaataaataagggcagtccctactttgcatggtagtgcaggtctatgccctgcaggaatgcaagcagaaaccatggaaagaaattttaataagccaactggaaaaattacaattgatctatgatgcttaaaatttttgtcaaaacaggagaattagctgagtcaggtggtatactgttttgagttaatgactgtaataaatagttttgtataaatctttccagacggactgtttatcccttgttctttccctttcttccttcaataacaatgctttggttctatgtatgctttaaaggattcaacttggggctgttgcttgcatcttttaaaaaattattgggttggaaattgtttaaaagaccaagatttttctgcagtattagtgtgcatcaggatgaattcctggttatcaggcctgaggttttactggtgatgtgacacctatagaactttagtgggttttctatcagctttgctccaatgtagtctctggaatacaaaataagggtcagttaactttctgtatctccatttattcttgactgttgattcttaagagttactgttgggtctgaaaccctttgaaaccttttctctctgtttttgttacctgtgaattaactagcagttttctgtaaattcaaaattctgaacttttatctcatctttattgctttgaagaatgaccagtggaaattaaaaattaaacataatttcatcctttttcaaaaaactgggtttaaaaattatgtgaatttttggatctagattattattcaatacagtcatgcatcacttagagtcatgcatcgctgaatgacagggatgctttctgagaaatgcatccttaggcagtttgttggtgtgaacctcatagagtacttacacaacctagtatacttacacaagcttactacacacttaggctatatggcatagtctattcttcctaggctataaatctgtacagcatgttactgtactgaatactgtaggcagttgtaacacaatggtaagtatttgtgtatctaaacgtatctaaacatagaaagttacagtaaagatacagtattataatcttacaataagattatatatgtggtccctccttgaccaaaacatggcacgactgtaatttaaaaataacacaaaattcagtcattgtaatataccacattaacagaaggaaagggaaaaatccctcacaatcatctcaatttattcggagaaagatttgacaaaatttaatacactttgatgataaaagtactcaacaaactaggaataggaggaaactacctcaacctatctgttaaagagcaggtgtggaaaacccaaaactagcatcacactcagtagtgaaagactgaaatcttttactccaaggtcagaaacaaggatgcttgcttttaccacttctgtgcaacacagtattggaaattttagccagaacaatcatgcaagaaaaagaaataaaagacatccaaatggaaaaggaagaagtaaaattatttttattcacatcatcttatatgtagaaaaccctaaagattccacaaaaaactgttagaaccaatacgcaagtttaccaaagttgcaggatagaaaagcaacacaccaaaatgacttgcatttctacacattaacaatgaacaatttgaaaataaaattaaacaaatattcatttataatagcatcaaaaagaataaaatattcaggaataagcttaaccaaggagatgaaagacttgtacactgaaacattactgagaaaaattaaagaagacacaaataaatggaaagacatctatgtttctgggttggaagactaatattgttaagatgtcaaaatgatctgtatattcaatgcaattcctatcaaaatgccaatgatgtgcatggcaaaaatagaaaaaaattcatcctaaaatttatatagaatcccatgagtccctgaatagccaaaacaaccttgaaaaagagcaaaattggctgggcacagtggctcacgcttgtaatcccagcactttgggaagctgaggcagggaggatcatttgagcccaggagttttagaccagcctagactacatggcaagaccttgtnnnnnnnnnnnnnnnnnnnnactacatggcaagaccttgtctccacaaaactaataataagaaaaaaattactacctgtgcctgtggtcccagctgcttgggaggctgaggttgtggtatcgcttggagtgagctgtgttcatgccactgcactccagcctgggcaacagagcgagaccccatctcaaaaccctgtctcaaaaaaaaaaaaaagaacaaaattgaatgtctcatacttcctgatttcaaaacctatgacaaagcatagtagtgaagacattgtggtactggaataaagacggacaacgtatagaccaatggaacacaatagggagctcagaaatcaaccctgacgtaaatggtcaaatgatttttggtaatggtgccagatcaatcaattgggaaaggacagtcttttcaacaaataatgttggggaaactggattatatatatatgcaagaaaatggtgttggatttctttctgtatcacaccataaataaaaataaaccaaaatggatcaaagacctaaatgtaagagctaaaactataaaactcttagaagaaagcatagagaaaaagcttcatgacattggatttggcataggattcttagatacaacactaaaacaagaacagtaaaaaaaaagtagattatttggattttatcaaaattaaaacttgtgtgcatcataggactctgtcaacaaagtgaaaaggcaacccatagaatacaagaaaatatttgcaaatcatatatctgataaaggattgatatccagaatatataaagaactcccacaactcaaccattaaaaacctaccaaatggctgggtgtggtggctcacgcctgtaatcccagcactttgggaggtcgaggtgggcggattacttgaggtcaggagtttgagacaagcctggccaacacggtggtctctactaaaaagacaaatctcgtctctactaaaaatacaaaaattagccaggtgtggtggtgggtgcctgtaatcccagctgctcgggaggctgaggcaggagaattgcttgaacccaggaggcagaggttgcagcgagccaagatcatgccactgcactccagcttgggtggcagagtgagaccgcgtctcaaaaaacaacaacaaccggtggctcatgcctgtaatcccagcactttgggaggccgaggtgggcagatcacgtgaggtcaggagttcgagaccagcctggtcaacacagtgaaacctcgtctcttctaaaaatacaaaaattagccaggcgtggtggcgggcgcctgtaatcccagctacttgagagactgaggaaggagaattgcttgaacccgaaaggcagagattgcagtgagccgaggtcgtgccattgcactgcagcctgggtgacaagagtgaaactctgtctcaaaaacaaaacaaaacaacaacaacaaaaaccgaccaaatgaaaaaatgggtagaagactggaatagacatttctccagagaagatatatagatggcaaataattacagagaaagatgtgcagcatcactaattattaggaaaatggaaatcaaaaccatagtaagatcactttacaccattaggatggttattatcaagaaaacaaaattgtaagtgttggtgagggtagagaaataagaactcttatgcattgctggtgggaatgtaaaatggtacagttactgtggaaaacagtatggtggttccttaaaaaactaaaaatggaattatcacataatccaccattctccttttgggtatatacagacaacagttgaaaggagatacttgaacagatatttctacatcagtgttcgtagcagcattatttatagaagccaataggtggaaacaacccatgtgctcatcagtggatgaataaacgaatgtggtacatctgtgcaatggaatgttattcagctttaagaaggaatggaattctgatgcatgctacaacatggatgaaccttacttaagtcattatgctgagtcaaataagccagacacacacacacaaaaaattgtatgattccacttttatcaggtacctagaataatcaaactcatagagacaaaaagtggaatggtggttgccagcagctagggggaaagcgagaaattgggagcttgtctttcaaaaatcattttggacatttattttaaatattatgaaccctattaaaaatagttgtgtaggcatgagcgctgtcccactcattatgctttcacttttttttttaaacttacattcctcctcattctttttttattttctattttttatttttgagatggagtctcgctccgtggcccaggctggagtgcagtggtgtgatctcagctcactgcaacctccgccttctgggttcaagcaattcttctgcctcagcctcccaagtagctgggattacaggcatgtgtcaccatgccccgctaatttttgtacttttagtcgagacgggggtttcatcatgctagtcttgaactcctgacctctggtgatctgacctctggtgatctgccctcctcggcctcccaaagtgatggaaatacaggcatgagccaccacgcccggcccctcctcattctttagagttttggtttattttcaggtgatgggggcatttcatttaggaagagaatgtagatggcattctttcaaagtccttgcctgtcggaacaggtttctatttttttttccatgggaaaatagattacttaagaatagtattgttgggttgcaatgttttcttttccttagatttttgtagatttcattcttgattttgtctggctttagctgtacagagcagaaatgtgatgtgatgacaatgagattgcttttttaaaaaacatttaatttttatttcttttaattttattattaatttttttttgttttttgtttttttgagatggagtcttgctctgttgcccaggctggagtgcaatggcacaatctcagttcactgcaacctctgcctcccgggtccaagtgatcctcctgcctcagcctcctgaatagctgggattacaggcgcccaccaccacacccagccaatttatttgtatttttagtagagttggggtttcaccattttggccaggctggtctccaactcctaccgtcaagtaatccgcccaccttggcctcccaaagtgctgggattacaggcgtgagccactgcacccggccatatatatgtatttttaattttagtgggcacatagtaggtgtatgtattttgggggtacatgagatgttttaatacaggtgtgcatgtgaaataagcacatcatggggaatgggatatccatctccttatacctttttccttctgagttacaaacaattcaattacactctttaagttattttaaaatgtacaattacattattgttgattgtggtcaccctattttcctgtcaaatagaaggtcttattcattcattctgttatgtttgtacccattaaccactccacctcccctgtatcccccacttcccttctcagcctctggtaaccatccttctactctctatgtccataagttcagttgttttgatttttagaccccacaagtaagtgagaacatgaaatgtttgtctttctttctttcttttttttttttttgagatggagtcttgctctgtcaccagtctggagtgcagtggcacgatctcagctcactgcaagctccacctcctgggttcacaccattctcctgcctcagcctcccaagtagctgggactacaggcacctgccatcatgcctggctaatttttttgtatttttttgtatttttaatagagatggggtttcaccgtgttagccaggatggtctcgatctcctgatctcatgatccgtccgccttggcctctcaaagtgctgggattacaggcatgagccaccgtgcccggccagatgtttgtctttctgtgcctggtttatttcacttaacaagatcttcatttccacccatgttgttgcaaatgactggatcccattgttttttatgactgaatagtactccattgtgtatttgccccacattttctttatccatttgtctgttggtggacacttaggttgcttccaaatcttagcttttggcaacagtgctgcagcgagcattggagtgcggatgtctctttgcactcctgattttctttcttttgggttgtacccagcagtgggattgctgggtcatgtggtagctcaattactagtttctttttgaggaacctctaaactgttttccatagtggttgtactaatttatattcccaccaacagtgtgcaggggttcccttttctccacatcctcaccagcatttgttgttgcctgtctttcttttgggtataagccattttaactggggtgagatgataactcattatagtttagatttgcatttctttgatgatcagtgatgttcagcatcttttaatatgcctgtttgccaattgcatgtcttcttttgagtaacgtcttttcaaatcttttgccccctttttatcatttgatcaaatcttgcccatttttagattattagactttttcctatagaattgtttgagttcctgatatattctggttttaaatctcttgtgagatggatagtttgcaaatattttctcccattctatgagttgtctcttcactttgttgatcgtgtcctttgctgtgtagaagctttttaacttgatgtgatccgatttgtctgtttgtgctttggttgcctgtgcttgtggggtattactcaagaaatctttgcccagaccaatgtcctggagattttccccaatgttttgttgtagtagtttcatggttggaggtcttagatttaagtctttaatccattttgattttatatttgtatatgctgagagatagggatctaattttgttttcctgcatatggatatccagttttcctagcaccatttattagagactgtcttttcctcagtgtatgctcttcgcatctttctcagttctctgtaggtgtgtggatttgtttctgggttctctattctgttccattcctctgtgtgtctgtttttatgccagtacatgctgtttggttactatagctttgtagtataatttgaagtcaggtaatgtgattcctccagttttgttctttttgcttaatataactttggctattctggatcttttgtggttccatataaattttaggatttctttttctatttctatgaagaatgtctttggtattttgataggcattgcattgaatctgtagattgttttgggtagtagggacattttaacaatattgagccttccaggccatgaacacagaatatttttccattttttggtgtccttttcaatttccttcttcagtgttttatagttttcactatagagatagttcacttctttggttaagttaattcctgggtatttaattttgtgtgtggctagtgtaaatgggattacttttaaaatttctttttcaccttgttcactgttggcatatagaaatgctcctgattttggtatgttgattttgtatcctgcaactttacttaatttgtttatcagttctaatagttttgtggtggagtctttaggttttccccaatataagattgtatcatctgcaaacaaggatactttaatttcttcctttccagttggagaccctttatgtctttctcttgtctgattgctctagctaggacttccagtggtatgttgaataacagagatgacagtgggcaaccttgtcgtgttccagagcttataggaaagactttcagttttttcccattcagtatgatactagctgtgaggtttgtcatatatagtttttattatgttgatgtatgttccttctattcccagttttttgagggtttttatcatgaaaggatgttggattttatcaaacggttcttcagcatcaattgaaatgatcatatggtttttattgcccattttgttgacatgatgtatcacattgattgatttgtgtatgttgaagcatccttgcatcccagggataaatcccacttggtcatgatgagtgatctttctgatgtattgttgaactcagctttctagcattttgttgaggatttttgcatcaatattcattagagatattggggtgtcattttctttttccttgatgtgtctttgtctggttttggtatcagggtaatactggccttgtagaatgagtttggaagtattccctgctctgtttttcagaacagtttgagtaggattgatattaattcttctttaaatgtttggtagaatttagcagttaagctatcgggtcctgggcttttcttcagtgggagactttttattacagctttcatcttgtgatttgatattggggtctgttcaagttttggatttcttcctgattcaatcttgataggttgtatgtatctaggaatttgtccatttcttctagattttccaatttattggcatatatgggtgctcatagtagccactaatgatcctttgaatttctgtagcatcagttgtaatatcttctttttcatttctgattttatttatttggatttttctcttttttttcttagtctggctgatggtttgtcaattttgtttaacttttcaaaaaaagctttttgtttcattgatcttttgtattttttcatttcaatttcatttatttcttctctggtctctattatttcttttcttctactaattttgtgttttgttcactcctgcttttctagttccttaagatgcatcgttagattgtgcttttgaagtttttcttcttttttgatgtagacacttatagctatgaaattccctcttagatttttcagtttctttcttaattacttcattgacccactggtcattcaggagcatattgtttaatttcccatgtgtttgtatagtttccaaaattccttttgttattaatttctagttttattctattgtgatcagagaagatgcaattatttcaattttttgaacgcttttaagacttgttttgtgacctaacatatggtccatccttgagaaagatttatgtgttgaggaaaagaatgtatattttgcagctcttggataaaaggttctgtaaatatgtattagattcatttttgtctatagtgcagattaagtgtggtgtttcttgattttctgttggaagatctgtctgatgctgaaagtggaatgttgaagtctcctagctgttattgcatttgggcctgtctctctctttagctctaataatatttgctttatatatctgggtgctccagtgtagggtacatatatatttaaaattgttatatcctcttgctgaattgactcctttatcatatagtgaccttctttgtctcttcttatagtttttgtcttgaagtctattttgtttggtattgtatagcaactcctgctcttttttcatttccattgggatggaatgtcattttccatacctttgttttcagctgatatatgtttttatgggtacagtgtgtttttttgtgggcaacagatcaatgnnnnnnnnnnnnnnnnnnnncgagtttagtcccatttatgttaaatgttattattgataagtaaggacttactcctgctattttgttatttgttttcctagttattttatggttttctcttccttctttctttccttcctgtcttctagtgaagggattttctctggtaatatgatttagttttttgttttttactttttctatatatcttgtatgtttttggtttgaggttaccatgaggcttgcaaatactatcttataatccattattttaacctgatagtaatttaacactatttgcataaacaaacaagcaaaaagaaaactaataaaaactccgtgctttaacttcgtctcctcactttttaaccttttgttgtttctgtttatatcttattgtaccatgtcctgaaaacttgtagttaccatttttgattggttcatcatttagtttttctactcaggataagaatagtttatacatcacagctacagttttataatattctatgtttttctgtgtacttactattaccagttagttttgtaccttcaggtgattatttattgctcattaatgtcattttctttctgattgaagtactccctttagcatttcttgtaggacaggtctggcattgatgaaatccctcagcttttgtttgggaaagtttatttcttcatgtttgaaggatattttcactggatatactattctgaggtgaaagttacttttcttcagcacttttaaatatgttaggaaaccttacctgtttccactgaaaagtctactgccaccatattggagctccgttgtatgttatttgttctttttctcttgctgcttttaggatcctttctctatccttgacctttgggagtctgattattaaatgtctcgaggtaggcttctttagcttaaatctgcttgatgttctataaccttcttgtacttgaatgttgatatctttctctaggtttgggaagttctctgatattatccctttgaataaactttctaccgccatcgatttctctaccttccctttaaggacaataactcttaaatttgcccttttgaggctgttttctagatcttttaggcatgcttcattcttctttattcttttttctttggtctcctctgaccgtgtatttccaaagagcctgtcttcaagctcatgaattctttcttctgcttgatcaattctgctgataagagactctgatgcattcttcagtatatcaactgcattttttaactctagaatttctgattgattctttttaactgtttcaatctctttgttaaatttatctgatagaattctttttttttttttttgaggtggagtcttgctctgtcgcccaggctggagtgcagtggcatgatctgcaagctccgcctcccgggttcatgccattctcctgcctcaccctcccaagtagttgggactacaggtgcccaccaccatgcccggctaattttttatattttttagtagagatggggtttcactgtgttagctaggatggtctcgatctcctgacttcatgatccgtctacctcagcctcccaaagtgctgggattacaggcgtgagccaccgcgcctggcctatctgatagaattcttaattccttctctgatcttgaatttctttgagttttctcaagacagctattttgaattctgtatctgaaaggtcacatatttctctttttccagaattggtgcttggtgccttatttagtttgattggtgaggtcgtattttcctggatggtcttgatgtttgtagatgttcatcagtttttgggcattggagagttaggtatttattgtagtcatcactgcctgggcttgtttatgcttatctttcttgggaaggctttctagtattcataggaacttgggccccaagcccaataatgctgtggtttttgcagcctcatagaggttggtgcaagtagatgttctttggtgtctgggcattgaagagttaggtatttattgtagtcttcactgccttggcatatttttggccatccttcttgggaagtctttccagatatttgaaagaacgtgggtgttgtgatctaagctatattggctttagggggcaccccaagctcagtaacactgtggttcttgcagactcatagaggtactgcctagatggtcttagaacagatctaggagaattatctggattaccgggcagagactcttgttctctttccttactttcttccaaacatacagagtctctctcttctctgttttgagccagataaagctgagaatggtgacacaagcacccgtgtggccactggtactatgtgctgggtcagacctgaagccagcacaggactgggtcttgcacaaggcctgctgtaaccgcttcttggctattgccatgtttgctcaaggccctggggctctacagtcagcaggtagcaaagccaaccaggcctgtgtccttcccttaagggtggcgagctcccccaggccccggatgggtcaagaagttctgtctaggagccctgggagtcagggactagagtcagaaaccttagaagtctacctagtgttctgttgtattgcagccgagctggcactcaaaccacaaggtgcaatgcttcccacttttcctcccctttctgaaggcagaggagcctcaacctgtagccaccaccaccccaggccacaaagagtactgccagagtacccccatagtcccttaacgcccaaggtctcttaagtcagcattcatgaaaagctatcgggggaactctggcagtacttttcatgaatgctgcttggcctgggactcacccttcaggacagtgggctcccttctggcccaggacatgtccagaaatgctgtccaagagccaagtcctagaattgaagacgctaagagcccacttggtgctctaccctgctgtggctgtactggtacctagggggcaaggcagagccccttttactttcccccctgctgttctcaagcaggagttttgccccatagccaccacagctgggaatgtgctgagtctcacctgaagccaacaagtctcagtggttcaccaaggccctcaatgtagtacctggatattgctgctggttattcagggcccaagggctcttcagttagcagattatgaatgctgccaagcctcagacctttccttcaaggcagcaagttcccttctggacgagggtgtgtctaggaatgtcgtctgggagtagttaggtcctggaatgggggcctcatgactctgaccggtgccctatcctgctgtggctgagctggtatccaagatgcaagacaaagtcctccccactcttccctctcctctcctcaagtggaagggaggggtctcttttggagccaccagctgtgcaacctggggttaggagagataatgtcagcactcccttggctgccccaggtggtatctcagtatgttgcgtgctccctccattgtctctaggcctagttcagccgtaggacttgccaaagagttgcagttcttatggcctagactgtctttcaagtttacttggagacacacagtgctgtagccctcggtggcgaggttttccagggactcaagtttggacctctgggattcctttctggctagggctggtttaaatgctccccctgtgggtgggcatcagctgagttcggtccggttttcctttctgctctaacaggacagcacagagttcagtgcctcacaattgcagtgttctcccttccccagtgcccagagataccctccataccatgcactgctgctggaagaggagtcaccactctgaggaaaagggtggcattggtgattcaggactgttacttttaatctcttctgtgcttctttcagtgatatgaagttcaaaccaagtcctgtgagtgctcccctgatttttggttcttatgaaggtgtttttttctgtgtagatagttgttaacttttttgtcctcggggggacgattggtggagctttctattgcaccatcttgctctgcctctgagattgctttttctctttctcttttagagaatctgtttcaactgtctggatatgtagatgtttttaatattttgaggaaaaagaaaatattcaagatacggtctgtgttttttctttactgatttgttatgttactaatgaaccctttgattctaaaattttaaatctgttttacttagagaatgtttgtctgctatttattttctcccttttctgtcagtctgccagttctctcttagccttcctattatgtgtgtattatattttttggatccatcctctgtttgcctctgtcttctcccctgtcaaattgacctctctaacctttcctgtcatttttaggattttttttgagctggcattgaagtcagtttagaatttttgacattatcctttcttctctcattatattttaaaatttggtaattatatctttatctgaaaattttctttgctattccaaagtcattcttttttaaaaaaatgccacatcccctcaaatctcactaagaatatgagttagatatatttcccatggtttttctcttttatatccaactttttccccatataatttattcatacttctccagtgggtccatttcttttgaactgtggaatgtttttatatgccctgttatttttttcctccttaagtcatcctcagaaagcattagagttatttatctttatttttccagaatttctgtttgaaattggttctgttgtaggctctaaattcataagatcaataatttcaggctccattgtgggttgaagagagtagtattcgtattaataaattaagtattagaagaccaaatgtctatttagaatagagtgggacaaacagatagctgagggtaaggagcctgagagcactcttccctctgtctttaattggtacgtcttcattaagttcttcactgtttttctgttttttcctttatttttcttttttgggtttaagtattctttgggaataggtactaagattctttgggaataggtactatatattctgctgtttggtatgttgtcctcagggtacttccctgaagattattagaaagaccaatatattggagccaagggcctgtctgatagttaagtagtaggtaaaattaggtccacttttgattaagtagtaagttcatccacttatttcttaggttgtaactagattggtagatgcttgtttcctaaaatgttatcttatgtgaaccatacccctgcagaaatttgttgaaatttctgttatgtggatagtactttatctaaaatagaaaatatcctggattgatgcaatagcagaatggtgataacagaagaaagagccagaagttgaagacagatcattagaaattattcagtttgtggccggacacggtggctcatgcctgtaatcccagcacttcaggaggctgaggattgcttgagccaaggagttccgagaccagcctgggcaacaaagtgagaccctgtctctacagaaataccaaaaaatcagccaggtatggtggagggtgcctgtggtcccagctacacagaaggctgaggcagaaagcccactcgagcccaagaggttgaggctgcagtgagccaacatggcaccattgccgtctagcctgtgccacacagcaagactctgtctcaaaaaaaaaaaaaaaaaaaaagaaaaagaaaaaaatcattctgaagaatagagattgaaaagaacagagccttggagttttgttggttcattctaaaggtctaacgtatgcatcattagaacagcagaaggagaggagaaagagattggagtaggaaaaaatatttgaagaaataatggtagaaaacttcccaaatttgatgaaagatacaatttttatttttatttttattttttgagacggagtctcactcttgtcgcccaggctggagtgcattgtgcaatctcggcttactgcaacctctgcccctggggttcaagcttctcctgcttcagtctcctgagtagctgggattacaggtgcccccgctccccagccccaccatgcccagctagtttttgtatttttaatagagatggggtttcaccatgttggtcaggctggtctcgaactcctgatctcaggtgatccgccctcctcagcctcccaaagtgctgggattacagacatgagccaccgtgcccagccaagatacaaatttatagatgaaagaagctcagcaaatgccagttaggataaactaaaagaaaaccacgcataaacacagtaatcaaatggttgaaaaccaaaaataaagtcttgaaagtagcgggaaaaaatggtacatagaggggaacaataatttgaataaatgcagatttctcatcagaaatcatggcagccagaagagagtggaacaatatgtttcaagtactgaaagaagagaactgttaacccagaactctatatccattgaaaatatccttcaagaacgaagatgaaataaagactaagagtatccatttctaacatgtttactttaatgaaatgttaatagacgttgtgtaggctgaagggaaatgataccagatggatatttaggcggaccaatcaaaatggtaaatacgtataaaggactaattttattcttaagttatcccactatctgagaggtttttaatatgggtggctaaacataaaagctagtggggaggtggaaataaaagagtctatatggttgcaatgtttctgcatttttcttttctttttttttttttttttttttttgagacagagtctcgctctgttgcccaggctggagtgtagtggtgtgatctcggctcactgcaacctctgcctcctgggttcaagtgattcttctgcctcagcctcctgagtagctgggactactacaggtgcacgccaccacacctggctaatttttgtatttttagtagagatggggtttcaccatattggccaggctggtcttgaactcctgaccttgtgatctgcctgcctcagcctcccaaagtgctgggattacaggcgtgagccactgtgccctgcctgtttctgcatttttcttgatctggtacagtgttaactgtaagtagactgtgtaaggtttgctgtttctgtatttatatatttatatgtctgtttatctacctatgtatctgataatccgataagttaaagatatgctgtttgagcacaaaggagattcatttaaaccgctattgctatagattatgcctatgatgcatttttacgaggaaccagtaaattatataaaaagatataggcagaaagttaatataaaaatatgaaatactaaaaattttctaaggaaaagagaaaagaggaagtaggagaacagaaaatacagggaataaacaggaaacggatactaaaatggtagacctgaatctaaccatgttaataattctattacatgtaagtggtctgacattaccaataaaaagagatcttcatattggatgaaaatgtgaagatacaactgtgctctttgtaagaaacctacttttaatataaagacataagttataaggaaggaaaaatgcataccatacaaacactaaccaaaaaaagttcagatgaatctatttatatcagagagagtaaacttttgaacaaatagtatggttaggataaagaacataacaataagagtcattttcccaaaaagacataataatcttacatgtgtctaacaacagagcttcaaaaacggagtaaaaaaaaaaacctgttagaactgacaggaaagattgacaaattcacaattatagagacgtcagtgcttttttcttaaaaatcaatagaatagggagatagaaaaccaataaggaaatttaagactagaataatatcaacttatatgacctaactgacatttatagagcagtctactcaacagtagcgaaatatacattctttttattattattatctatattattatctatattatctatatattataattattatctatattagcaagatagactacattctgggccataaaacacaatcttaacaaacttaaaagaattaaaattatgcaagtgtgttatctgaccatatagaattaaactaaacacagtcattggaagagatcaaaattttttttaaatatttgaaaattatacatcaaacttatacatttagaaatgatgacatgatccatgagtcaaagtcaaagtaaaagtcacaagggaaattaggatgaaattgaaaaaccacatatcaaagtttggaggatttaggtaaaacagtacttacaagggaaatttatagtaataaaagcttatgtttgaaaagaagtatttccaatcagtgctctgagcagctaccttaacatagcagaaatagaagagcaaattaaactcaaattaaaactaaagaaagaaataataannnnnnnnnnnnnnnnnnnnaaataataaggtagagtagaaatcaatgaaattgagtagagaaaaccagtagagtaaaatcagtgaaatgaaaaactagtccttggaaaagatagataaaattgataaatctgtagacagagtgaccaagaaaaaacaggacaaattatcaatatcagaaatgcaagaccctgttgacatttaagggataattagggaatattttaggcatcattagccccataaatttgactactttgttgaaatgagcaaaatccttcaaagataagctatgatgtttactcaagaagaactagattatctgaatagtcctatatctaataaagtaattgaatttttcattaaaaaaatttctacagggaacgttcagttctacataagctcttccagaatatagaatatgagaaaatacctctgaattcaatttctgagttcagtgctatcctggtctgaaaactagacaaagacattatgaaaaaattaaattatgtccatctccctcatgaacatagaggattggatggagagtaaatcagtcaaatttcccaaaatacagtgctgttaggctatacccattgtaagtaaaaacattgatgttggggctgaggccaccaaaggttgaaggatgaaaaaaaataaaagtcaaatgtgtgaagttagagaacaggtatcagaaactgatgatcactcttttaatcagatgcctgcaaccagtgaatgttctttggggcactctggaattccatctctaccttgggtagaagctatctaagagcttagcagagggcatgattagaacctaggagagtttagagctacaaatgaccttatgttatctcctcaacttttgcccagctgctccctaaacatgactctcactttttacctgaaaacttgtcttcctttctcaccttttatctagagagtcaccttcaaagggcagaatcgctggtactgcagctttttcaaatatcaggaacttcaaccaaataaaatgaaaaaggacatattctcctatgctttccacctatgaaccttacttttccctcagggcccaaatgtggctcccctcaattcctatgctccttgttctgggtaaaagagtacaaggggaccaggaacagggtttttacctaaagcagaagggagagagggtgggagaagtatgttatttgagtggataaggaggaatactgagaaggactgcccgctttcaaactgaggttcaaggagtctaagagcttctttgctggtttcttcctttcttcatgttgggaaaagggcttgtggggtgtctgtataaactggccataaaaatatgggacaataagttgtggaagccacaagaggcctctgaggaggaaagtctcctaattgccatcatgttcccatgctcagagggagacccgctttcttatctgtaaacactgtgttcaaggagaaagacactcctttgaaacactggaatgtgaacaggcgtgcaggctcctagttaagcccgctcctactagctgctctctgataagttaaagataggctgtttgagcacaaaggagattcatttaaaccactatcgctgtagattacgcctattacgcattgcctccctttcactgtttcgccctgaacgtctgcttctcagatctaagtgattgtactcaataaatagtgtggagaccagagctctgagccttttgcagcctccaaaagtacaactggccccctggctccccacctttactcttaacttgtctcttctcaatcctttgttgccaccggactttgggtaccctatgggtggttttgaggctggtccccaacactccacaatttctactttgttttttttttgagacagagtcttgctctgtcaccacgctggagtgcaggggtgcgatcttggctcactataaccttcgcctcctgggttcaagcgattctcgtgcctcagcctcctgagtagctgggattacaggcacgtaccaccacacccagctaatttttgtatttttagtagagacaggatttcagcatgttggccaggatggtctcgatctccagaccttgtgatccacgctcctcggcctcccaaagtgctgggatgacaggcgtgagccaccgcacctggccacaatttctacttttaggattgtactatgtcttgtcgctcagtctacttctctgtctgtatgccctcctgtagtgatctcatccctttccaaatgcatattgctaaccagtgctgtctcctgtattctgtagcctttattcccatatattcagctggcttctcagcatatctgaaaccaaactctggattgctcatctccccaaatacctgcttcttccctagtctttctcatcatagtaaatggcaattccatttctccagttagtcatttgtagtccttcttcttttttttttcttttgagttggagtctcaaactctgtcacacaggctggagtgcagtggcgtgatctcggctcactgcaatccccggctcccaggttcaagtgattctcctgcctcagcctcccaagtaactgggattacaggcatctgccaccatgcctggctaattttgtgtttgtgtgtgtatgtgtgtgtttttagtagagacagggtttcagcatgttggccgggctggtcacaaactcctggcctcaagtaatctgccagccttggcctcccaaagtgccgggattacaggcagtagttcttcttaattcatgtccctcctttcttatatcatatataatctattttcagaataaatcccaaatctagcccattctcactgtgctcactatctttcctctgcataattgctgtagccttctgttttccatggtatcatatcttctggtctatttttcacattgcagccagaaagatccttttaaaatatgagtcattgctaaatatttaatgatgtctttcctctgctcacaactctccattggtctcctgcttcactcatagtaaaagccaactcattttacagtggtttatacatttctgaccttatctctcaccattcttcccctcacttactccagtctggctctcctggcctcctattcctggcacatgccatgcctaaaccattgtttccctagctagtcacatgggtcccttcctctcttcctttgcatccctgccaaaaggaaggccttttctgaccaccttatctaaaagagcaactcccacctccacctcagcacttctcatcccccgatactactttatttttctccacagtagtctattgccacctcactattattgtttattgacccttgccccattagaaggtaagcagcacatgggcaaggactttgtattggttatggttggatccctaaggcctaggatggtccctgctagaaagtatcttctcagcaaatatttgttgagtgaatttgattgtggtgtttttttccttccccatatttgaataacgttctgcggaataaagttagatagtcatggagtaggataccataggacaggatgtctgactttaggtaatcattgaatgaatgaatgaatgaatgaatgaatgaatggcaggggtcctacagaacatttaatccctctcttttcttatttcaaagatgagaaaatggagagaggtgtacaaatcatagaaagatgtcttagcttcagtattttgtaaaccctccatagtgctcagcaggtttcacaaaatactcaaaagaatgtcacaggtaaggaaatagaatataaaaagactagcttgtattcaagaatattttaaggctatcatatagaaagttcttataagaaattggtaacggggattctaatgcttcaagtatcacatatttatataacatttgttgtaaattaataaagctaatatctttttaaaggcagtttattagatatggtatgtaattcataaggaatcccttttccccaaattaccctatagtttgaactttattttgtggttaccaaagtctggacttttaaaagatataaagttataatctgagaatgagaaagacaaaatgggaatacagatagatataaaactaaaataaatagaaatgtaaaatagtgcacaggaaattctaaatgataagtgtagattaaaatattctagaggaggctgcacatggtggcacgtgcctgtaatcccagcagtttgggaggccgaggggggtggatcacttgaggtcaggagttcaaggccagcctggtcaacatggcgaaacctcgtctctactaaaaatacaaaaattagccagtggtggcatcaggtgcctgtaatcccagctactcgggagactgaagcaggagaatcgctcgaacccgggaggcggaggttgcagtgagccaagattgtgccactgcgttccaggctgggcgacagagtgagatactgtcttaaaaaaaaaaattctgaaagaaattaggattgggtgacacagtggcccaggtgttaggagatggctgtagcaagggagaaggagtaaaatttgatgatgctttagatagaaggggagaacttagaaagctggggccatgatctgagcagaggcatagtggggcagccagagaatattctagtagtgagtaaggtcattttaatagaaccttaggtcagagagtttaagaacagatgttagtgcacattgtgagaatatttgaatgttacataaaatcatttggactccagacagtcagaagcttttgaaatcttttacgggggctgacatgtgcaaagtagtgttttaagcatattaaactgtcagtgatatacattatggataggaagaggagactgaaaagttctctgtgaggtgatactgacccatgctaggataatagcannnnnnnnnnnnnnnnnnnnttagttactcttctgtgagaagagaccagggtaattttgtggtttttggtatctaggagaactgtggaaataggaaattctatcatgaatgtcattttatcatgaatgccattttgtcatgaaagatgagtttggctttagacatagcaagtttgggatgagagcaatctaatgatgtctagttagagatgtggaactcaggctggatttgggctacagttagtcctaacggtgaatgaaatcttaggagtttcagagattgtagaacagtgtaggctgaaaagatggtggtgcgcagaactttagtgggcagaggaagaatgtttagtgaaggcaactttgaaaagcaatggttgcagaagtagggtaacctatgaaaagaaagcaaaggttcacataattagttggttcaaagtaacattcatccctctctcaattcccccattgcaaatgcagtacatctttaatgtcagatcctggaaaatagaaaatagcaaaaatatttttaaatatttttaaaaagtttttacccagcctgggcaacatagtggtaccctgtctctacaaaaaaattcgaaaattagccaggcatgatgacatacgcctgtagcctcagctgaagctgaggtgggggatcacttaaacctgggaggtcgaagctgccgtgagctatgattgagccactggactctagcctgggagacagagtaggatctgtctaaaaaaaaaaaaaattacttataacccagttagccagagaaaactagtaaaatatttaaatatatatcttaagttactaaatatttcttgtttattgtgtctatgtatttgtgtatttatattgctgtacaagatagtgtttattatttgctgtaaatagttgaggtaagatgattcaaaaagagttcagcggttaattacgtagcttatttgttgacctaatcttctaaatatttaatatatatagaatttcccatattgtctgttttgtttattcttcagatgattgcaaaagggaaaaatgcatctgaactgtttcctgctgttgtgaagaatgtggccagtaaaaatattgaggtactgttttgatctataatttttatgattccttttgttttcatgggaccgtacactttttatgtagtataatgcaacataagatacttaagtatcactagatttttgttatgattaaaatgtccttaattttaaatgtaggtaagatcaaataaaaagtaggcacaatcctagctttggatttttggtagaaaatatgaaaagcaaaacagattgattcccctgagtgaatgatggtaagttgtcgagttttcacctgttcctagaggcccgtttagtttaaattttgttccagggacttaattttaagatagcatatgtccagtgaaaaagacctatttgggtatatccagaccttgatgatttggggctttttgggatttctaggactgagcccaagaatatttcccaagtttctcagactactcatgacatgtactaagcactcagtacatatatgtggatttattgaatgaacacgtcccagtaaaatactgttttctgtaagctacactaatatagtctagtattaaggttacattctcctctccaccctggttaattgataaattaattgaaaaagcctggttaattgataaatttttctcagtttaaagctttaaagcctttccctcaccataaaattaaagatgtgttactgctactatttgtttgccattttattggcagatgatgaagctcattaacaaataacagaaacattctaatccagggaacatggttatggtgacagagaaagtgcacaagcattcttgcacgggcaagtgtgagagcgtaaggaggatgggtgtgtgatttcagagggttcgctaattttgtagttatgattttattttccatgcatagtatggtcattttttggtagtgaagttttttctattttgcgtgatgattttaaatgttcaaagtattcttgccagcaaaaccaaccagagaaaaagaaaacatttttgagctaatgttctttaaatattacttaactaaatgtgattgatagtgttggtgagagaggaatttttaatctcccaatcatgattttgattttttttttttttttttttttgagacagagtctcacttcgtcactcaggctggagtgcagtggtgtgatcttggctcactacagcctcgacctcctgggctcaagcgatcctcccgcctcagccccacaagtagctgggactacaggtgcttacaaccatgcttggctagttttttatatttttttttttgtagagacagggtttcgccatgtggcccaggctggtcttgaactcctgagctcaagcaatctacctgcctcagcctcccaaagtgctaggattacaggcgtgaccaaccgtgcctggcttttttttttttttttttttctgagacagggttcctctctatctcccaggctggagtgcagtggcatgatcgtggcttactgtagccttgacctcttgggtttaggtgatcctccttcctcagcctcctgagtggctgggactacaggtgcatgccgccatgtccagctaattttcatattttgaacagagacagggcttcaccatgttgcccaggctggtttcgaactcccaggctcaagcaatctgccaaccttggcctcccaaagtgctgggattataggcatgagccatcgtgcctgggctgattctggaatgttttatttttccccttaatttagtattttttgcttatttttaaaagtactcctattaggcataactctttgggttttcctgatgaattgacctttttattataaaaaaatcctttatttttgttaatatgttttgtcttaaagcatatttgatttgttattagtattgccactccaaccttctcatttctttttattatcatttttattcatttgctttcagcttgtctgtttatatctagtgtgcacctgttgttgacagcgtatagttgcagccttccctacatcccgtgtgtcaatctctgccttttaattggagtgtctattttgctaacacttaatataattattgatctgcttagatttgagtctactattattctttttcttttctctttgtctcttttatttttgtcttctattcttcctattccttttttgggttaactagaaacattttaaaatttcattttagtttttttccaacttgcatttcttggcatatatgacagtggtcccatatgattataatactgtatttttactgtactttttctatgtttagatacacaaatacttaccattgtgtgatagttatctacagtattgagtacagtaacatgctgtacagatttgtagcctaggagcaataggctatatcagtagtccccaacgtttttggcaccagggaccagtactgtggaagacaatttttctctggacccggggtgggtaggatggcttcaggatgattcaaaagcattacatttatggtgcactttatttcctattattattacattgtaatatatgatgaaataattatataactcaccataatgtagaatcagtgggagccctgagcttgttttcttacaactagatggtcccatctggggtgtgatgggagacagtgacagatcatcaggcattagattctcataaggagcacgcagcctagatccctcttgtgtgcagtttacaatagggtttgtgctcctatgagaatctaatgctgctgttgatcttacagtaggcagagctcaggaggtaatgcgagcaatgaagagcagctgtaaatacagatgaagcttcacttgcttgcccactgctcactgcctgctgtgtggcctggttccaacccctgggctatgtcatatatcctaggtgtgtagacccctggtctgtatcatatatcctaggtgtgtagtagtctataccatgtaggtttgtgtaagttgcactctgtggtgtttgcacaacaatgaaattgtccaacgacgcatttctcagaacattgttaagcaatgcatcactggattatagcattttaaggataggtactttaaacctactttttttttggagacagggtctcgctgtgttgcccaggttggagtgcagtggcacgatcttggctcactacaacctctgcctgccgggttcaggtgattctcctgcctcagcctcccgagcagctgggattacaggcttgtgtcaccatgcccatctaatttatttttcgtatttttagtagagccggggttttgtcatgttgcccaggctggtgtggaactcctgagctcaagtaatctgcccaccttggcctcccaaagtgctgggattatgggtgtgagccaccatgttcagcctaaacctacttttaaaaaaagatttaatattttaaagtatgcttcttgctttttttgggggggaactgtagtggcatgaacacaacacactgtagccttcacttcctgggctcaagtgatcctcctgactcagccttctgagtagctgggaccacaggtgcgtgccactactcctggctatttaaaaaatattttgtagagacgaggtctccatgttgcccaggctggtgttgaactcttgggctcaggtgatcctcctgccttggcctcccaaagtgctgggattatagatgtgagccactgtgcccagctcttaatttttttcattagataggaagtgcattctgtatttcagatagatgaatttttctatcaaaatgaaatagttcttataaactcaattagactaagttggataagccaaaatcaaaacagttgtattcttgtggccagtttatgaattagattaaattagtactgtatttaaatgacttgataaaccatactttctttgtagatttcttgagtaaaatcaattttacttatgattaatttagtagatatttattaaacactatgtgcttgttatatataattctgaattgataattttcaactactctccctttgacaccttatggccatgatatctgagcttctaatttgatatgtttattagttttatggcctgtggtataagaaagtccaaatatctggaaaaaataaacatttaacttagaaaaattatgaggcataggtgaagcttgtcttagtattatcaggaatagagtctcttagtagcaataggaataattgctaacattaaaaaaacctgtctgaccaaggttattagtgccttgcatagatctactccgttttatcctcacaaataaccctgtggggctgtttctgtcattacttgtattttatatatgaggacaagatggcagaaaggttaaattagctgatcaaggtcacacagccagtgtgtagcagtcagaatccaaagctaggttgcttgacttcagaacccatcttagcccattcagcgccatctttcctgtttgatgattcctccctctgttttgtctcttaatatttttgactccttatcaacatctggcattagccatcctttgggaggtacctagtattggcatattttttttttttatgttttagttatgggtagaaatgacgaagtccttagaaattggtggtaaagtagctagttccctgaggacttctagttcttgttgtaaacagaaaattccataccaattattgttccttcagaactgttttactattcaaatagttatcagtaggagaacttttccatttgctcatattttccctttacaattagattctggtagctgcctaatgttctgttacaaaaatgtcaatataaacataattattggtctatttgttttggatttctttcgttctttaaataccttgtttattttatttttttgaaacatggttaagcctttaatgttttgggaaaactgacataagtttcttaaaacttatgttcagaaattgaatgtttcactcctctcaagtgcaaaatttcatttttacaagtacatgctgctttagacacacaggtgagctgtacgtcatctaccattaaatgtcaaatgataccaaaagtgacctagtaagcaatcagtggttatagtacaaaaataatcaaaggtttagtcaataactcatgaagtttgatgtactagtattgataagctaattaaacagatctgtctgtgttcttccagcctactggggctctgctatgattagctttacagcaaggagtgttataacattgaatgaaagtaaccgatcagagaatgatgtagtcacggagctttaactactcccatttctggtcacagaatggtttcagggaaggtaggctttctttgcacacctgcagcctgtcagtgcataggcctcttgtggtcaatattgattgattcttataacagaagtagaacaaatttagtgtttcgcaaccttctgtgatttaatattgttatgctttttgccataacagtcacagaaatccttctccaatagtgagtaattattgcaatgcctgctagctcagctgtggttctgaatgtttcagtgttgccaatataaactctgtgatatattctagagttcataatccagttttaaaagctggctgtacttggtgaataaaggtattgctgagaaataaattgtaaggggataagggagaactggacccattctttctcaaaactttccagagaactgtagagtgagatctgaatataattagtaaagagaaagaatattttaaaagaatattttaaaaaaccaaaccagctgtgttggtgtgcacctagagtcctaattaccagggaggctgaggcaggagtctctcttgagcccaggagtttgaggccagcctgggcaacagagcgagaccctatctctctttaaacatacacccacacctccacccccactcactgacacacacacacccctccccacacacccacatacaccaaaaaaacaaccagactaacaagttaaagactttggaggcagtctttccaaaacctgttgttttcttcatagtatgttggtgtctttctagactttgctgttcaatgaattatacccactggtgtgagaagttagatcctagatgtagcactctaatgggaaatgtcttaatttttttcagtctacagttggtctggaatgtgatccagctgataaatattgagcttttactacatgccaagcaatgtaataagtccttgcaatatacagatgaataagaaatggttgttgtactaaatagcctcaagttcacttccaggcagatgggataaattacttagttaaatacatattatgtgttgatttgatatattgaaactgttgttaatcaactgctgatatattgatatatatttgatatattgactgctgttaatcagtcaaccacgtgttaattgctttctaccattgctgtattcttaggaactttaaatctagttgaggaaaaagtcatctatcctcaaatagttagagaagcgcttctaaaactgatctaagaatttgaaaaacttatatttacacttaaatataatctgaaacattaagtatagtttgaatcatttggtttccatcttatacctatatttgtattcttgtgtaacatcacttggttccaagtgatcatttaaaggaacagtgtttcacaaatatgtgtattttgggtttgaaaaattctgaaggttgagaagcactaatttaaaccaagaaagtgtaaagagtctaatcgtgaatatagatggaaagtacattgataatagagatggggttctatggaatgaagtcattactaccttttactacagttgtaaatttcttgttggatttttaataataatactgcaatgatgtcattttcaaatgagaagatgtgcaattggggttaaaaaacagtgatttaaagcattcttcttttataaatgtatatattataaataaaatataatttttttcctaggttttcagatgctcttaggggaagagttgtctcctcttttgttaggggtaccttaatagaaatatctgcggactgccatcataggccacaacatgtagtagttaggaacatgcccgtttgcatcctgattctgcacttgctagctctgtgactttgggcaagttatataaacctctgagccttactttccttatctttgagagggagataattgtacctaggatagatatgagaattaaacgagtaatataatgtagatgtagggccttacacatttaaattctagctggaaagttatagcagattgaggtgaagaacaaaagctgtcgcaggcagttttcctttcatattctgtatttcctaattaattttaatactagccagaatgacaagggtacttttagaaaagaaaggctgggctgggcgtggtggctcacgcctgtaatcccagcactttgggaggccggggtgggcggatcacctgaggtcaggagttcaagaccagcctgaacaatatgatgaaaccccgttctctactaaaaatagaaaaattagctgggcgtggtggcatgcgcctgtaatcccagctactctggaggttgagacaggacaatcgcttgaacccaggaggcggaggttgcggtgagctgagatcatgccattgcactccagcctgggcaacaagagcaaaacgccgtctcaaaaaaaaaaaaaagaaaaaagaaaaacaaaggctgaggaacttctccagatgaaagaagaccaaggagacatgaaaacttaaatatgatgcatgatcccagatcagaaaaaatactataaatataggatgttattgagaatttctaaatatggattatttattagataataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttaaaacaaaaacaaacaaacaaaaaacctttttcaaggtacatattttcttttctttcttttctttttttcagatggtgtcttgctttgtcacccaggctggggtgcagtggtgcgatcttggcttgctgcaacctctgcctcccgggttccagcaattctcttgcctcagccttcccagtagctgggattacaggcatgggccaatacacctggctaatttttttgtatttttagtagagatggagtttcaccatgttggccatactggtctccaactccggacctcaggtgatccgctcgtctcagcctcccaaagtgctgggattacaggtgtgagccaccgtgcctggccacaaggatatattttcaatgtcatacagatttatttaattttgtatagtggctgaatagtatagtgttatatggaggaactgtcatttgtttactgtttatctactaggactctttattgtttaatttttgctcttgtggaagattttaataagtggaacttggggaagtggaacttggtgaagcgggataacttgggataacctgagtggagattgagataaagagtgcaagttatatttggggactatttctgtttgactaggaaaggaggtttcgaacagattataaactgtattgagtactaggttaagagctttagattttgtttttaaggttttgtggagccattcaacattgaagagtaattggaaaaaggttttttcatttcatttataactctacccgtatagtatagatgaatggattgatatcaacttaaaatggttgtgtttaacatatttatcaatgatgaagatgtacaaagtttgtttgctcattaagttttcatttgtacttatgaattgagaaatagtttggattataaaattatcatctcaaattatcttaacagggtgccaagatgtgttgaatctaaattgttgacaatttctgtagataaatggaagattttgcctttcatttaaaataattttaaaaaaattccgtgaggacagttggattttgatttggtcagcagtacatttggaaaaggtgtatggttttaatcaagaattagtcatatctgtggaagtacctcatctggagcaagttcttatctagtttgttctgtttagactttatttgtagtttgtagtgtcacgctgaaaaaaattggagtgagtttaggaaggagcaaacaggatggtagaggaactaaagctgttatgtttcacgagaaattagggtacaaggaaggaaggtcatgacagttgtctctaaagtagtccagattggttagtatgactggaaatatgatccagtatagtactgtttttatatttccagcaccaattccagctatctccaactttttcccctcatttcttgtgttctttgagtatataactttttttttaattttaaattttttaaatttttgagacagagtctctttccagttgcccaggctggagtgcagtggcacaatcctgcctcactgcagcttcgacctcccaggctcaggtgactctcccatctcagcctcccaggtagctgggactacaggtgcatgccactgtgcctggctaattttttttttttttgttttactagaaatgggatttcaccatgttgcccaggctggtcctgaactcctgaactcaggcaatctgcctgcctcagcctcccaaagtgctgggattacaggcgtgagccactgtgcctggctgagtacataacttttaggtatatactgtgttggtatcttagaagggtaatcaggaatgtgaagatatttgagaaggtagatacaggctataaatagtgctagaaggaagcaatggataaatttcaactcaaattctagtttttgtttatttctttttctgttcataattttgttgtaaacttagtgattaaattacctttaaaacttgttttcaaggctgggcataatggctcatgcctgtaacccctgtgctttgggaggctgaggtgggaggaccagttaagcccaggagtttgagaccagcctgggtaggcaacataggaagaccccgtctctataaaatcctaaaaaaaagccgggtgtggtggtgcatacctgtagttccagccactggagaggctgaggtgggaggatggcatgaggccaggaggttgaggctgcagtgagccgtgattgtgctattgcactgcaccctgtgcgacaaagcaagactgtgtctcagaaaaaaaatcgaaaaccaaaaaaaactgtttccagaacacacatccaatcttcttgaatttttattacgttaaattggtattcatagtcacacattattcttactggactgaaaatatcatgtaatgcgtgttgaaatgtgagtattaccataaaaatcagagttagggctctggactcttttaacagatgaggaaacaagttcccataacatatagttagtggcctgggcccaaattctttctcttattattttttaaagaggtagggtctctctgtgttgcccaggatagcctctaactcctgggctcaagtgatcctcctgcctcagcctcctgtgtagctgggactacaagcatgtacgccatgcctggcttctttcttttatttttatccctcattttgaaaatatttttacaatttagttaatattcttatatgagatctgctcagggattttttattcccttcaagaggaagggacactttgataggctattgctattgtgaactggactattaaaatgcttactttaaaagcttttcctgttgtacttattatcccacaaaatattatttttattttacaatctaacatgtgaccagattcagttatttacttgagaagaattgagcatggattttggtatagcaaatactgagttttaaattttcactctggttatgaataaatgattttttttttaacagatcaagaagttggtatatgtttacctggttcgatatgctgaagaacagcaggatcttgcactcctgtccataagcacttttcagcgagctctgaaggtaaataatggagtgagtaggcaaatagctacaaggtttctgcagagttgaaagtgtgtcagttaaagaagtggagcgataatccactaaatagcacagtagtgtcttgaaagagttaaaagcctcctatagtgcctactcagtacacttagaaaataatttatacaaccaactgaaaccttgctgtatatgttacagcttctgtatgtttgtttatattcaatataattattttcatgcttcaaagagctgtttatcattatactagttgttgaaagtacgcaaaaggggttataagacatttttaaacatgaaattgatgacctgcagcattttattattatgaaagtataaaaacccagcatatttagtaataaatgaccaactagaattataactattacttttctttaaaacattattaaagaagtaaacatttatgtctgtctttttttcccattcctatatactaattgttcattttaaattaagtagctttcttttgctattgtcatattacaccctttaagcacctattaactgtgtctgaaagatatgtttaaaatattgtaaagttgaaattttggtgaatatttttgcactatttttaggacccaaaccaactaattcgtgcaagcgctttgagagttctgtcaagtattagagtgccaattattgtacctatcatgatgcttgctattaaggaagcttctgctgacttatcaccatatgttaggaagaatgcagcccatgcaatacaaaaattatacaggtaggtgcattgttaacaatataccaaagatctctgatgttacatggaatgttatagaccacagaggcttgttttattcgctcttttaggtaggctgctcttacactaagtaaatccagtgactgtatgatggtatttccccctgctgcaaatgttccttacacatctttaatttcgttttggctatagagaccctatgcaggtttttatttgtgaggctgttagagcctgtgataatttatagattttataacttaagaataatcagaatttgaattctcatttatatagtctatctcatgtacacatatgcttgtattattagaaaattgagatttttttttcctgtttagggtagaatcttaagtgtctgatcctctcaactcagttatatgtgttttcctttcttccatctttgttcctgctcctcccttcgttgtctaattcttttccagagctattttattaagtaattttaaaaagtgtagtgatttgaaatatagtgtgctataccatatctgtgtgatattttagaaatgttatgcaatattatacaatgccctgatctctgtggaaaatttactgtccaaatagaattgtctataacaatttggtattattttcagctatcatttattcctcaagctttttgagactctcttctgtttctggtgttgtattcacagtattgtgctatgtgtatttagatgtatgaaaacagtagaggatgtggcacttaattatgaatagcatatcatgtatttgaggaagaagatcaaagacataccaaataattaaaggcaatctataatgaataagatattagcacttgatatatatgtatatacaaaggtacactagcaatgtctttgataggacagggaccagagatgatcatattttgttaccggaaagtaaagatgtaatgagatgggattggtagtgaaatactgctttgagaaggaagacttaagctgaaatttgaaagaattaaaaagtttgtccagataattataatgtttagtaataaatgtgtatgtttgtagaaagtgaaacctcatattcctatgttaactgccagacaaggttttatcatgcttctcactcaccttttctccttagaaacttatgggataagatccatgctcactctaacggcttaaaagtccttctatcattgggcaccagtatattccagcctcaatgcttgcctctccttgccttgagcttatagtctgttagtattctatctcaaatgttttaagcttattactacctcttatttttcctagttttagttggcagattttataatgcatgtctctatcagtgaactagtatgatataaaattcttatttggaaattctccatatttgtttttgggaagtatgtatgcatagtaaaataatgactgctatctagttatttttttcctcccagttgaaaagagtttgtggtttatctacttacagtcgctttcttgaagttttccaactcttttagaagtgaacttgttctttcagtactatcttaactaaaccattgatatctggtttagttaatatgaacaatattagagggaaagatgaggacacattcatgagaaaaaccatcccattttatttgtttttctttatttctaacttataattcttgctctcctttccctctttaaaaatttctcaacatccttgaattggtgagcatcatgtaaagctagaattaaagggaaaaattaatatgttatttttgtattttttagccttgatccagagcagaaggaaatgttaattgaagtaattgaaaaacttctgaaagataaaagcacagtaagtaatgtctttttacgtctttgacataaaaatgtactttatttacatagtatcatttaccattatatattttatatagttgtatttattgatttcaaaatggtataaatattaatggcacacaggactatttttaaagaacaaaaattttcatgtaatgagaaagactgcatttggagttttagatcgttatgtgtttcttcatcagaatctgaaaaaaggcaagttgagaaaaaaatctttaacctgtggctaagtggttaacatggtaagatcaaggaatagaggtgacctatgggggatgtgagttactagtgtactagtatcttagatggggcttttgtacccactttatatttctcaaaactactgaggaaaaggattccagctcatcttaggatgctatcatcagggagtatgtactatctatgcatggcagctatctaatacagtaggcagtagccctgtgtagctgtaactattggtttatggcttagcatttgatctatcctggataatgttcaataaacatttgattagaatgtgtattctgctgttgttgagtggagtgttctatagatatctgttttttagtgttgttcaaatcttctactttgctgatcttatgcctacttgttctattcattattgaaaacagggtattgaagtctctttaattctgttagtgtttgcttcatctatttaggagattggatgtttggtgcatgtatgtttataatttttttaatcttccttttgtcattgtaaaatgttcctctttatctctagtaacatttttttgttttaatgtctgttttgcctgttataaatactactattctagcttttttatggttgctgtttccattatatatctttttccatccttttactttcagcctgtttatatttttgcatctattgtatgtctccatagacagcatatagttggctcttgtctttttatccagtttgccaatgtgtgcctttaattggaatgtttaatccattcacacttattgttgttattaatatagttggattttaagctgtcattttacttgcttttatatgtttcatgccttttttgttccttatttctcctttattgctttttcttagattaagtgaatatgttctagtgaacattttaattcttttcatggtttttttactatatatttttgaaaatattgtcttatacatggagattatacttgtagtttcattcctagaccatttagtaaatttctgttagtctgtagtgtaccagaaatcattattgcatttcttctatgcatagttggtataacgtaggaggtaactaaatatagattgattataaatgaagatagagaaaagaaatttgattcctttttgtcttctgtatgacaggcatgctatctgccagatatgaagtcaatattattaatattatggttaacttgattttaataatttaaaaaaatacttagtgcttttctattataagtgcaagagattggctaagtaccatggagagtagtaagatctacaagaagcagatctgtcattttaatgagttttaccatcatttctgctacattatagactaagagaaattctttggatggcctgggaatgaactctctctgtataatatgtgcatgtcttcccagacaggatacagcatatcataggtaaaaacaatagcgtttgaatcagatagaactggcttaatgtctgagcatctgccacatagtatatgtaccaattctttatgagttttaggctccagatttgtagggtttataatatctaatttatacatttgctgtttgtgtcgagagaaagaactattgtatataaaacccttagcacagtgcctaacaccacatgggatgtgattaaaaattccaaataagaaataagtactcaaaaagatgtaaagatacaatatctgtgtaaaattggaatgtctgtttccaaaatacaccagaaagtaaaaaatattgaatacttgttcatcacaggtatttaatatttgttgaatgactgttgaattaatttgttacattcttggtgatagtaattaagtgtgtagtatcgtttttaatgtctccctcacccccctgcagtggtttcatgctcagtgttcataggtagattctttgggggctttggtggcctaccctttgtgaggcactcatttttcctaaagtgttatatactatatgtttattttttttaattaagaatacatatttctttttctgtctatagtaaaaaacaaagtttttactgacacctgtaattctggtggtatagcacagagttccttccagcctccttcctttttatatttgaaactgcctattcaacattaagaaatgtggctctggccacgcaccattgttcatgcctgtaatcctagcactttgggaggccaaggtggatggattgcttgagcccaggagttcgagaccatcctgggcaacatggtgaaaccttgtctctacaaaaaaaaaaaaagaaacaaacaaacaaacaaaaaaacaagaaacagggctcctatttccacaatctgtttacatttttgctgagtctcagaatgcagagaaactattgcttcagaattgctagcactgtacctctgtggggtatacagtagcatggggcctaataattagagttaaatatttaattagagttaaatattagtttagagttgtttttgtctttaatcttttttttaatgtatggtaaatcaaaattgcttcaactatttatatctttgaactcgttgtgttggtatgtaagaaagctattgattttttttgagtgataaattttatattctgcttttttactgaattcttctattgtttgagttaattttctcattcatcctccttgggtttttttttgcatgacaaagagtctttacttttaaatgattatcagtacaccaagtagtaacatgtaacaagttcttgaattctgtcctctttgattaagtaactaaaactggcccaaacaattatactagtgttcattgttctaaccactagcaggaatggactaccagatattgcagaaaaaggccaagacttcacccctcttctgcctaaactgcttccagatggttctcttctcctgggtctcctctactttaatgctgcagctgccttgggatcgcagggcagcagcctccttggccttgaactctttctccctctgcaggcaatattgttcaatttcaccttgaactgctgctttggcctgcttctccctccggttctttcactgcaggtctcagacacccttttcagcaacctgcagcagctactggatccgctgagactgactggccatgacagcaccaactctgaggcagaagcaagcagcctaaatctctctctctttttttttttagagaatgaatcatatctgcaaatagagatgttttacttcctctttttcagttcctagaactctaatttctcttgcctaattatattgtttagtgccatcactacagttgtgttcaatagtagtggagatggtgggcattcttgccttgtttcagtctaaaggaaatgcttacattgtgtttgcattaagaaagatgctggccctgaagattttatctttgaaatatagtacttttgcaaggtacttcaggattacttgatatgggtcaattgttttgccttggtactcagtgagtcctttcaaaatgtagattcagaatttttattatctctggcaaagtgtttttttttaagattataattttaaatattaattctgttattttttttctttttcagggattcctattttatgcacattggatcttctttgcctgttttacattccaatcattgtgtctctaaacctcttctttctttatctcatttttattcttttggttctttttctacctttctttaataccccttttaaaattttcattcagtaattttattcgaagggcaccttgcaatttagtcttcacatctgattatttttgctctcttgatttctttcctgttgtcaatcaatcctgatttcttttgttaatttataactttaaaaaatttataatttatatttatatttcctatcttcaaatgcttctcttgagggtatttaattcattttgaagtgtcgtgttgtttccttttgcttcatcatttatatttctttgtcggtaatttttgccagttgaattgttttgattttcattttctgtttttagtacttacagattacttgcatcttcttatttctttggacaggattggtgatttgattttgaggtagcttgcaagattcctagtacaagagtaccctctctgttagaattacaaagtatgttttcttagtagatggccttttggtgggagggcgtgcatgcataggaccagtatatgtccccaaactatttcgagatatgttttgtagcagcctaaatttttctctcttcttttcttttctgcctaaaaaagaagggtcttactctgtcacccagggctggagtgcagtggtgtgatcatggctcactgcagcctcgacctccccagcacaagcaatcctcctgtcccagcctcctgagtaaatgggactatagacatgcaccaccatgcccagctaattaaaaaaaattttttgtaaagatggggtcccactgtgttgcccaggctggtcatgaactcctgggctcaagtgatctcgctttggtcttgcaaagtattgggattacaggcgtgagccactgcacccagcccctcttatttctttttttctgttatttcacagtttccaaaggactgctctccccttacttttttttttttttaagctaattttctccgtgaaactttccctttctacactacctcattgaatcatcctctctttcaagtctttcccttataggctgctctgatctaccaagaatcttttccagtattttcacacttagggtgttctttctctttctgttgttgattttcgtttacttttaggcctgccattaacttctgcttgctttgttccaggcagttttttttctatactgttggaggtctttgtgaagttttgtgatacaagcatgaaaatagttatctggaatttagggtttatatttctacttatatataatttgaggtttagagattctctgttttgaagttaggcttaaagcatgggttttggtcccttgttgtttttttttttggatttgggttgggagattcagacttacttaggcatcatcaacttctctacccagtatttaaattggctgtattttgtgaatgttttctggtaattttttcttttgtgtgattataatccattgtagaaaggttaaaaatattctacacagatatttgtggatcatatcttaattattacctttttttggtcacatgtaattcttcattgaaggaagacaggtacatttctcccctgccccccaccaccaaatttttaatgtcagcattggcatttaaaatcaatagaggatcaaaaatcactttcatttaaaaaatctcccagttaaatgtaccaggtctaatttatttccacattttgaaaaggaatttatttgttgccagcagcagttttttgggatcattattacgatgatgacattggtgttgctgctgatacatatacatttgaaagatgttgatctattaaactttcttcatttaacctctgttgattttgaggcataccatctgttgcttcttttaggctagaggatattttctttcaattgagatctcaaagaaaattagttccataattctcattttaaggaaaggtggaattataaatatattaaaatataatagaatggcttttctcttttactaaagaccagtatgtgtcatatgaatagttttttcctaaaaatagaacattttagtgttatttaggtaaaagatattacagaaaccttacaactgtagtcagtgaacttaaaagggggcatctaatctatattctgtcatctccaatcaactgttaccatttttctttatatgaatttttattgtttattcttaaattttataccattttcatctaccttctcaacatgtcctaaacactttcctactttactacaagccttttctaatgttcacgtatgaatttatttttaaaattaataagtttctcttgtttttctttaaaatgtagcaatccatatttgttgacattcttttctttagaacactttagaagcagagtggtatttatttccttttcctttcaagttaatcctaaataaatctttttgataacatcgaactttctgatagaaaacagagtttcttaggaaaacaaattaggtcagtgcctgctgaaaaactgatttatgtatatatttttgatgacataaaatttcctctttttgatttttgctataaaattatgtttaatgaatagattggtagtgtatagctaaaccgtagggataagacacaaattttaagttattgatttaatgttgataaaagccccaccgttatgtgcaaaaaacacacccctgagtttgtacagatgttttattgtgatagatctattatccagctattagaagataaatgactgatctttcccattttccatgcctcaagaaaattgaaataagaaggggaatatcatttgggctgtatgattagggaaggttggatggccattaatttaagggaagaaaatcttggcagcattggccaacttataccatattatcaatcaaaccttgatgcacttcttgtgatgacccagcactctcaggtttttgcaatgttaattagaattcatgacaaaatagatgcaaggaaacgttttgtacccttcataattttatagaaaatttattgttattagaggaaccatttgcttagtgtgatttttttcattaccagcttgtcaactagcatagataatctagagaaaatatgaactccatagatggggtgtcacttttgttgatggttcatgtagtttaccttggagcacagctaatggctgaagttcatagcaacagcacagaaaaacgtggcaaccaagggaagataaatgaaccatgtttattgctttaatataaaaaatacataaatggaaaactgcatttgaatttgatgagctcattgctggttttgttggagtgatttattttttcccttatatgaaaagctactattgacacagtgagatggaagttaactgtctgttttttggaaaccagtatttttggttttaaaatctgagtagatcatttaattttaattctgaatattttatagaatattgaacatttaataaaccaaaattattaattttccttgtagtgtttagcccagggtcagattgttaaaactatatgattaagtatctaaaatgatcagttttattttgtaaaagtactctctttatatgctttttaattattttgatgttttcttaaactttatttggttctatttaattaatgatatttgttagtaccttagaaggtgttagtactttagaattattgtgtacatgtagctcttggtttaatgaatttaatattatatggtagctgattttccatttaattgtttagtatcaaaacacatttggaagaaaataattgctaagacagaataacttgattttacatagtattttaaaaattgaaactgtgaattacctgttcaatttcatggatcattttatcctagatactatcctttatttttgcactttaacaccctttaccaattgatgttgatattaatataaggttgataatacatatatatagatgtttatatctcacaatgagttattctagagtttaatgtcataaacttagttgtaagatattttaaaatgatactaattgtcactttatagaaatgtaattatcacaaaatgtaatttctaaagaaattatgtcttttgcagaagacatcaaaatgtgattgaaagcatgagcttaacttccttgccatatctataacaaataggaaaattatatatatannnnnnnnnnnnnnnnnnnntcaataaaatgcagcttcacgtttaatactgaattggtaattcataaaatcccccacaggacttgaaaacttgtttagcataatagcgagtctatattctgagctgttttctttcaattgtattgttggttgcatattaataaactaaatgtcagccaactagagggacaaacactcaaaatatgaatatcattgtatctaatatttttcaaaaagtaccatttcagtaagttatatttctatttaattgcttattttaagtcattggggaaattttagacactaaagtgaagatccctagtgttcagatagaatatggtattaatttgtttttcaaaactgtattatattgtgggctaactgcacatatatcatttgtacgtatagagaagtatttgtataatatatattctgcttagtttgtgtctttagagtaaaggaatctcaatgttaccactttgtaaaagcatcacagttcagaaactaacattatgattcattaactggtgttggaagagcccccttttgttagtaatatattattccaacttatacacattgttatgaaagtgataagagcccaggtgatgttctaaaatttcagccagtgtgttttctttgtaaataaattatattgggtaaaaaccggtggattaagatgtatatgatttgaaagtgttcttctattaaaatttatgaatttctcatatactttttaacataagttcattttagaatgattgtcgttctcattttaaactgacacaatgtgagctttgttattgtcttgattctttttctgaatattatgaacaaagtactgaatttttagattagaatttaggttagctttaaacatgaaaaatgtgcgtgattaatgtttaatccacatatgaacaatgtgttgaaatttaacctggtgaaataaacacatcagaatttacttctcttcagaatagtattttctagacatattagaactattaaaattattctttgacgaatagtcaccataaagtttgttattcaaacatgaacattcattttaattgaatgactgaatactttaatactgattggcatgaaactgattactataatgcctgagtaagacctttgatgtaggggagaaacattttttaataagttactatttctttcttttctagttggtagctggcagtgttgtgatggcttttgaagaagtatgcccggacagaatagatctgattcataaaaattaccgcaagctatgtaacttactagtggatgttgaagagtgggggcaggttgtcataatccacatgctaactcgatatgctcggacacagtttgtcagcccttggaaagaggtaagtgttgaacagtcttccactttcaagtatactaagagaatggatgagctttttaaaacttgggcaaaaaattaggagtagtaaactagagaaatctgcatatttaaggaagactcatttgtctcttgttcttttactaaagcaggcaaccaatataaatgcaagcataattatccattattttggcactgattgatacatatttattggtgtaagtatatacacttttagtttgatactggcaagaggcccttgttaggaggagcagcatgacacagtgtttacagtgacattgccaaaccatggatttttttggttactagttactttcacgtctttgagccccagctattccaggtactcatttgtaaaaaaagtaggtgatgtgctcctatagcatgtgaatttatacctaaagtaattaatttcttgcctctatagataaatattgttgaacttttaaactactttttcctagttttgtatttataaaatgtttgtgttcttctcttcactttagctggtagcatttagtaaaattaataatttaagtgaagctatttgttttctttgtgcagattaacattagaagtacgccttattcttttttttaagtatgccttattcttttcatcatattgacaatttagaaaattttatcatataacttgtaattaagatccttaggatgtatacatttaagatttaaggtaattttaaaccagtttaaataaatccttaaatgttgtaagaatagcacattcattctagtcttttgatgtcttatctttttaaaatacagtattatagattttaaaaaccaatttgtgtaaaaaaaaaaaagatttttaaaaagctcctgttatatcaaagtggtctgtatacatacttatgacaggccttgagtgctcagtacatcttgcttttgttaattagaaaaatgtaaataacatggaaaaatgtatgatacatgctttaaatgacacatcaagcttgcaaattattataaaatgttgatcactattttctatattgatttagtattagcattaaaaactgtttagaaattttaatacttctttatccacaagacagtaatactgattttcatctcacttttaatattaacaaaatgatgattatgttatccatcttaaaaattgaagtatgttttgaattattaatatgtaagtcttatgttacataatgctcttaaattgatgaaattttactatccttgtcaactttaattttataaagttaattttatttatcattgagcaaagtacagttttgatggcacttttgctagattaaggaacatctctatgatgaaaatgtcctggcccttttatgataactttgatgagagatttttgttgccaaacagcttatttgtttgatttcagccaattcctttcaaaacttctgctcagattttttttctattgtataaagttataggcaatttttgccttagctaatcactgtcaccatttaaatttttaaattttactttcctatcattttcagtaactatatgcaaatgatcctttgcttgtaattatatagaaactggagttaaaatatatagtgtacttaccatacctgctaaaaatatgtaacccgtagtaaaatctctgcttttgtatatttgtctgtttatttgtttttctgttccttgaattttatcttattttagataaaatttatttttaaagccattgcaaaggaaagttaagttttacaccatcatatacatttgttttttgacagataatttgaaaaattgggactgtattcattcttggtgttttcacatgttaactccatgaacatgaattaggacaaacatgaggtgaagtctggtcattgtccctggcatactggaatgggctaagtcatttcttttctttgccacttacttgcaatccaaccttggaattattcgaaatgctgtgctcattagactaatttagtggttttccagtgtgcacatcagccctcaggatgtgctagcactgccacaggaacgagccaagcagggcaggggtgctctagactgtgcagctttttgggcttttgccactgtttcaaacacagaagccttttttgccttcctttcttatgcagcgttgaatttgatttcctttgagaaagatccattggcttaaaagacagatagaaagaaaaccactttaaatagaagatttataagtttagctaatttgattcctattattgttgttgttgttttttaattatagaagcaattcaagtacatgttcccttctcgtaacctcttggttgacgccttagaggcaattattggtaactgtttaatttcagttactctggtggttataaattttactttggataaaacattttgctttatttattaatttaagttgatatcagttgacctcaattcaaggaaaaattattcatcgattgtgtaagtgctatttgagggtctcgtttagcccagaataatcagtataacaggcttttgtctacatacgtacatatgttcagttcagaagcagtgtgaaagatttgaaaggctcagcccttattgcagtattagaatcaaggattgtacaatatgttagactcttgttataaatatattttataaaattaagattcaaatgagtggtcaacactaggaccatgtctgtgctctcactcttccagttaacccatctcaggcttcctctgtgctaattatgattttgttttactgagaaactttggagtgagcagtgtagccatttatagtcttcagtgctttctgatctaggcttgatgttgcttccaactttttagtgactacacatggtagttttagctttagaagttggcagacgaggccgggcgcggtggctcacgcctgtaatcccagcactttgggaggctgaggcgggcttatcacgaggtcaggagatcaagaccatcctggctaacacggtgaaaccccatctctactaaaaatacaaaaaaaattagccgggcacggtggcgggcacctgtagtcccagctacttgggaggctgaggcaggagaatggcatgaacccaggaggcagagcttgcagtgagccgagatcgcaccactgcactccagcctgggtgtctcaaaaaaataaataaataaataaataaaaataaaagaagttggcagactaaatctcaaagcagagtttgaccatagctagaagaaactgagaagtatttggcatttatatttgcttgctctttcttatgtgatgttgtaaaaggaacaccatgtagtaaagaaaggttaagatgattatagaataaaaagacaaggtgaaacagtactctagcagaggcattcctgagagtttacctctcttttttatccttttaccatcaacacttgaatgtgttgtttcatggaatcatccaagtagaaatgtcttcactctagccctccattcccttttacctacaggcagaagtcacttacataaatgctatataagcaccattttatgatgaattaagggccattttaccttgaagtaaagaatttgccagtaggaaaaagtgtcactaaaacaatgtatcgacataaaagttaaatttataattaaaaaaacctgcctgtaataccgaattcatttaaatccagcagttttctctcagatactaagagaaaatgtgaaaaataatactgtgatgctttatatttaatggcttatcatttttgctgtactttcttttcttctttgttttccttttttgggatagagtctgtctctgtcacccaggctggggtgcagtggtgcgttcttggctcactgcaacctcttgcctcctgggttgaagcgattcgtctgcctcaacctcccaagtaggtggaattacagacatgtgccagcacacccagctaacttttgtatttttagtagagatgggggtttcggcatgttggccaggctggtgttgnnnnnnnnnnnnnnnnnnnnnnnnnnnnnnnnnnnnnnnnnnnnnnnnnnnnnnnntactttcttacatagtattccatttgccatagggcaatcagaattattatacccattttatatatgaagaaattgatatatacagattttagcaagtcacttaagacaatattaattataaaaggtggagcagaaatataaacagaattatctgatgcccaggccagcattattgcctttatattttgttaccctgtgacttgtaaattaaaataatttcttagttaccttaataagttttctgtgtttgtttattgtgttccggtcaaaaccagctttgaggctcccaatccatagtgctcagacatgcaattagctaacaaccataattaaatttgctctcaaagagaaaaatcatgtttcctattgaatttttgcaaacatttgtttacgttaatatgcttgaagtgtggcaaaattgttttttgttgaggaatcgaaaattcgtagatacactttttgagatgagctgatgtacatgcttttgtcaataagttctcaaatgaacacatcatatacaaacaagcttcttcaggggcagaagagatttttaatttagtttatttgcatcattatagatcagtatttaggctgtttatatgtaaatgtatgatttgaggaacaattaagtgttgacaaagtagattgcagtcatatcaattgcagtgcattttccataatttttctaactgacatctttgatgataaatagtggatgtcaagtcaaagctgattatacagtgcactaggaattcatggggctgtcagggagaagaccgattgactttaaatttacatattaatgagaagatttgttaagagggtgcttgactatagaaaataacggcgtatttatagggcacgacattttataaataaagctgatgcaggaaaatggaaattaaaccttttaggttaataaattcaagagactgctaaaatgcacatttgcatttttattttcttaaatttaccttactctttgcagtccatgtgggttgttttttattctaggtcaagtttgtataattttcaaggatataaaattgtttaagtattttatttgtcattcaagcctattatgggagatttcttgaagcataaacctagatctctaagactaaagttgcttttgtaaaattaatcgatttaaaaaaataaatattataaaacacagagtaaattttaagagtgatttaaaataaaaaccaacatctgttagtggcatcaattgtaaactgaaaggaaactctgacactggggcctgctaggaatgtttttaattgcatgaatctagctttttacaactgaactttctctgggagatgagaggttttcaagaattatcaaaatattttacttcagtgatttggaagttaaaactctaaatatttaccattattttttagaatatgaatccgggttatgtaattctggtggcagtatttatgccagtttaaaatttggagtaattaattttgtctctctctgtatatctgtacatcaattataaaaccttacataagtttaacaaagtccaaatttagaattttgtttaaagtatttttaaggtaagttcttaagtttttcagtggtagccataaaataacttatcaaaatccaaaatttataaatgtagttttttgatgagcaattttctgtaggtacagaggtacttcagggaagtacttcatgaactccacatccagatcctgtcttaacggaccaaaatgttagagattattgagttttaattttctttactgattaattttctttgttaaaacaaattttgtcatgtgtcttaccaatggactatagatccacgattctgtggaatttattaaaaaaacaaaatactgagaagttgtggtagaatacattctttacaatgcaataagagcagttttttgtgcactgttttaagtaactgttgacaaagggttcaacatataatttaaggtgaaactaaggaccatgatctaatattgaaataatgtctcctctcttcccattggttatgaagcatttatcgtaaagattccgtattctttttgttgtttataatttattcctattgattggaattttttttaactcatgaagttttcttttttaaaaaagaaaactttaaattttaccaaggaacatatgcatggtttaaaagaaagaaaatgaatagtactacaaggcttatgagaaacatttttctgagtgacccttctcaatgtctgaattagcttcctcagttcttttcccttctgtgtgtgagctcaaaagtatctgagccaggtctcaatcaatttagaaagtttattttgccagagttagggatgcacctgtgacatgtgcagcctcaggtggtcctgatgacatgtgcccatggttgctatagcttgcttttatacattttagggaggcataatacattagtcaatacctgtaagatgcacattggttcaatctggaaaggcaggacaacttgaagacggggcttctaggtcatagatggatttaaagatttctgattggcaattaattgaaagttaagttgttatctgaagacctggaatcaatagaacggaaatgtctggattatgataaggggttgtggtgactaaagttttatcttgcagataaagcctccaggtagtaggcttcagacagaatagattataaatgtttatcagacttaaggtctatgttgatgttaatgctggttggcttttcctgaattccaaaagggaggagggtgtaatgaggcatgtctgacccacccttcctatcatggtctgaactagtttttcaggttaactttggaatgcccttggtcgtgagaaggggtcccttcaggtggttgtggggtaagaattttatttttggtgtgtgtgtgtgtgtgtatttacctttctccatttctaggtaatagacatatattgctatttcttgatttatcaattttaggcattatgtattgacttcctattatagaaatggagaatttgtcattcttctattaccttatgcttctgcttacctctttcatctttggaatataattatattagaattttttcaatccataggtgttcattttcctatgatttatgaatattattcagctgtataatagcatttcatctcttgtggaacttttggttctttttggaatcaaaaattgcttcattttaaatttgcttactttatcatgtcactatatgaagcattccaagttctccgttggaatattaaatattctccaaatattattttatgtgcagttgttgtgatacttcttgtctacccaatgtcagttctacccctcccacttatttaaataacaggatcctgattttgttcagagtagttatatgcctaatgaaaaataatcaacgtactaaattcctttagagtcagaaatgggtccacatctggaaattgggattctggggaagctattgtttttctgacagacttatttgacatatgtatattttaccctttgccctttctcatgattccttcccagaatgcatgtgtgatgattagaggtgcagtagtcatgttacaagcataaggataaaactatattctgggggtgggcagagctgaaaaacaaagtgtttggggcaacttttcattttatggagctacctaactagatatttctgttatatatagctgaacacagttctgactagtacagttgtcaagtatatcaagtatttcaacagcttcattttcttcccaggagatatgttcctggagtcttcaccctctgttctaatctgattgcttactaggcctgcacagttccaatctgtttttctagaacttaatttcatgtctcttctgtgttgaatcctatttcttaggctttcttcttctctctctctttctctctctgtctctctgtctctgtctctgtctgtctctctcctttcttttggttttcctggctttggagcatatcctccaatgttttcttaagagtgggtagatgggagataaaattttgagactttcagtgtcactctcacacttgattgatattttacctgggctcttggattagtattctcttaggccttgtgcatttgaaaatggtttattgtttcttgtatatttgacatcttgctggttatggtactgttgggacacacccttttcttcttttgagaactctgtagacattacttaattttcttctgcaatgaattttgctgtgaagaaatctgaagatagccaaagatttttctcctttgcaggtgacttgattttttttttctgcatgctaaaaaaacctgtttaaaaagtctttgagaattaatcaggttacatctcaacgtgagttattccatatgatctccaggttcacttcttccttttattttagggaattttcttttctttttgtaattttaaaaattcgatgtttacattttttttctgcttcatttgtaagttatatacttgaggaatacccgttattctgttttataatctttgtctaccatgtccatcatatttttagaaaatttctttaatgtttgtccttttttcttttttttgagacaggatctcactctgtcacccaggcttgagtacactggtgtgattacagttcattgcagcttcgcccttccaggctcaagtgattttcctgcctgagcctcctgagtagctgggaccacaggtgtgtgccatcatacttgataatttttttttttttttttttttgacactgagtctcgttctgtcacccaaggtggagtacagtggcacgatcttggctcactgcaatctccgcctcccggatgcaaatgattctcctgcctcagcctcccaagtagctgggattacaggtgcctgccaccacacctgcctaatttttgtgtttctggtagagacggggtttcaccatgttggccaggttggtttcgaactcctgacttcatgtgatccacccgcctcagcctcccaaagtgctgggattacacatgtgagccaccgtgcctggcctaatttttgtattttttataaacacaggatttcgccatgttggctaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtgttcttagtaacgtgttgagtgatatgcttttgacacttacatatagtccgtttatatgtgaggagtgtggtcaggggagaaagatccttcttcctccttgccctactggctgttggaggtaatcaacagtctctaccacattctccataataacctaaaaaatttttgaagacactatgatttggaaagaataattgtttcatctgttaagatatatactattcatgtatatatatgtggtataaatattagattaaaatgaagtgttctgacaaaatttttttatctcaggagtacacctcctgttccctctagattttgaaatggtctattttagtttgatcacaatgtagtatattttaattcattaaaatagatgtctggtaggtgaggaaggcctgatacattgtaggttggaagctcttaattaatttataagtgaaataatggaccttttctcattctcatttattaggaaatacttcaggctgtgtcatctaagttgctgattcattccaatttttaaaatttgttgtggaaatgttcacattaaaaaaaatcagctcatactgacctttgtgaaacgctttaaagaactctgttaaaaaatgttagttaaaaataagttttcttgggttgatgtccttcagaaacaccaatttttcttagataagtaacttcatacattttcatataaagtacatagaaaaaccattcctagtatagtagagctatattctgaaaaaaaaaaatttttttagacaaaataaatcccctttcctcttcaccctccatccccatgattctgtgtatgtcctgctgaaaattcatgtacttgtctagcatggggcttatagtatgctgtatgtaagcactaggtgatggtgctggttagttatccatttgacatgctgaccattttctaatttgaacagttctagccatgttgttggaattaaaaatttagggccagacattgacctttgcttttttaacatttcctttagtggttagctactgccttcctcaacccagtggagaccttgacagattccctattacaagtaattgcttccagagctagttgttattcctgttaatttatttaggggccagtaaagtttagtgcctatatatataaaaatatatatttgtgtgcgtgtgtgtgtgtatatatatatgtatatatatatgattccatctttaaaataatgtatttattgatttaatgatttagtttttatttttatacattcagcttacttagtaaaaggcaaaagatttatacagtctgaagagaaaccagagcatgagcttacttagaatataaaatctctttagtgagtttatattagcactttctctcactttctgtttcctaaacatcctttttgtgtgactagccttatttttgcatttcttataattttaaaaattgtatctttatgtcgtatattgttagtgaacttttattactgttttatgtcattttgggtttcctaaattttcaagtttttcactgtaagtcacagttccaagagaaacagataagttgtttctaatccatattttccccaacattttattttaagaattttgcaaatggaaagtgatatcagtaaaaatggcagagtagagaactcccaagagcttgttgctccacagagatacaagaaaatctgtaaaaacagtccaatcagctttttgaattcagaaaatagtcaaaggtttacagcaaccattcaaacatttaagaaaatggggcctgaaactcaggagaaaagatttgtggcatttaaacttaccctcactctatcctcccttctctgcctcagtgacaggggctggatggaacagagtagattctgttcgcaaagaggtgtgattatttgttttgacctgcctggaggatccctaatgcaagggacatgcctttattttgctgaaatcataactccctcagaacaaattatctactaatgccccttggggcaatagatatcaatgggagtaaacaatggacatgccaagaagcctggaacaaaaggctggaggatggaatgctttggggaataagggagttgagaagctcctgtggataatatgggatctagaaagtccatttcatgcgtagggttagacacctactcagaaaagatctgataagaacctaagcttttatgtcagactgaccttcaagctctgcagaagaggaagtgatggctaaggcaaatttttaaatggcccagctaagttttaggcaaactgcaagctaacaaaacagtaaacacttccatgaccacatgcaacaaagaatgtactcttttcagaaatagcttagaaacgactgtaaacaaacaaacaaaaacctgataggcagcaacaataatccctggggaggagttagaatctgagttagttaccacattataatattcaaaatgtctagtttttagcagaaaacgatgaggaatgtaaagaaacccataaatttgttccatccacaagaaaaaaagaaagtaatggaaactgtactcaaggaagtccagacattggatttgctagcccaagggttttaaatcaccatgttaaatatgctgaaacagctaaatgaaaccaggaaaacaatgactctccaagtagagagtatcagtatgtatagagaaatgatgcaaagaaaccaactagaaatactagagggaaaacgtataataacttaaatgaagtattcacaagtagcaatcaacagcagatttgaacaggcagaaaatgaatgggtgaacttaagtcaattgagattatctagtctagggagtagaaagtcaaaaagcatgaagatgaacagagctcaagagacttaagaggcctgtgtgatgacatcaagtgcaccaacacacataatacatattccaggaggaaaggagagagagaaaggggcaaatagaatggctgaagaaaaaaatggctgaaaacttcccaatttgatgacacactaatcaacacattcaggaagctcatcagaatctaagtaggagaaattctgaatgcacaccaagacacatgatatggtttgggtctgtgtcccccccatatctcaccttgaactgtaataatccccacatgtcaagagtgggaccaggtggagataattgaatcatggggggcagttttccccctactgttctcatgatagtgagtgagtttcacaagatctgatggttttataaggggctttccccttcactctattctcattctctctcctgctaccctgttaagaggtgccttcctccatgattgtaagtttcctgaggcctccccagctatgctgaaccgtgagtcaattaaacctcttttctttataaattatccagtcttgggtatttcttaatagtagtgtgagaatggactaatacagcacataaagatcacattttcaaaagctaaggacaaaaagagaatcttgagagcagcaagagaagtgactcattatttacaaggtttcctcaataagatcaacagctagtttctcattagaaaccatggggccagaaggtagttgaagaaccatgtttgaagtgttgaaagaaataaaaaagtcaacaagtaagttcttctttggcaaaactttccttcaaaaatggagaaatcggtacatgcctgtattggtataaacagtccaatgttttagatgcatttcaaagtaagatgcagacatcagtacacattacacctaaacacttcagtatgtatatcattaattagaattcaatatttgtttatgattattttccttttgttgacataaaattttcacagtgaaatgcacaaattttagagttttgataattgcatgtatgttagtaacacacacaaacccttttcattatatgaagtattactgttgtgcttccaagttagttgtttgccctcagatgcaagtattgttttaatttttttcattatagtgttgtattcaaaaagtaaaggatttgaggtattaccatactcctgcatttatacacacacacacacacacacacacacacactgaatatatggcatatgtttagtgtatgtacacacacaaaagcagaaacactgatgtgtggatcagagaagagactttttatttactcatggttatcttagtgtcactttcctgcacttcagttccccatgagggtgatgttatgagggttagtgccatctgtatatcttgggggatggggagttgtaatacaggagaggagctcctcctaaataaatgaatctcagaatttatataggattgtgtattagtccattttcatgctgccaataaagacatccctgagactgggcaatttacaaaagaaaaaggtttattggacttacagttctacgtggctggggaggccttacaatcatggtggaaggtgaaaggcacgtctcacatggtggcagacaagagaagagagagcttgtgcagggaaactcccctttttagaaccatcagatcttataagacttattcacgaacatagcacgggaaagacttacccccatgattcaattacctcccactgggttcctcccacgacacatggcaattgtgggagttaacagttgaagatgagatttgggtggggggcacagccaaaccatatcagactgtatacatctcagagcttatataggactgcttttgcatcgctcctcctcccctgtgtagagagaggggatagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcagtgttattttgctgaataatagtctattgtatgaatattcccatagtttatccattctcatattaataaatactgggctatttccagtgttttgcctattgtaataaatctgttaggaacattcttgcacaaatctttttatgtttttgtatatgttgggtcaatacctagatatagaattattggatcataaggtggatatattttggttctgcaagaacctgtcagtctttttcccaaagtagttgtattattgttttagtttgctacagttgccatgacaaaataccacagattgggtggcttaaacaacagaaatttattttctcacagttctgatgtctagaagtgcaagatctcaaggtgttggcaggtttggtttctcttgaggcctctgtcctttgcttacaggtggccatcttctcactgtgtccgcatattcctagggttttcctgagtatccagatttccttcttttattaggacactagtcacattgtattagggcccaccctaatggcctcattttaatgtaaacacctctttaaaggccctgtctccaaatatagtcatatttggaggttaaggcttcaacataagaatttagggttggggggcacagtttggcccataacaaccaagctgtaaaccttacagtgacatatggagattttgtttgctccacatcctcaccaacatttggtaacgttaatgttattcattttggccattctgttgggttttctgatattttaaaatgagttctcttagtggtattctaataaagaattattcaatacttttttgttgttgtttttaatgaggcagggtctctgttgcccaggttggggtgcagtaatgccatctcactgctgcctcaacctcccaggaccaagtgatcctcctatctcagtctcccaagtagctaggactacaggcacacactgccatgcctggctaattttttgtctttttagtagagatggggtttcaccatgttgctcaggctggtcttgaactccagagctcaagtgattcgcctgcctcagcctcccaaagtgctgggattacagaataactatttaattctgagatggtttgaggttagaaaacttagtccttttatcctcaaaaaccataactagataattgaagggttagaaaaaaatcaaaaatcaaggttggagcctccttgaacccttctgttacacacccattccccttgtcccccctccccctgcttggcagtcacagattgcacccatttatgtttgaatgatgactcctgtacacccatggagctgtcatctttgcctccagtgccacaggtgtttgtgtaagcatatgttttcatttctgtagggttctatagtaagcatgtgcccttccccgtcttacctccagtggttactctccaaaggcaaacagatctcttttggctttgtcttctactggttatcttcatattttaaaaaataacttgtttatatgatttttttccccagtgactcagtgtatcctataatttagatacaagaatattttggaaataatgaagaataaatagtccctttttgaaactttatataaaaaccttttatattccaattatttctgttttttcttttttaaaatgttaagttggtgttttgtggagatctagttttctaccctccctttacctagaatataagtttttttcctgttttatgtattaagagttcttcatagtattaaacaaaaggaacttttaattaatcgccctccttcttaggttgtccacaaatattgtaaaacctctgctttaacccatttgtttttatgccctagaggagaattaaacatcagtttcaattcaacacacatttactttcctgtctctaatataaactttttattttagagattaaggtatggagagaatgaatacatgaggaatcatgattagttctacttaggatcattgtaattttgtttcataatttatgatcaaatgaaaactactctaaaatgaattttgcttaacaaaaaatgtttctattttcttccccatcactggatctacattatttagtttttaaataagtaggacccttatttctcatgtcttgaaacccttagacctaagttcaacatgtttcatgagcatattttatttcagaaaatttgaaaaatgctttattatagatcctctagatttctcagtacaaagtttggaaactgctgcattcagaaagcttgtttcttacatactagagctgaatctagtcataagaaatgagatgtgttgtgggcaattgaacactgaagtttcatagtggctcaacacaaagttactgtgcacaggtgtttctataattgtgatgtattgggggagattcagtgttcaatggtcctcaaacccacacttccacctgtgtagtatagtggtcactgggctgtgatataaaacatgtaaagtgtatagcatagcagtttcttcacagaaggaaaaaaaatctcaaaccagtatgcatatcctttgttgttttacatagacacaaattttggggaaggagactttttcttctttgtgaaaaatactaaattaaaagttttattaaacgtgaatttttttccagtgaattatctctaataatgtattctcttcctgcttagtaactaatttgactgagtgattattatattagttaccacctacccaccctggtcttgtcaggtacatctaacctaatgtcagagagatgtaacacaatatactgctgtggtatgtgctatggactgaatgtttgcatcccctctgagtgcatatttgaagacttagccccagggtgatgatatttagagatggataaaagttggtattcttaaaggcaatgcctcaggttactttagcttttgggaggtaatgaagtttagaggaagtcatgagagtggggacctcataatgggattagtgcccttctaagaagcttgcttcctctcttccaccatatgaggtagctgtccacacaccaggaggagggccttcaccatgaattgaatcacctgccccttgatcttggacttttcagccccgagaactgtgagaaataaatgtctcttgtttcaggcacctaccctgtggtattttgttataacagcctgagttgactagtgcagtgtcttagattatgtgggaatgtcatgatgtgttaaagtcacttttaaacattttgcaagagtctcaggccacagcaggttgcagagattgtttcatcctggtgtaaatcttgagatggcactagcacccttcaggctgccttggaattcagaaggcaagtgggtatattcagtgtcttttatgtgactactctaaatgccaaggtaataaaggtgagaggtgacaggataaagaataataattcccgagttcaaatcctggctctaccatttttaatctctgtgactattgataatttatgtaaattgtgtgcacctcagttctttcatctgtgaaaaagatagtaaatacctgctttgtttaccacatggggtggttctcaggtttcaaagaggtatttgtgcaagtgttttattaatactagaagtttcttaagctgaagttgttttttatttctactaagtccattgttactgctcacatgatacaaaagtagatatttttcaggaatgtttgattcctttatcaatttttatacataaaaatattttgctgtaggcagttttaactgtcattaatttcattttttatttttctattattccttatgaactgacaaaagatcatagtttgtgtttatttcttaggaaatccattcagataaaataagtctccctgtatcttaagatctctttgaaaagtaaatattaccctcagcacccaaaattgtgggttcagttactgacttattactatttttgtgaacatttatgtttagagcttcagatacaaaatatgtagaaagtactactacttaagtataatttcacacttttctttattccatgagcctgtggaatagtaccttaagagtatataaaccatgccttttccaaaatatacttcatggagttattttttgccttcataaagcttatatgtaatgtaacaacgtttgtctcttctgaaagtgaatgttttagagcaaagtgaaaagctatattttattctgattttttttttcactagcattagggtggttggtaaacatagcagagagagacctatttttatataagataggttcagatatattaaactcactgctttcttaaaaataaaaataagctttattttttggagcagttataagtttacggtaaaacttagttgaaggtgcagggatttcttatatatcctctacctccacacatgcaaaacatcccccaccatcaacattttacattacgatcaatgaatttacattaatattgttgtcacccaaagtccacagtttacattagggttcatccttggtgttgtacattcttcggattttgtctgatatatgataacatgaatacaccattgtgttttatcatacacaatagttttgctgccctaaaaattctctatgctctacttgttcatccctccctccccaccagctcctggcagtcactagtctttttaatgtctacatagtttgccttttccaaaatatcatatagctggaatcatacaatatgtaacctattcagattggattctctcacttatattgtaatatgcatttaagttgtctccatgtcttttcatagcttgttagctcatttatttttagcactgaatactagtcctttgtctggatataccacagtttatttatccactcacctactgaaagacattttgagcactttctagttttggcaatgaggaataaagctgctgtatccatgtgcaggcttttgtgtggacatcttttcagcttttttgggtagatatcaaggagtgtgattgctggattgtttggtaagagtatgtttactttggtaagaaactgcaaagttgcctttcagagtggctgtaccattttgcattcccatcggcaatgaatgagagttcctgtcactttatatccttgtctgtatacggagttatcaagtttctggattttgtccattctaataaatgtgttatagtatatcattggttttagttagcaattccctaatgacatggttttgaacatgtttttatatgtttatttgccatttgtgtatgttttttggtgaggtatctcttcaggtcttcagcccatttttaaaaaattgggctgttattgttgaattttaggaactctttgtatattttggataacagtcctttatcagatatgtctttggcaaatattttctcccagtctgggcttgtcttcaaattcttttgaccttgttcttttgcatagcaaaagttttaaattttaatgaagtccagcctatcaattatttcttccacagatccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacgtggagaaaccctgtctctactaaaaatacaaaattagccgggtgtggtggtgcatgcctgtaaccctagctactcaggaggctgaggcaggagaattgcttgaacccaggaggcggaggttgcagtgagccgagatcgcgccattgcactccagcctgggcaataagagcgaaacatatactgcaaatgactatatattttcacaaactgaatacacctatgtatcaaatacctagattgagaaacagtaattatcagtatacttcataagcccccttcttgatacccttcacttaataatctgcttttccttacagaaggaaacagtatccttacccttagtgataccagcatttcctttctgataagttgttggactagtttgaagctttggatgatggattttgttctacttgtggttctagggaatggattcaacaatcttgagttcacttatcacctcaattatggattgagatgatttaagctgggcttttatctgaccatcgttactccccaagacatagattttatattttaaaccaaagactaggagagttagcaggattgtaatttttggcggatcctggcctcaccttttgttactgcatttttgttaacctgctgaaagctctactgagcttttaggcctctcagcttcctcttgtctaattaacacatcctttttttttttttttttttttttggggaaaagcaattccaaaagccaatcagaattctaggtttctagatttactacttcttctgggtcttgtctgcataattcatcactgtttttttagccctccagtgccttctaacaggtttcttaacttttccccagcttttctagttctcactgacaggcggttgttctaagttgtctgtttagccattcttagaaatagaactatataatcttatattatgtgtttttaaaaagtgttctctaaaggcttagttaaaaatgacatcttttatcactgtgatttgtgactccttttaagcatccataactagcattgattgaagttgtttcagtgtaatgagttccccaaacaatacattatggttcaaaatgaagcagttgtgtaagagcctcataatacatttataaatcctcaagtatgaggcaacttctttctgagggataattttaggggggaaactttttttcatatttggcatctagggatattgaatttgaggcatagtaatagtttcaattacatggcttctagaaagaaagtttcttaataatagaagcagtggcaatagctactgtttgtgtactttaatttgtatcaggcactaagtgcttgtataatgttcaataaactgattcaatctttataaacactataatgatatagttactgcttttatagatgagtaaaccaagacaaggaaaaaaatcaagacaaggaaaggttgagtgatttgtcatggtcatagagccagcacttatattgaactggtgtgtccagatacacccatatgctgtgtacgtatccattctgtttggactaatgcctgttctgattcattaaaaacctgagaaacatagtccacagtagtacagattcaaatatgttgtgtggagattcattcttgtcctccaagaaagcctcatctccttcatttcattaacctcataaaaacgtccacccttcacttgtcaattttttctctgcttggttccaacttagagaattatgcagttggtacatgcctatagctagtaactgggagagccggatctaagaagctgtgtcatgatgttctcatggcagtagaaccaaactgaaatttcataaaaagtataagagaatttcttctgaggggaatgtttttaaatgataattaacatgaactattttagctataagcaacatgttcttcatgtttgttagctcataatcccattataaaaactttgttatttcaaataatcccttttattttaggaaattacaatttctgtaatattatatgttaatttgtagaagttttattagtagcaatataagatcattgaatcatgtggaaaagatactaatgaaagaaaattactcttttgaaatctttttattattaatattttattagtttgcataatttttatttttattttattttattttattttattttattttattttattttattttattttattttatttgagatggagtcttgctctgtcatccagtctggagtgcagtggcgtgatcttggctcactgcaacctctgtgtcccaggttcaagcgattctcctgcctcagcctcccaagtagcttggactataggcatgtgccactatgcctggctaatttttgtattttcagtagagatggggtttcaccatgttgggcaggttggtcttgaactcgtgacctcaggtgatccgcctgccttggcctcccagagtgctgggattataggtgtgagccaccatgcctggccgcataattttttaaaactgtaaaaaaattcatcaataggaagcagttgcatcaattgtgaaccatgtatgttatgaaatattactaaattttaataagatagtgattcatcgacctttaattatagtcattaaaaatgccatcctttcaattaaatacatattgaagaaatacagtagtgcaagtaatcctctgtaaagtgttcatatttttgtaaatgcatattaaaatcaaaccatataaaaatgtttcttatggaagtgaactcaaaaacctatatgatggtatgttcatagaggacactatagaaacatttacataagtttaaaaatttttttttaaataattttattattattttttaagttccagggtacatgtgcaggatgtgcaggtttgttacataggtaaacgtgtgccatggtggtttgctgcacctatcaatccatcacccaggtattaagcccagcatccattagctcttttccctaatgctctccccactaaccctgccctgacaggccccagtaagtgttgttccctcgctgtgtccatgtgttcacattgttcagttctcacttataagtgagaacgtggtgtttggttttttgttcctgcattagtttgctgagaatgatggcttccagcttcatccatgtccctgcaaaggacattatctcgttcctttttatggctgcatagtattccatggtgtatatgcaccacattttctttatgtagtctgtcattgatgggcatttgggtagattctgtgtctttgctattgtgaatagtgctgcagtgaacatttgcgtgcatatatctttataatggaatgatttatactcttttgggtatatacccagtaatgggattgctgggtcacatggtatttctggttctaaatctttgaggaatcagcacattgtcttcaacaatgattgtactaatttatgtacccaccaacagtgtaaaagcattcctatttctccgcagcctggccagcgtctgttttttgagtgtttaataattgccattctgagtggtatgaaatgatatctaattgtggttttgatttgcatttctctaatgatcagagatgttgagctatttttcatatgtttcttggctgcatgtatatctttttttgagaagtgtctgttcataccatttgcccactttttaatggggttgttagtttcttgtaaatttgcttaagtttcttgtaggttctggatattagccctttgtcagatggacagattacaaaaatgttctcccattctgtaggttgtctgtttgctctgatgatagttttgtttgcggtgcagaagctctttagtttaattagatcccatttgtcaatttttgcttttgttgcagttgcttttggcaatttcatcataaagtctttgtccatgctgatgtcctgaacggtattgcctagattttcttctagggtttttatagttttgggttttacatttaagtctttaatgcatcttgagttaatttttgtataagatgtaaggaagggatccagtttcagtttttcacatatggctagccagttctcccagcaccacttgttaaatagggaatcctttccccattgcttgtttttgtcagatttgttgaagatcagatggttgtagatgtgtggttttatttctgagttctttattctgttccattggtctatgtgactgtttttgtaccagtaccatgctgttttggttactgtggccttgtagtatagtctgaagtcaggtagcatgatgcctccagctttgttctttttgcttagcattgtcttggctacatgagctgcttttggtttcatatgaattttaaaatagttttttctagttctgtgaagaatgtcaatggtagtttaatgggaatagcattgaatctataaattgctttgggcaggatggccattttcatgatattgatacttcctatccatgagcatggaatatttttccatctgcttttgtcctctttgatttccttgagcagtggtttgtagttttactgttataatatactgccataatcttaaacatttgtacagcaaaataagcaatacatatgtgtctttcattaaaataatgtaattgaactcagtatgttaattaacaatgaggaagaaatggaatgagtagatggttataaaaagcagttttttatgtacattttgatgattttgttagtaatagtgctatgtctgttaatacagcactttcattatgtatcactttcaggtagagtttgaacatttgtttaattaaccatgacttaagattgtaagtgagtgcttatgcttagagcatttaattatttgtgttttattggtttattaatgtacttaacagaactactttagcctggagctccataaaggaatagtcactcaagtccagctttgatataaaagtatatctcacttatagtctttttattaagcactaaaagacaagtagtgtgtttgttttgaattctgtattcaaaggaaggtgataatgttatgatttctagtttaattttgaagatgagtattagtagaaatacttttgttttcaaagagtataaattttgtgagttttctctgaataattttataagatttttttgcctgtggatttaaaaagcactgagctaatattattcctattctgagagacctaaaagttgtacttttgatgaaaggtgttttccagtgatatttatgtcaagatttaaggaaagattgtgtaaaatctgtaggcacctagcaagggaaaaatacttaagtgatattaacctaaaacattttagataattttctttattgttatgtataacaatgcataaatacaacaaattgcttttaagtgacttactgatttttatctccttagttttattcaattaaatggtttttaaaagataatttagattcacatgaaattttaagaaataattgagagagatctggcataacctttactcaattttccccaatggtaatgtcttgcaaaactctaatacagtattacaaccaggatattgacattgatacagtcaaaactgagaacatttccatcacagggaatcttcatgttgccgtttcatagccaaaccgactttattccacatgtttaaccttactcccaacccttaacccctggcaactgctaatctttctgtttccataattttgttatttcaagaatgttatataaatggaattatatggtatataaccttcattgtagattatccattttgtcattctataatgtccttctctgttgtaattttctttgctctgaagtgtactttatctcatattaatatagttattgtgctttcccttgattaatattagcatgctatgtatttttccatctttttacttttaacctgcctttatctttatgtttatggtgaatttcttataggcagcacatagttgagtcatgggttttaatctactttgccagcctttgtcttttaatcagcatactgatttacatttaatctaattatttatttttaaggcttaagcgtcccatttagttttttgttttttgtttgttctctctagtcttcatttctcttaactgtgggttatttcaacattttttagaattccatctttgcttatctgcagttaatttgaatatatctctttttttattaattaaaacctatttttttgaaattttttagagatagggtctcactctgtcacccaggctggagcacagtggcttgatcatagctcattgaagcctcaaagtattgggctccagtgatcctcccacctcagcctcctgagcagctaagactatgggtacatacccccatgaatggctgagttttgttttatttttttacttgtagtagaggcaaggttttgctctgttgcccaggctggtctagaactcctggccttaagtaatctttctaccttggccttaagtaatctttctaccaaagcacgaatatatctctttgtgcagcttctttagtggatgctgtaggtattacattttacatgcataacttatcatcttaccatcacagtctactgatgtcctcatgttacacttcaaggggcaaactttttaaccacttagctccctttgatctcttttttctctccactttataaatagttttcttaggtatgtcctttacatgcatttagaaccgtatcaatgttataacttttcttcaaccatctaatataatttaaaagactcagaggagaaggaaaaactattatatgtactcatatttttccttgccatattctttcttccttccagatgtttgaagattccatcttttatcatttcctttctgtctaaagagcttcctttagccattctttcaggataggtctgcttataacaaatactctagttcccctttatctgaaaatgtcttgattttctcccccttcattcctgaaatatatttttgctagatataagattctcttttgatagttcctctccatcagttggtctactgtgttctgtcctccatggtttttgatgagaaatctgctgtcattagacttgtttttctgttattggtaaagtgtcatttctcctttcctgctttcaagatttgtttttctttgtctttagttttcagaggttttactataatgtgtgctgttttggatttctttgggtttaatcctgtttagggtttactcagcttcctcaatttgtagttttatttgccaaatttaaaaagtttgcagtcattatttctttgagttctctttcaactcttgcctctgtctcttctccttccaggattgattaatagatgaaaggaatgttaggtcttttgttgcattttcactggtccctgagactctgtttttttttttttgagacagtgtctcgctgtgtcacccaggctggagtgcagtggccaatctcggcttactgcaatctctgcctcccaggttcacgccattctcctgcctcagcctcccgagtagctgggactacaggcacccaccaccatgcctggctacttttttgtatttttttagtagaggcggggtttcaccgtgttagccaggatggtctcaatctcctgacctcgtgatccacccgcctcgcctcccaaagtgctgggattacaggcatgagccaccgcacccggcctgttttttagttttgattttttttgtccctagtctattttatctttgttcagattgggtaaatcttgttgttctgtgttccagtttactgattatttcttttgtccccctcctctgcttttgatcccattcattaggtttttagttttggttcttgtatttgccagtcgttaacagtttttatttggtctttatatcttctatttctttctttaaactttataatttttttttttttgagatggagtctcactctgtcacccaggctggagtgcagtggcgcaatctccactcactgcaacctccgcctcccagggttcaagtgagtctcctgcctcagcttcctgagtagctgggattacaggcgtccaccaccatgcctggctaatttttgtatttttagtagagatggagtttcaccatgttggccaggctggtctctaactcctgatctcgtgatccacccacctcggcttcccaaaatgctgggattacaggcgtgagccactgtgcctggccttttttttttttttttttttaagatggaattttgctcttgttgcccaggctggagggcaatggcgcgatcttggctcactgcaacctccgcctcatgagctcaagcaattctcctgcctcagcctctcgagtagctgggattacaggtgtgccccaccagccaggctaattttgtatttttagtgagacagggtttcgccatgttggccaggctggtcttgaactcctgacctcaggtgatctgcccacctcggcctcccagagtgctgggatgacaggcatgggtcactgcacccagtctagactttataattctttgctaaaaccttctatttctgtattttttaccaggatgttctcaattgctcatcgaagcattttttaatgatttttaaaaaataatcagatcattccaatatctctattatcttggtattggcatctgctagttatctatttttattcagtttgagatcttcctttctcttggaatgatgagtgattttttaattgaaacttggacattttggatactttgagactggatatttttaaaccttcaggttaactggctttgtttgataccactctagcagggaagggtggtggaaagagagaggggtgctgtctcatcactgccaggtcatagcaggagtccggattccctgcttatcctccactgacacttcagagggattttactcattgttaccataggtgaatgtgggatttctggctccccaaccgtctttctctgatagctgtctgctaggagggatacaaggtactgttctatgtgtgtccttccctgacaaccaccagggtgtgggcggggctgactttggttactactaggtgtggtgctgcaagtcctgactatgcactaggcctcctctgacatcatcacagtgaggaggaataaggtcaccttgacactaatggatgggcttagaagtccaagctcctcacttggtcttcactgacaatatcagaatgccttgttacctcttggtagagatgaaactctcaatcccatcttggccttttctgaaaccacctagtgaggtggttggggcatctcattacagcctaataagggtagaagtctaggatcaccatctcagcctctactggtggggatgggggtagggccataattttttatctggtgttgggctgcacttgagtagttacttctaaaagttttatatcttgctagactgcccctttcctggtcctttggctagagagagcggttctggtggtttctttcatctgcatttgttgccagcttctgcaccgagttgtggatatatgaaataaaaagaaaacccagggaactcactggtctgtctttctttggatcttgaggttcctatccagtgctcctcctttttgcctttcaaagtcttcttatgtttgttttatatatgttttacatgtagtgttctgcttttctagatctctacttagtgagagagatggggaaaagtacatctactccatcttcctggaagcagaaagtatgtttcagatacttggtaacggaagttacctctaaacagaagttgaattggatgtatgtggctattactgtgtttgtttggttttttgtttgtttgttttgagcactaaatgcctgtaggcatattttattggcagagataaagaattcaaaacaaaaacctagaatcagctcctctggatatttataaatctcaaactgagacgttttcttgacaactcagggacctacttaacaacactagttttttcgtgtcacactttactgtgatttcttttatgttactattcaaacaatgctcctctttttttgactctttgatctagttacagagtggctgacaatttatggaaatagttttcaggttttaggtagtattataggccttgttaaaatctaacggtcatgtgttccttttgaaggactataggtatttctatggggatttaatagtcaaaaatttactttgtaatacaatagaagcacatcatctatagcacagtaacttgttataaaatatgagaaaaatcaatagacctttattcgatataggttgtgtaatatttttaaattgcccaaacagaagtattctacggtaaaatgttgttatagatgtttaaaggaaagttttctttgactatataatatgcagattgctcaaggtctaaagtaatcttgggttggatttctttcattgtagggtgatgaattagaagacaatggaaagaatttctacgaatctgatgatgatcagaaggaaaagactgacaaaaagaagaagccgtatactatggatccagatcatagactcttaattagaaatacaaagcctttgcttcagagcaggaatgctgcggtatgttaaaatccttataagaaataattcactggtttttaaaaaacagcaattaaaaatatctcaatttagtaagtgagtctgtgtgtgctaatggagcatttgtttgtttacacaccaaatgacatgtaatggatagttggaagtacagtgtggaatgtaagctatagatttagagacctaatgtctgagaagtaatacctaaatatatttcagccttccatgtttccaggtatacagagttaggttttgatgacaatacctggtttggcctattggacttcatttacgttttaatggttttgttaattggcttttcttaagatatttctaagttgtttctcaattggttggattatattagctcttatataagaactatgtatatttatcagttattccattgtgattgggggtacttgatctggtattagtccatactgtttgtatctgtctgatagaatttttaagagactaacaaaggtaatgcctcacatattataaatgtaaattggcagtaatagtaattaaaaatcatctttatttgggtcataaggttttttttgtttgttcgacacctttttgtttatataaccatttatattttagaagaatacatgtgcacaatacaaaattagaaattacaggctagcaaaactaaaaagaaaattaaaacatcacattctcaacactcagaaatcacttatgtcttagtgtattttcttccagatctttctaatctgcataagtgtacatatattcatggttacacatacatatatatatattttttaaccaagataaaaatcatactgtacatagcattttctaacctttttttctctagtcagtcctctctactttttattttaataaaatttcatttcatttaataccaattgatcttaaattattctttttggatgatttatccaaaccattatctaatgcattgcatcttttaaagcctgtcaagtcttgcagaatgtccttctgggtttgtctgattgctgctgcttctttttattttgttattttgtttgctatacctactggaatgggatggttgcatcttttatagtgtcatttaattcttttatattctgtgtttcctgttaactggcagttatatccaaaggcttgacggatttaggttaaacatgttcttaaagattttaattgagaaagtattcttaatgaattgttctgttcagaacaattcttaatgaattgattcttgagaatttagagcttacagctttgtatatccaagttatcaacaacaatttttgtctaatacctaatggtttagtttccaaatcattattcagtaatcatgcctagtcataatgaaaatattatttcatggctgttgtaaaatatgcttatattttaatgtactcagcttagccagatgctagttaggtagctgtaatttgccatcttaagctgtactttatgagtgactcactgttcatttaactaggtcttagaaattgattttatagttcaaatacttatggatcaaaaacgttttcaaatagtgaaacaaatagtggcagtttgtacttctggtcccattttgtttgggttccctgcttacttgatgctgtaatagaggtggtttactttttgtgtcagtgtattttggtaccttgttttgggatgctgctaaatatgagtaaaggctaacttttgaagaattgtggatagatttttttttaacctcgtacttaagtttatggagagactttgagaatttctttcaggaaacataatacatcattgctatgtagtttgtactggagatagatactgaaagcggaatgttaggaggctattctaacagtctaaataaggtgacagcggcatgaatggttaagagtagaaaagtgtttataggatgcgctttattatgaacaggcatgatgtaactgtagaaggtctataaggttgtatatttttagtctttttggattttgaagttttgggaacttttttcatggcgtttacaaattagcctatacatttcaaatctgggtatcaaagcgactttcaactgttggatttctaaataccgaggaaaaagaggctcatttagtccttttggattttggagtaccctaatatattagaacagatggcatgccaaatggcagctagaattttaaagacattgacatgtataggaagtacagtttgctttcttgccagtaggattggacttttatttgtaagggaaaaggatttactatctgtaagatagattaaaattaagattcagctttcttttctatcatttactaatacttattagccaggtatatgcgttaatatttttttaaatgactgatcttggattaggtcaatcattaattgagattcttttattttataagatttaaaattcaggagagtttattttgtaaccaacttatatttgcagttcacaagtgaagaaatgagatattcttgcattttttaaattctcaactaatatcttaaagctataaatcaaacttgtaagaaagtacaagaaatggcaaacagtaaatttaggaccctgtatactgtatttttaaaaacggttctttagtttcagaagaaacttttttttttaacctcaaacattcttctgtgctgtatactatttaggcatatatattaatagaatttttgctatatatttgttcaaacttcatagaccaggcagaattaaattaatattagtgtgtcctttgagccaaaggcagcattggtaacatctgtagctatgtctctgcagttgtcactctgaatctgagtgtagaggcacttaggggaaacagtactcttctgttttgagacaaagaaattccagtcaccctttgtttgttttgttttgttgagacagagtctcactccattgcacaggctggagtgcagtggcatgatctcggctcactgcaacctctacctcctgggttcaatgattctcgtgtcccaacctcccaagtagctgagattacaggtgtgcaccaccacgcttaacctaatttttgtatttttagtagagatggggttttaccatgttggccaggatgctctcacacctgactgcaagtgacccacctgcctcggcctcccaaaggggtgggagtacaggcgtgagccactgtgcccagtctttgaatcacccttataatggctttgaaccagaagccatttttaaggttctgtgtttttaaaaacaagattattttaaatgctactgctgtagatgtatttgttttaatggagtttctttaattgtaacttaaatgtgctgagttttctttatttcagcctactagttactgttatcctggcttcatttagaaaggcatgcttataattcttaaaaagccccagtctcagagcagcagctgaggagcatggaatttcgagtgtcttgagctttgccacgtactagctgttacaccttgagcagttcattcagtgtctctttttttttctgaggatgtattcttttcatagcactgccatacatattgccacaaactgagtggattaaaacaacagaaatttattctgtcacatttcaggaagccagaagtctgaaatcaaggtataatcagtattggttacttctgtacgctctgagggagaaaccttctctttcctggcttctggtgattgccagcaatccgtggcattgcttggcttatgggtgtatcacactaattatctccatcttcacatggccttcacggtgtctctttttgtcctttttttttctcttataaggacacgttcattcgatttagggctcttaaccagcatgatgtcatttcaattcttatattaataatttctgcagagatcccacttccaaataagatcagattctgaggatagtattgggcactgggagtgggggacacttcttcaactcactacgaagagtaacattccattttacgtcacaggaatttgtaggacttagaggaaataatgtgtaggaatggattttgaggttgtagagtgctctagtgttcatagttctgttatttttatgctttatcttgtaggtggttatggcagttgctcagctgtattggcacatatcaccaaaatctgaagctggcataatttctaaatcactagtgcgtttacttcgtagcaataggtaggtcatgattttatatatattttttcttttgtattccttcaaaagtaatgtttgaacaaatgtaatctttcaggcatttaatatataactctgactatattttaatcaatcgatcagtaagatttcatacttaaggggattattataaaagtctttatgcatttatctcaaacttaatgataaatactgaaactttttaacctcaagcccaaagatattgaaaatattttgtggcataacactagagtgtcactagtagcctagtattagtgtttgaaatttttaggtatggcaataatgatgtttggggagttttggtaaatctggaatcactgaaaaactatactgaagtactatcagattgacttactcaatgtattaatacatggttttatatagagcaatgtgtatgctaagtaatgtagtttatgccagaattgtgcttcctataaagctggaatatttaattactatgctttgctccactctaaaaagagagctgtgtttttaatagctactcattttaaagattgcatactcttagtttcagatagacagacagaaagagcatgccaccttctttgattttacctctttataatttagtggtttaggttaacgattcaaaacaatttattgagtttccatgacatataacatgagaatcatgatttcaggtttaattcagacatttgtttctgtgtttaagaataccttcatttcagctatttgacataccttagctatttttcagtaattagttgttttaatttgaaacaatgtttttcattgagtgcttgtttccactaattgcgttggaaggaaaaaactatgtatttatttttgcccttaactggaacttagtccacaattgtagctcttgactggcttagtaacaaatgagatgccatttcctttgtgttcctattctccctatctgtatatccagctattatttttctcttttgctagttcaatactttttttttttttcctatggctagttcaaaagatatcagaaagacctggaattggtctttcacatgaagccttataccagattcagttcatttattagatatttgggtctaaaaataacatgactacttttaaaatctggcctttgccctgggaagaatgagttatttaatgagtttataataacagtgtggtcctatctacccctattaaccctaagaataccttccttggatgtgttcaaagcaggtacaatgttaacttcatattttaggagcactttattataaaatttgttttaactattcttcatgatgaatcacgtctaatttattggtattttataggaaaagtgcgttaaaaagacacacatctaagatttactaaaaacttttcattattacatttaagagtctcattcacttgaaattattgctaattctttgtcattattgtagtgcttactcaaagatgtttcattggaacatatacccagtaaaaattatcttttgatttctagggaggtgcagtatattgtcctacaaaatatagcaactatgtcaattcaaagaaaggtatgtatgttctgaacacgtaatttaagagacacatgaacacattagtaccataatgtatttttgtatttatttttgtaatccaggggatgtttgaaccttatctgaagagtttctatgttaggtcaactgatccaactatgatcaagacactgaaggtatgtatgctttcatttttcagaggcttttaacacatttgttttgaagagatatttctatagcttttagcacctgtgggatgcagtcctgcttttcaaaacacattgataaagttaatggtttttctttatacttttcaatctatattattatatactaattactgtactacattctgataatgtaaagttaagccatgctacctacaacttgaataactcacagattactgaaggagacaggcatttaaataaataactttggagatttgttccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14278 - DNA, 6759 bp, Human
ttttcttcacccaagaatctgggtgctttataagcataagcatgaaatctccctgaggatagtatttatgcatccactgagcgctcaaatatagaccatattagaagttaagcaatgggttgagtggccaaccacattttggccagtcctacaagactttctttgacctaccaaatggggtataaatgcttctcgtattctccccgccagtagggactcaaaatcttaatagctcggggtagtaaaaaggatgctaggtttgaatcttggctttaagaaaactgtgctgaggtgttttgtttgtttgagacagggtttcactctatcacccaagctggagtgcagtggcgtgatcatagctcactcccaggctgaagggatcctcccaccacagacttctgagtagctgggacgaccggtgcatgccaccatgcccggctaattttttgtacttttggtacagacagtgtttcgccatgttgtcgaggctggtctcaaactcatgagctcaaagagatccacctgcctcgacctcccaaagtgctgggattacaggcacgagccactgcgcccggccagctttttttcttttatcagaattgatattaaactatatgctgagcttccatgtccttatcttccttttggcatggctatggccatttgaaatgtgtgggatttgctaaagtgctcaacatacgttgtttccttttttagatctaagtatgtagagggctctgatttgcaatatttagaaagttcttctaagctgggaagaaaagtcaagactaagaatcattgccaacagggccgggcgcggtggctcacgcctgtactcccagcattttgggaggccgaggcaggcggatcacgaggtcaggagttcgagaccagcctggccaatatggtgaaaccccttctctaataataatacaaaaattagccgggcatggtggcgtgcgcctgtaatcccaggtactcaagaggctgaggcaggagactcacttgaacccgggaggcgaaggttgcagtgagccgacatcgtgccactgcactccatcatgggcaacacagtgagactctgtctcaaaaaaaaaaaaaaaaaaaaatcgccaataggtagggaataagttaccccctgctaaataagttacactcacctaggcaaggaaggaactcataaaccaccttctaaactgcttgccttcctccccgaagttctgtaatttagaggcggtcactaccactgcttgaacaccccttcccaagtctgtaccacaaaaggagctcttgtgtagcccagcccctccttctcaggaccccaggagcccagacacactaatggggacattagttgcttacttttccagctactgcttaagctaggcaggccatgaagaaataacggtctcagtaacctccatgctcgggatacgactcccgggaagacgtgggtgggtgcggggaatgcggactgatccctcccagcggccgttgggggctggcccacaatccctcgcgagggcgggaaaagcaatgtggtcgttgcggggggggggggtcagaaaagggggacggtcagcgggaagagccaagagactgcaactctacaaagagcacgcagattaattctaatgattgttccctgagcttttcacaccaaaataatggtaactggctagtgtgtgcccgttacgctcactactcccactcgagatcattcctattaatgactctgaggcttcacctaacaggccacggtggaggcaaggaaatgtggcgtggagaacccactgggcctggctctccgtcctatggtctccgtccatcgttttacagtcagggtgtacatttgatgaggaatctctaaatgggattttggggaatcaaaacggaatggtgcataagtgtgaaaatttacaagactgcgcaaagctgcaaggcccggagccccgtgcggccaggccgcagagccggccccttccgctttacgtctgacgtcacgccgcacgccccagcgagggcgtgcggagtttggctgttccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcagtaagtggtgccaggatttacaaacccaggcaatctaattccagcattcaggctcttgataggattttcatttcctaaatgctgtcatcaccattgtcttttattagccccatatttatggctcatattcttatcagatcaagcactgatatatcaaactgataagtgatgtcatcctcaccattatttcttcaccagcttgttttgtaattgccattttcttttctcaggccacactgtcagatgggtgaaattgtgtagtcgaggaagcataaatgtattctttaaaatgcttgtgccttgaataattgttctcattagtttggagtgatacatgaattttttacatcagttatttccatgaaaagtttttattataaataatacatgcatatgtgcttcttaaagttgtaccttgttttaggcagttaaaacatctattttcattctcatctgaaaaataatttgtataccttatgagagcgagataattatggcttcataagaccaaaagggatagtaaaaatatggtaatagtgagtacatttttatttctgcttcctgagacacttgtaggtactcagaaatgctttagttgaattgtttctgaggtaataggtaattctttatgtgatgactaagaaaacgaatacctttattaagctgaattttttttttttttttttgagacggagtctcgcactgtcatccaggctggaatgcagtggtgcgatccaggctggagtgcagtggtgcaggttcaagtgattgtcctgcctcagcctcccaagtagctggaattataacgcgtgccaccatgcccggctaatttttgtatttttagtagagacggagtttcaccatgttggccaggctggtcttcaactcctgacctcaggtgatctggctgcctcagcctcccaaagtactgggattttaggcatgagccactgtgtccggccaaactgaaaaattaaatggttgatagaatgttgcatttttatgtttctccactcctagcatcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctgaggcgggtggatcacctgagatcaggagttcaagaccagcctggtcaacatggcgaaaccccatctctactaaaaataaaaaaattagccaggcatggtggttcacgcctatagtctcagctcctcgggaggctgaggcaggagaatcgcttgtacttgggaggtggaggttgcagtgagccgagatcatgccactgcactccagcttgggtgacagagcaagactctgtctcaaaagaaaaaaaaaaaaggtagatttatgtataataaggggctccattttgagaggcctggaaatgattaaaatattcttaattggctgggcgcagtggctgacgcttgtaatcccagcactttgggaggccaaggcaggcagatcatgaggtcaggagatcgagaccatcctggctaacacggtgaaaccccgtttctactaaaaaatacaaagaattagccgggcgtggtggcgggtgcttgtagtcctagctactcgggcagctgaggcaggagaatggcgtaaacctgggaggcggagcttgcagtgagcctggatcacgtcactgcactccagcctgggcgacagagcgagactccgtctcaaaacataaataaaataaaataaaatatccttaatcttggttttataggcatgccctccccgaatccagttgatttacatatagtcgattggttcacattatatctggagtcatgaagagttagacatttctgttgccttggggagtatatttacatttataaaactttagtgatacctaacttgtcattatctggagttcaaaaacactaccttagatcatcatcatgatttggttgtttgtcatctttctgttgacagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttcctgtaggagctttgggacaaaacctatgtatgtatttcagtcatcatactccatcttatcaggtgtaagttaacggtgccggacaccttaatataagcaactgttgttaaatgctttccaatgtataaggacttccatattggttttccaaaaaccaaaggtagctttgaaaaccacgtctgaggccggatgcagtgctcatgcctgtaatcccagccctttgggaggccaaggcgggtggatcacgaggtcaggagttcaag

SEQ ID NO: 14279 - DNA, 77535 bp, Human
  misc_feature (1)...(77535): n = A,T,C or G
tgagggtttagaggtaggggaatgcccaaggctttgttattttgcgtaaatattcagggaagtttatctaatatggtgacactttagcaaatagctatgggaaggaagcgaagggagcaagcagcataggtatctagcagaagagaattctaggcaggaggaacaacagtaccaaacacctgagataagagtgcttggcatatgggaggcattgcaaagaagatggcagtgatgcagtggggggaagaacagatcacaaagggaatatagtatggatatatgtacatatacatacacatatgttttataacatacatagtacagtatatatatatacacacacacaccatgcaccatgcactatatagtattaaattgtgtgtgtgtttgtgtgtataaagtactgtcgttgaaactgaagtctagtgtaatatgttcagtgccataggccagttataaagtgctatgaagatctagagaaggcagagattaaattccattttttactctcagaagttgaagcatgcatatccaagttggatttactgtttcatttttgttgcaaatagtctgaattgtgaaagctttgtgtcattctgttgttccatgggcactctgttttgttctttgttctttaagcagtattggccaccgtagctgcttatctaaaatgcatgtgtttatcagatattaacttatataataattggacctattaaaggaaaaattttaagtaaatgttggtagttacattgtcatttcttgctagcaatcaaggccaagttagatcatttgaattcatatttaatcattacacactgaagattaaaagtgaacaaattaatgtcatgaataacttttttccctttattgtagtatagctgagacatttatacattacattttatatatattttaaaagtaactcatttcttggttttctcctctgttatatctctaaattggattatattatattacattttttattgaggcagagtctcactctgttgcccaggctggagtgcagtggtactatctccgctcactgcaacctccgcctcccaggttcaagcaattgtcctgcctcagcctcctgagtagctgggattacccatgcccgccaccaagcccagctaatgtttttggtattattagtaaagatggggtttcagcatattggccaggctggtctcgaactcctgatctcgggtgatccaccccacctcaggtttccaaagtactgggattacaggggtgagccaccgcacccaacctattttacattttcttcattgagtttacgaataatatctcttaaacagattgtaggttactcttcttaagttttattgagaatctttttttccagttttgttctcagtattacctagttatcaactgatctgagctaattcagtagaacagaggggagagaaggagtataaatcttttgtatgaacaaacagatccaactcaattacagaccagatctctgccctgttatcttcctgttgcaaagacagcattctagggtggatgttcataaagatagtttgatcttcattttgttcattcttctgtatggatgatttctttaaataagctttatttaaagaaaaatgttaaagttaattttaaagagatgaataataccagtattttaatggaaggtttttaagtagtaaggaaatagaaggttcctcaaaaccttgaaacaattcattttgagatgaccaaagtacttgagagagaattataccctgagggagtttgatttattttttggtattgttgatcatttatgtgattctaattggtaccctgcttcttaggtagattatggtagtctcaattgctctaattgagagatttttaacaacatctccaaactattactgctccactttgtgttaaatcttttgcctgtttgtatgcagatctggtattaacaataaattaaaaccacagaggaaattaatcatttaaaaattttttattgcagacttaattcagtgcacaaatgagatgaatgtgaacatcccacagttggcagacagtttatttgaaagaactactaatagtagttgggtggtggtcttcaaatctctcattacaactcatcatttgatggtgtatggaaatgaggtaagcagaatttttattgaacaagtatactgatgtgttgacttattgttagctagcttctctcactgaaacttcagaaacagctcccaggtacaaaggtcaaggtgcctagccagaaatataattatagaccctgtaatttgaggaaagatagcttgtaagccagaaagcaaaaagtgggttagagcacagaggacatcaataatggatcaagaagcaaagattaatgcctagaaatgggttccataagcatccctggtttttgctggtcctgtttatagactatatatttgtctatatccatttgttcttttattatagtccagttagattttttgtttgtttgttttgagacagggtcttgctttgttgcccaggctgaggtgcagtggtaccatcatagctcactgctacctcaaattcctgggctcaagggaccttccccacctcagcctcccatgtagctgggattacaagtgtgtgctaccatgcctggcttatttttaaatttttttgtagagatgggggtctttccatcttggcttaggctggtcttgaacttctgggctcaagtgatcttcccaccttagcctcccaaagtgctgggattacaggcgtaagccatcacacccagctttagattcttgtctgatctcatatagttgtttatggaagcactttgcctacttcaaagctgtgatatttaggactaagatggcatttgctgagagggactgattgaagtgtgccttcttcagcagagaggtgtgtctgaagcctttgttgcctaaaagggtaacaaataagatatatacgcttttgaaaatctgttttgagagaatcatcttactttccgtgatagcctagcagctaattttttggttcattttctcagctcaataaacttatttgtaaaattgtattaacaggagcttttcaagaacatctgagtagaactagataaatcttcttcggtatgtgccttagaaaaatgcagcccgggaagataaccttctagagatgagaaagaactttagtcattggtattagttttctgagcgtaatgacttgttgacatccatcacgttgtgtgttattttgggcttttcagtattgaaactattttttgacaactaccaatatagcattattaaagttcaaaattaaagcaagaatttacccacaactttattgttccagcacatcttacttttggcacattttggtcttccctctagttcttgtccaaaagtatttgtattttttaaatggctataatcataatgtagataaaatatacttagctttttatataatattacactatcagcattgccatgttgtatttttttatcatctttagtaactatgtaattgatcatatagttcacaatttttaaactattttccttgctagaaattgagttttctgattcatcgttataccaccacattgagtgattttatttgtagtttttaatttttaaaaatgatttcccctaagtgttacctgaaatgtgattactaagtcaacagacatgaccatttttaggacttatgttagttgctttctaattcattataaccagttgatagagctaatagaaatgtttggctgtattagcttaaatgtaacttgaaacatcttaactaggataatagtttttacttttagcaagaatatgtttagttaagattatgattattctgaagaattccaagcgtgtatgtacttttcttcttcttctttatttatttgatgtagtttattttttaaaaagaaaaagccacaaatataaccagctacactgccagataaacaaagtatcaataatggctttcagaggctgtaaataaggtaattgatagtactagaggcaaaatgttaataaagacaaaacagaaagttgacagtcattttgtagattgactgacaaggggagaaagatagcattttagtgtgtttttttgatagtgtgttttttgataaactcatgtttagcttcctgtaggcagttaaagcaaattccatgctctgttcattttttatgctggtttgtacaaccttcaggtttttatgctagtttgtacaaccttcagacgttcccattggcaggtgccattaatttgttagaggctgtacataggatttcactatactgtggtgattggaataccatggagcggtgattctcaaaactgagtggggaagggggatgattttttttttcccttaggggacatttgtcacaactgaaggggatgctgctggtatatagtaggtaaaggccagggctgcttcaaaacatcttacaataatgcacagaacaggctgggtgaggtagctcacacctgtaatcccagcaatttgggaggccaaggtgggtggatcacctgaggtcgcaagttcgagaccagtgtgaccaacatggtgaaaccccgtctctagtaaaaaatacaaaaattagccaagcgtggtggtgcacatatgtaatcccagctactcaggaggctgaggcaggagaatcgcttaaacctgggaagcggaggttgcagtgagcgagatgacacctttgcatgccagcctgggcaacaaagcaagagactccatctcaaaaaaaaaaaaaaagaaaattaaaaacagtaatgcacagagccagtctccaacaacagagaattacctgattcagtgtcagagtactcaggttgagaaacctggccacagagaaaaatctcaaaaggtaaggctgagtgagcattgtgttatagacccttaacatgaggcaggtaggtacttttatactgttgttcacttaccaactgggtgacttgggtaagtcacttctggagcttcctcaataatatgatagtaccttcatggtaaatagaattgaccaaggctcttactatagtatgacaagttatagatgattaatacatgaaaatgtagagttaaaaatttgtagatgaaattagaaaagagaagtaccaagcatggatttattataaagtatttaataccattttgggtaaaataatctgaaatatgttctttaaatattttgttatgaaaagtttctaatatacacaatagtagagtgaatggcataacaaatgcttatgtacctaatcacccaccttccacattgccattctttaaatgaaggtttaggataatccatttcaggttaccgcttatgacccaaaatgggaacctgtgaagccttattacttgccagagtgttggcatggtgctcaatttaataccattttgaatatcattaggatgctgttgaaaacaaaatcaaaacttgattaaagccatatatgtctttgcagctaaatataatgaacgtagaaaggactaataaaatgaaaaggaaaatttagatttattatctctaaaatcatgaatgaaatggcctggtagacgaaattatttacattaatttagaatgcagaggtaaagaagagtcttatcaaaatctattaaaatcatagtctaatattgtcttacgatatttttataactttttgaaacactattttaggataattgtgaaatatgagtcttcagtttacacattgattttcaaaatcctggtttgttagtttggggtgatctcagttgtacaagtctaatttggaggccgggcgcagtttctcatacctataatcctgagagtttggggggccaaggcgggaggattgcttgagcccaagagttccagaccagcctaggcaatgtagtaagacgttgtctctacaaaaaatttttttaaaaatgtgagctggacatgcctgtagtcccagctacttgggggcgagggtgaggggtggatggtgggtggtgcttcatactgagatgggaggattgcttgagagcaggagggtggaaagctgtgatcacaccactgtactccagcctggatgacagagcgagaccctgtctcaaaaaaaaaaaaaaatactgatttcagaggtgatggtgtacatcctagttgattattagcctctacatgcattaaaaaaaaaatgaagaagaaagtaaagtaatcctaagaagcgaagttgaaaggcatttctttagctatttagaggctgtatgtgaaggagactaaggttatgtactatggtaagcacttcagagaccattttggcaatattgagaagatgagcttttacatatgtgctggcctaataattcatccctaggtatatatcctgaaaaactcatatactcatatacttatgcatggagaccatgaagaaatatgtcaatacaactttgttaataatagcgaaaattacaaagtatatccataataaataaatggatttatgatgatgtattcattagaatattagaacatcatttaagatgaaatgttaagtgggacaattcttagggaaaagttgagttaaaacacattgcaaagagtaagtacactatgatacttgtgtaaatttcaaatagaaaacacttggatagtttatagatacttgtatgtctagtaaaatggtgaaaacctgtgtgaaagtaacgtatacctgtttcagaaaagtactcacctctgaagagggagggaagggagattgaaggtgtggttcttcaatggaggctataatgttttgattctatataagatgtgaagtgaacatgtgaatttgtttaatctggacagtgggtaagaggatctctattgctttcttgtatgtttagaagtattttttttttaaagccaaaactttggtttaccagacggctgtttaaaatacagatgccacctaaaaatgattagctatagttttagtatgctgtaataaaaccaaaactactgcttccactgcctatttgcttttattgttttgacttaatactatatctgtgggcattaggctttaataaattctcgcatgctagtgaaaaatatgtattatgtttttaggtttggtaactagttaatggaaagagtgaggatgagaaatttaaactagataagcttaacagaatgtgttaaccataacttttcctcctaattttcgaattagagttggtgagatggcagtaccttaatatgatgtaattttttttttccagcgttttattcagtatttggcttcaagaaacacgttgtttaacttaagcaattttttggataaaagtggattgcaaggtaaagataacttttacattatagaaaatcaaaagaatgacacccacatgatgattactccagagtagaactctgtcttttagaacatgtgctactttaaaccttatattttagtgaaggttgtaggaaagaaaaaactgtcttttaatttgaagattaataataatcttcctaccagatactcagagctctctgagacggagtacagagtagttatttgagagcatgaattctggagctggactgtctaggtttgaatctcatctttgctgcctaccagctatatgaacttgggcaggttacttcacctctgcatcagtagaatcgagtaatagtgatagtacctacccagtaagattgtcatgagacttaacctagttaattactacaaagtgcttagaacagtgcctggcacacaagacatgctatgtaaggctgggtacggtggctcatgcctgttattgcagcactttgggaggctgaggcgggtgggtcacttgaggtcaagtgttcaagaccagcctggccaacatggtgaaaccccgtctctactaaaaatacaaaaattagccgggattggtggtgcacacctgtaatcccagctactcaggaggctgaggcaggagaatcgcttgaacccaggaggcgaaggttgcagtgagccaagatcatgccactgcactccagcctgggtgacaaagctagactctgtctcaaaaaaacaaacaaaaaaagaaatgctatgtaaatatttgctttcattgttattatattatgtttcattccaagaaatgtagttgaaatattacatgttttagtagctaaagtggatataatttgttgagatgaattgttccttcatattcgtagctattttcttatttatgtttttttgagacgaagtctcgttctgtcaccaggctggagtgcagtggcatgatcttggctcactgcaacctccgcctcccgggttcaagcgattctcctgcctcagcctcccgagtagctgggactacccgcgcatgtcaccacgcccagctactttgtgtatctttagtagagatggggtttcaccatgttggccaggatggtctgcatctcttgacctcatgatctgcttgcctcggcctcccaaagtgctgggattacaggcgtgagccaccacacccggcctgctattttttatttagtaacttgaaatggacataatgtggttatagctgtccatgcacattgtcttaatgggatctgttttacttagttctgtaactaggctgttagcattatagaatgttagctttagggagaacctcataaaggatatgccaaatgaattgggaatattcaacagtgaggctcaatcagggaaatgtctttagagaaggtgagatttgtgctgggcttcaagagaaggatgagaagatgagttggcttaagcacaggtacaatacatgaatgtgaaagtaaggacagatacacagatgtatatggatgtgaaagtcattcacatggatatgagtatttaagatttacagagcaaatgaatgtgaatagaatatatatgaatggtgtatttgagaacatgtagtggcagatagccctcaagaagctgttcagagccaaaatcaagcacaaaaattttttatagagttggaattttataatgcagtagagagaggaggggagagggaattatgtgttaccaggaaagcatcatagcttagtcaagttagatcagagtaaaccaaatcttgaagatgctgagactgtttcagttgttctggttatctagtgtagagttaatcagggcctgaactgtggttcttctggaggtgtaaaaaaaaaaaaagatcaggggaatttttttttttttttaatgtgactggctgtatttgagtttggaggtgttcagtccaatacttgtttccctttggtaagtgcaggtattgcttaaaaagaatttaataccctatcttccagacattctagaagaccagtaatctatatgtaggacccattgttacaaaatgcattatattttaacaagagttacggcgctctaacttaaggaaaaaaaattaaaacagtagaccccctctcttgaaaaaaaaattttttttttctttgagacaggatctggttctgttgctgaggctggagtaagagagaccggggcttgctctgtcacctaggctgggtgcagtggtatgatcgtagctcactgcagcctctaactcctggctcaagcggtcctcccttcagcctcctgagcagctgggattacagatgtgcaccaccacgcctggctaatatttttattcttaaatattttgtagagatgggctcttgctctgttgaccaggttggtcttgaactcttggtctaaagcgatcctcctatgcctcccaaagtgctgggattacaggcatgagccaccacacctggcctctttttgaaatcttaaacagaagccagatatatattatagataaaaatggagtgtctctattttcaggggcatggaagaaactgcctactcatcctttaattttcacttcctccctcattcagttcattttaactttaaaagtctatggaaaacaagatgcagagcagtgctctaggcagagtttatgcatatatccaagtaggttttttgtgtcttattagcgactgatttatcattttcttaagatggaaattaagcaattctagtggtaaggtgttaataatttcactctttttatgtagacgagaggttgagccttgaaggatgagaggtgtttaccgtcttaggatggggtatagtagatagaaccatatgaaccgaagagctgaggaatgtgagcatgtaacacctgacgtgtacagtagtaggtatgaagtcatatgggagcagtatttttttttctattttgttcactgatttttctccactggtacttaataggcactcaataaatattttgctaaataaatgaactggtgatgttgaaatccagttagtttacattttggttggttttggtattgtcttttaaaggtagcaaagaccaagtaattaaatttgttagatgaatatgagataaaatgggttcacttttcaatgaggagcaaaaatttatagacttccttgagccaggtaataactaaaacacaaagtttttggtgtttttagaaaataatattgattagattttatgttgctaaagttttcaagtcaaggtcatgatgaaacaaaatcttagaatgatttatgtattcatttagaaagtttcattgaaaacattcatataattgtttttgttacaccctgaacttgcatattgccatttcttatattacacagtaattttttatactttttataaggttggcacatacaagttatggttctaaatacagctaaagattttaggagtataaaaattatataaagttgcttgatttgaggaatgggattgtggttccataggatgttaaatttgagttgagattatcaagttgtgtaaaagaacatgtttttctaattcctgatgaataaagaataggaatattgagagaatagtgaagttctaagggaagaggttttttttttaaaactacataggacttatctgatttaaatatgaagccttaagagaatttaatggtaatgttattaattagttacttaatttacatactaaattgaattgggatatcaagacattttatagccattggatgcaatgagttgtttttctaggcatattgggatttttagtcatttataaaaacttgtctctctctttgttttgtttttgtttttgtttttttacaggatatgacatgtctacatttattaggcggtatagtagatatttaaatgagaaagcagtttcatacagacaagttgcatttgatttcacaaaagtgaagagagggtgagttaagctttttttgacatctaattgatttgaatttttaaaaatgtaaaacataggagttactagattatgaattatgaaattttagccagttttaaaagatgagcctcatttttctttgatgaggtatatcaagtactttttgtggtaggatttgtttttaagttctttttatagcacctttattgagatatcattcacataacaaaatttatcattttaaagtgtgtaattcattggtttttagtgtatttacaaagttgtccaacatcaccactaatttcagaacatttttatcacctccacaaagaaactctatacctattagcattcatttcctagtccctcttcccctagatcctggcaaccatgaatctactttctgtgtctctgggcttgtctattctgaacatttcatataaatgaaattatacaatatgtgacctttgtgtagcatgatatgtccaagttatagcatccatgttatttcatatatcagtattttattcctttttctagccaaatcatattttactttatggacatatactgcattttgtttatctgttcataaggtgatggccacttgaatagtttctacttttgcctattaggaataatggtgctgtgaacattagattttatgtggattatctttttaattctcttcggtgtatacctagaagtggaattgctgtgtcatatggtaactcttacgtttgtcattttgaggaactgccaaatcatttttcaaagcagttgaatcactttacgttcccaccagcaatgtatggcactttcagtttctccctattcttgccatacttgttattttctgggtttttttttgcctttttttttttttcttaaatggtagccatcctagtgggtgtgaactggtgtcttgtgatttttagtttgcatttccctgatggctaatgatattgagcattttttttgagctgttgaccatttgcatatcgtcttttgaaaaaatgcctcttcaaaccctttgccctgtttttattttttattttcactttttgagacagtggcaccatcccagctcactgcagtgtcgacctcctgtgctcaagcaatttttccccctcagcctgctgagtagctgggaacacaggcatgcaacactatgctcagttaatttttaaaaaaattttcatacaaatgagttctcactatgttgccaaggctggtcttgaactcctgggctcaagcagtcttcccattttggcctcccacagtgttgagattataggcttgagctactgacctggccttttgctcatttttaaattgggttacttgccctttttattgttaagttgcaagaattttaaaaaatatgttctgggcaccagtttcttatcgcataaataatttgcaaatatttttctcccatggctggtcttttcagtttcttgttggtgttttttgaagaacaaacatttttaattaattaagtgtatcttttttttcctttggttgcttgtacttttgtaatcatgtctaagaaatcattgtttaatccagggtcacaaagatttactcctactttttattctaagaatcttgtattttttgcccatatagttaggttcttatctatttggaattaacttttgtatatggtgtgagaggtgagtccaaatttattcttttgtatgtggatattgagttatcccagcaacattttgtgaaattactcttctttccccattggatagtcttagtaccttgttgaagatgagttgaccataaatgtaaaggtttatttctggacttgcagttctgttctgttgatctgtatgtatatcttcatgccagtaccacattgtcttgattactgttgctttgcagtgtgttttaaaattagaacgtgtgagtcttccaattctattcttttttttttttttttttttcccaagattgttttagctgttctgggccccttgcattcccatgtgaatttcaggatcagctttttgatttctgcagaaaagatagctgggattttgtgggggattgcattgaatctatagatcagtttggggagtattaccttcttaatgattaaatttctagtctatgaacaagagatgtctttctgtttatttggatcttttttcatttctttcagtgctgttttgtatttaagctttcttttaatcttaaatgcagaagatgcatttaatttttgctgcaccctaaataacaatcatcttagtacatgatccagtcacatgaatgatatagtcagtgcttctataagtgataacacctgatatgcagatttttttcctaggatataggatgaggcctcaggagaaagccactgaagacattcttagcagcagcgatgacccttgtagctatgaagacctgtcttgaagggaatctggcatgtacagaaatagtctggtgaatgccttcctgagccactctgctgctcagtgatcccaaaggtctaagcaattgatgtgttcctttagattgttctattgaaattttaaattaatggactgaagtgaaaaatttaattaaaatatagaggtaacctcttagttatgcaagaaaatttaaagctgaatttaaatgttctatgctgccattccaaatccatcaggaggtgattattttggaatatacctaaagtaaattctacagattttgtttcatatatttaagcactttgtagaagattatggtggagaacttttttagaagtctgatttttaacctctgtatcctgtccaataatatttcactgtaaagtgtcttcagtgaagttgatcttcagtgtatttacagatttcagaataatagatttttaaaatggtaacttttgttctaatttgaagggccagtcttgagaatagttggtgaatttttttatttaatagagcagtcttttttaattggaggaaaatagctcctgattaagtacaataaaattagtattgacttagttgaatcaaggaggagccataattgagtggggaccaagaagaagtgcaaaagtggcattatacacacacatatacacgtcagactgtataaatacaaaagaaaaaaaatcaagaatatcaggtataaattgaggacatgacagcaattgaaattattatatcatggcaaaaacctcagtaggctacaccttttggagaggactctcattgtaagtagtaaagtttgatttattaagatttttttttatgtttacaaaagtaataaaatttaagaaaaataccatcctaattcatagaaaatgttaacattttagtgtgtctaaccttttctgtgcgagtaaatagaaatatgtatataaaggcacatagaaaattacataaaaattggatcagattctttgaaggctgcttttcttcccctcctgtgtattttggacattttcaatgtctgtacacatagatccatctcattctttttttcttttttttttttaagtcagagtctggctctatcacccaggctggggtgcagtggcgtgctcttggctcactgcaacctccacctcccgggttcaagcgattcttctgtctcagcctcccaagtagttgggactacaggtgcccgccacaatgcccagctaatttttgtatttttagtagagatggggttttgccatgttggccaggctgatcttgagctcctgacctcaagtgagctacctgtctcggcctcccaaagtgctgagattacaggcatgagccacctcatctggcctcaatccatctcattcttatgaatggctgtagaattatgttgcaggtgtacatctgatttattccctttttttaatcttataaaagcagtggattgaccatccttttatgtatggttgcattgagtttttctatagaataaattattaaaattgatgagtcattgagatatatatacatttaacattttaatacaaaacaccaaattatcctttataaaagttatactaaattattggcttaaatagttatttgtattcttccatcatcatgaaaaatgcgttcatatgtgttcattttatattagttgattgaataaatggtgatattgagcacactcccccttccttttgaatgccatacttgttttattaattgtcttttgatgtccattgacagcttctctattgggtttttcactcttttccattgtgtttaatagtggtaagaactcacaagcttttttagtcagatgaatctaggtttgaattctagcttcacaccaattagatgagagacttcagtgagatactttagctggtttactgacttttaaaaaataatattactttaaaataatttcacttccagaaatgtagcaagaatattagagaacttctgtatactttactcagaaccaccagtttttagcattttgccacatctgcatttctctttctgtgtatattcacacaggcgcacacacacatttttttctgaaccatttgagagtgggttacatacctgatgccttttatagtttatatcttttaatactttggtgaatattttctaaaaacaaggatattttattacgtatctatcagcttgctaaacttctttcacatggtggcacacaaactgttaactatttatacaagagactacttgaggctaaagggttaaaaaggatcaacatcttggcacacttataaccctttctaccatactagtatgctgtggcaaaactgggaaggccttacttaagctctgagttatttcatctgtaaaattacgatgttaattagtactttcctgtcaggattgttgtgagaattaaatgggatattgtatgtagtgcttaacacataacaaacactcaacaaatgaactttttgtatattaggaaaataaattgttataggttatgagtatttttccttgttttttaacactgttaaaagctttacaatcttaggtgatcaaaatcattatcttcatttttatgttttttatctttcaagcaagctcagtgagctaaaatgattatgttttcatcagttatatttatggattaggtgttttatattttaatcttggattcatttggaatctaccatggtaggaaaaacatgaggtagaagctaactttttttttttttttgagacagagtctcactctgtcacccaggctggagtgcagtggcgtgatctctgctccctgcaacctccgccttccagattcaagcgattctcccacctcagcctcccgagtatctgggactataggcgcatgccactgtgcccggctactttttgtattttttagtagagatggggtttcaccatattggccaggctggtctcgaaatcctgacctcgtgatccactcgcccctcggcctcccaaagtgctgggattacaagcgtgagccaacgcgcccagccttagccaacactttttaaatagaaatatagtttgggtggcaagaagaccagacaattgctttttgttattttctgttccagaatgaaatattttgggagttaagagctgagagcttatgtgtttcatgtaaggagacaaggaaagagaagaggattcgaagatacttaggagaggattttattagagacggctaagaggattgctggcaatgttgagtattcatttgaggttgatgatcatgagtttatagttttgccagtttgcccagttgtgctgttttctttaccagcactcagctatgtgtgtacaggcatggattagttaggtgtttgctcagccaggatagtgaatttgccagatgactgaaatgcagggaagaaaagaggtgcaagaaagttaaaggtatttgtaaaggagtgattatattaatgatctgtggaattctaagctagatgaagaaagtaaaaatgagaaaggatcaatgtgggtagtggtggagttgaaacattgaagtttctgatgaggtcaaatagtttttaccacagggatatgtgaccaaagcagctgaaaggttaaaaggtaattgtcacagaataaggtgtctgaattttacctttttttgttgttgttcttcaggggtggggctaggatgatgtggtttctgggggcagtaaggttagaatcagggattttgacatcaaggtgttggattggttgtccatgtagatgttgaagctaatgacaagaaagactgagccaatgttcaaatcttctgtgatggagaagtaaccagaggtaaaaaaatgacatcagtaagaagagttgcaaaagaaggaatggtgtcctcagcccaagctccagcagctgcttccagccaatgctgtttagcacttgagcggaaacaggcatccataagttaacacattagggagaattaggccgaagctgatcaataggtgactacttaaggcagtctagtatttggttattaaactttgttgtgtcctacaaagcacagttgttgctttttatagcttaattgttttttggcgtctgaggtcatagttcatggtttatcgtagggtagaacagccatttataagtataggtcatttgtaaattaggggaacctgacatattttttggaaatgccttgttactcagccaaacagtaaatcagtagaatgaggatttgaaaatgatagggcaatctctgaataatacttagtgtgatatataataagctcttaatattagttgtgtacgttagccccagtacctttcatgtactggtttttaaatctgttttggtgctgccaataatttctctatctttagaaatatctgtttggaaatatttaacagactattttattaaaggctgtccattgaaagtatctcttgtgtaatagccagattagaatgatttggtaaaattgttctttattttgtaataaagtagttttagttataatttctgaattaaaagccattgctgttgggtcatgaataaaatactttaaataaaacagagctctaagactttgttaactcttggcctacagagtgtttaactgttttttgacttgaggcaaatgattattttatttgtaatttaaaaaaatggtaaaactgctctttacacaccaatgattgtgaggatcagatcatttcatcttgtgaaaatacaagctatagaccttgctgtataatgtatacttttgcttttatggctcatgctttatgttcttttttagttctaaatgagtaccttgatatttgacatattgtgttgcctgtttttgttttttctgtatgatctctgcttcagttttcatgttccataatgacttaaaaatatgtgacatttcatagcaacttggttctctgttttagtagaaaaccagggggggagtttgaaatgtagatttaattgcagattcatttgtttatttctctggttttttcataacagggctgatggagttatgagaacaatgaacacagaaaaactcctaaaaactgtaccaattattcagaatcaaatggatgcacttcttgattttaatgtgagttatgcttttgtaatttaagattttaaaaaattaggtcattataattcatgagaatttttaacctcaagttttcacagactctagtttttcacatcctgatatcctatatggctaaggattttttataaaatagtctcaagtcaaattactttctgatttttatgactgttttggatttatttctttagtgcttctctagctctagaattttaagatatacaagctaaagtggtgaaaggattgatctgaaaatatattttcttttgataatggcttttagatcttaaaaatgtacagggatattttttaaataaatagccaacttaatattttacttttgtctatttaatgggactcaaagcatggcaattattcagaagaagaagtttaaatagcagttataatagcttattatgtagctattgcccaagggcattgtgttcgctggaatttttgttttaatgaccatgacttgaaccaagctgccagctttgtcattcatttataatgtgttagaagttaacgttttcaactctgttctgtttttttgtcatctatcttaacaatgttttgtttattatttatttgtcattttgttttagagattgtgagtgcaagttagtgaatggaactgtgacagtttcatgctgaaatagatttttcctttaaattgtttaattgctagtttttaagcttcttcagggcaggaactaggtcacttttgttctctgttgtacccccattgcctattaatgtggcacatagtaagtgttcagtaaacattcaataaatcttacaggtatttcatagactaaaacagagattatccaactacagcttactgcctgtttttgtatgttttttaagtggttgaaaataattaaatggtattttgtaacaggtggaagttacatgaaattccaacttcagtgtcctcaatagtattattggaacacagccaagctcactgatacatattatctatggctgttttatgttacaacagcagagttcaaaagttatgacagagactgtgtggcccacagtctaaaatatttaccatctgaccctttacaaaaaaaagtttgctgacccctgctctagaaggcatggggtactgatgcagttattcaacattattttggtttgtatagaatctcagggtccaaccatgcatatttttcttaatatattgtatttgtttaaaatttcttattcttttcaatgtctgtattgtactttgttgtataataacaatttatctaatcctcctgttgatagatgtttattctgtttttttatcctaaacagtgctacactcaattctctctcctttctctgtctcttgtctgtctctccctctgtgtgtgtgtgtgtttctatttgtaaacctattttaataggtttaacacccagaaaaagaatgtggtggttcaaataatataaacatttaaatttttaataaatattgcttatattccaaaagggtgagccactaacttctcaacaggtgtctgtttttgctttttcatcttttttttgtttttttgagacagcatttttctctgtcaccctggctggagttctgtggcatgatcatagctcattgcagcctccaactcctgggctcaagcaatcctcccacctcagcctcctgagtagctgggactacaggggtacaccaccatgctcagctgccttttcttggttttagttttttgtagagacaaggtcttgctgtgttgcccaggctggtctcatttgaaactgccaggctcaagcaatcctcctgcctcggcctcacaaagtgctgggaccacaggcatgagctaccgtgttcttttcttttttcattcttatgggcactgagtaatatagtctgatgttcaggaaaggatattttagtaatttgatttgattattgtattttaatttacctgataagtgaagttgtatttcttttcacgttattatccatatgtattttttattttgtaaattgttttcatttactttatttattattaggattctccctatataatggacatcagctctactagatagtctgcaaataccttttttaccagttttttgtttgccattcaattttgtgcttagtttttctatatataacgagttaattttcatgtgctaaaaaagaacttagaattaatttggtttatctttttgatttattccttgagataaaactaaaaatatttccagtattcttttagtcaaataaatacaattatctggttacagcaaatttaataataataaataatgttcatttatatggtagctactgcaccgtgatctttatgtatgtattagagaaaataaatgtatttttcactaacatgcctaatgcatgaatttactgtatcttaatttgaaggaaatctttttgtcaatgtcatttaaaacctaagattagctaattttattttccaatttttccctaggttaatagcaatgaacttacaaatggggtaataaatgctgccttcatgctcctgttcaaagatgccattagactgtttgcagcatacaatgaaggaattattaatttgttgggtaaatactgctgtagcctaataacatttcttatcttgtgtcatatggataaacaatattgactgagttgttacttaaagctggctaaaaatttattatgatatattcattcattgtaacagttaatttggagaaaagagttttatacctaattacttctgcaagtgattacatatttttatacccaggatgttcagcaagatgaactttattttttagatgtatctatgttttttccacccattttattaatttttagaaatataaaagtgcctttaaaatttagctgggttaagatagtaagttttaggctgaggcaggagaattgcttgaacccaggaggcggaggttgcagtgagcctagatcgtgccattgtactccagcctgggcaacaagagcgaaactcagtttcaaaaaaaaaaaaaaaacaaaaaggatagtaagttttatgttacaggtattttaccacaataaaaaaagatgggaaaaaaacaaatattttgtcccagaagaatattgttttctcataatcaactccataatgaacttttaaaaaatttaaatctgttttttatagtctgaagtaacgtggacttactcagggatgctttaatctatagggatagggaaatttggcttattttttcacaagtgaaaaataaaggtttttctataaagctttggaaggcatagtcttcaatactataattagtataaattaaccttttctatgtatacattaaacttaaatgaactttctgagtgacatttgggcatggtaaagttgttatcttagataatatactattagtaagattggaaatagatgttagtgctgttttaaatggggtcaagtgtggtacgtgtttacacacaaatatgtacttaggtaattgtgaggaaaagtactatggcacaaactaggaatatgagtagggtcaagtaatgtttctttttttagtataatagcacctctattctaatttgctttaaatacctaagctaacttaacactgatatttttctagtagggtatgtatgctcctttagagacctatttggagctattacctactttttttttccttttttgggtgttatattttgatgtgaacaaaagaatttttacatttattttgtcagaaaaatattttgatatgaaaaagaaccaatgcaaagaaggtcttgacatctataagaagttcctaactaggatgacaagaatctcagagttcctcaaagttgcagaggtaaactgtctttaagtgactgtctcctaacttgcctttttgtctgtaagtatggattttgaagtcatcactcactatccaaataaaataaatgtcttcaatttagtattcaatcattattatgctgtattgaattctgtggcaagatatgaatatgataaagtagtgaataaaatacatgctgtaaatttaattcaatagcgagtattgaaaagttacctgtttttacattgtttacttctctataaaattaagtaggtgacatacagtagtgccagagatttttatggttggaatgaaccatatatttgagaatgtttattgttaaatgtggtagagaatatccagtatcagtgcaggtttctttccagtgagacagctggagccatagttcaaaatgttttcgttggctgggcaccgtggctcagacctgtaatcccagcattttgggaagctgaggtgggtggatcacctgaggtcaggagttcaagactggccaacatggcaaaatcccgtctatactaaagatacaaaaattagccagtcatggaggcgggcacttgtaatcccagctacttaggaggctgaggcaggagaatcacttgagcccaggaggcggaggttgcagtgagctgagatcgcaccactgcactccaggctgggcgacagagcaagactctatctcaaaaaaaaaaaaaaagcttttgttccccgacagaaatggattttgtgtatttattatcattgattgtgaaaactatgaatgtaggtaataggatatctaattttgcagctctgcttaaaaataattttctgaaattgtcacggaaggcaggtgtggtaatacttgcaggcattatcttgctaccacagaggcgttcttaaggggtttttttgtttgttctcccattctccagcctctacccatctccaccaaagatttcttcctaggataatttgctcaattatgtcaaagcagttactttggaattagcaacatagtgattctaggctttgttactgtggtgatatattattctatattagatgcaataggacagaacaggatgatcaacaatagctttgttattagtctgctgttttatgaagcctactgaaattaattttgaatttaaaaatgtttcaaggagaaagatcctttccgttttttaagggtcagtcacgtactaaaacagaagaaggtggtgtttatgctgtgattctagtaaattcttcaagtaagttttaatttgttgaccttccctcttggccttttatgttctttgcatttggtagttgtagttacaaagttaagttttttttgtttgtttgtttttgagatgaagtcttgctcttgtcccctaggctggagtgcaatggcgcaatcttggctcactgcaacctccacctcctgggttcaagcgattctgctgtctcagcctcccgagtagctgggattgcaggtgcctgccaccacacccggctaatttttgtatttttagtagagacggggtttcaccgtgttggccaggctggtcttgaactcctgacctcaggtgatctgcccgcctgggcctcccaaagtgctgggattacaggcgtgagccatggcatcccgcccaaacttaagttgtaagcccccttctgtactccagatctgctgttaacttattcttaggtgcaatagactgtctgctatatatgactttttttttttttttttttttttttttttgagacagagacttgctgtgtcacccaggctggagtgccatggcatggtctcgtctcgctgcaacctctgcctcccaggttcaagcgattctcctgcctcagcttcctgggtagctgggattacaggtgcccgccaccacgcccagctaattttagagatgaggtttcaccatgttggccgggctaatctggaactcctgacctcaagtaatcaacccaccctggcctcccaaagtgctctgattataggcataagccaccacacccagcctgctccatatgatttaagaaaaatatgaagagtcccttaccttacgctttttttctttttttttttttttgtcttttttttttttcctttttctggagaacggggtctcactatattgcccaggcaggtctcaaactcctgggctcaagctatcctcccgcctcttagcctccctgagagctgggattacaggcgtgagccaccgcgcccggccagagtcccttaccttaaaatattctgttttgagactgtgtttgggcttgcagtttaattagaacgccttagttcctggaagaaggcaagagtaacctcttgaaacatgtttgaggaggacaaatatatcaggcagtgattagtaacatctgagtaataatgaatttatcagattttttttttttctcctgagatggagtctcactctgtttcccaggctggagtgcggtggagcaatctctgctcactgcaccctctacctcccgggttcaaacgattctcctgcttcagcctgctgagtagctgggattacaggtgcctgccaccatgcccggctaatttttgtatttttagtagagctggggtttcactgtgttagccaggatggtctagatctcctgacctcgtgatccgcccacctcagcctcccaaagtgctgggattacagacatgagccaccatatctggcctttatcagattttctgctgacatcattctgagaccagcccctgagaggtcacaaaaggaagggagactgattagaaaatgaaacacagccacgggacagaaaatagttttctaattggggtgctagaatacacaggaaccgtttctatctttttttgctggaaattgcctagggcctgagcatcatgaaggtatattggaattggtttgagaagacagttatatcctgattagatatcacttgacatttatgtaaacctggcctacctgacagagcatgagtttttaaagtgttatctgtggtgatttccagggaaagcatgttttatggagaaagacaaagtcgatgtcttcaggtttgtttcttaaatttttttttttttttgcatcaaagagcttgttcatggtcaggctttctcattcttaccatagtgtttttatcatattacacatagaagagaggggagttttcagattgtgacaaggtagcttacatacaggtgttcagaagacagggatggtaacttagatttgttgactttccaactctagtttccctactgttaacaacttttagggccaccaaataatatctaagccattggaaatgttgagtatttttggagattaaatattttcctgattcttaagaagtctgtttaaaatattactggtactagccgtgatgtcatttttccaaattttatttataaaatatttgtattataatttattaaatacagtgcttttcttacagcaagttggaattgacagaggtgatataccagacctttcacaggtaagtttattgttaaaataccaatccactatctgttgtgtacaagttgtgaagagtattaagataagtaacatatagcccccattgtcaaagggatcaatgcagtttttgaccagttttaacattttgatgtattcctgaagattgttctaacactatgaccacgtaaaatgatctgcttaccacttatatttgttgcctacccactgtcataccatttatttaatctcttcaatcactctttctttcccatcatcattgtttaaaaaaggaaaaaaaaactttttggaacctgaatttagaaaatgatatttagaaaaacaattttcactataatgctggtagagaattatacagtatttatttttcctgttttaaacttccactttgactgtttgactcaggtgggagtattaatttagggataaaccacaaaacataagattaagagagtagggtttgggatacgtcgaaatttcagtcccggctgtgccattagctggccctgtgactttggggaagttactttctattcttcagtttcatcatctgtaaaatgaagatacaacagtacctacctcagacagtaagtagttcacaggattaaataagttaatgccaaaaaaaaaaattagagcattaaacacactcaactaatgttggctattttaatattgtctttatcatcatcatcatcaaaaaattttctaggaaaaaacttcatacctgctggttgttctggctgattctctgttttctttacggagtattaagaatgaaagtacctggcataagctatccttgtaacatttccatcaactctctcatttgttgacatctgttttaccttgttttgaattattccaggacatttttttgttgttgtttctttttgacatagagttttgctattgtcgcctaggctagagtgcagtggcatgatctcagctcactgcaacctccgcttcctgggttcaagcgattctcccacctcagcctcccaagtagctgggattacaggtgtaagccaccacgcccagctaattttcgtatttttagtagagacggggttttccatattagccaggctggtctcaaactcctgacctcaggtgatctgcccgcctaggcttccgaaagtgttgggattacaggcgtgaaccaccacacccagcttccagtacatcttttaaacgccttgttaacagttattattgagtttctctgtactcacttgttctgattcttccctctaatgtcaaggctaagagtatgcaataaatctagtcatgggttatatgtaagtaaagaatcctgtatatgtccacttgaaataaattggctttattaagagcaagcacatgattctgggttgaacatgagacaagtcattgcttgaataacgtatattataaaatgatttggcaactttagattcacctgttacccaccccatttgttatgcttcccttatgttttatttaaaaatcattgtcctcaggctagatgtagaagttacaggccgtcatcatgtatctgtgtatgttaatattcaccctattgtaattagagtagggttctttaacctccgttcctcttttcctctgtattgatgatctctgagcaaaggtaacttgccaggcattctttggctgattcagaaaattttcaaaagtgaacaaaacaaagctatttacactttagggacgatggtggtaatgcagaagagtgaaaatttgagattatttactcttttttttttttttggtaatttcttttaaggtgtaaagcatcacattttcttcactctttgggttttgttgggggagggagagaaaagataggcttttgctttgtcacccaggctggggcgcattgacaaaatcatgggtcactgcatcctcaccctcccaggctcaagtaatcctcccacctcagcctcctttgtagctgggaccacaggcatatgccaccacacccaactaatttttttatttttttgtggagacagggtctccctatattccgcaggctggtctcaaacaactgggctcaagcagtcatctcacctctatctacttccgaaagttttgggattacaggtgtgagtcactgtgcccagcctcctcactctttgtcgtgtggatttgacttttgaaaaatagccagatatatttagaagggattttagaaatggtttgtcttactaatcataacttggtagtttaatatttttatttgtaagccacagcttaaacccttcagaaaaaagataaactacagtttctatgaccacagtttcagtccaggatttggtaccatagtagttaattatgtagtctttaaagtcagagataccttccctatcttggcttctgttgtgtatcagatatgtgatcttggacagattacttaatcttcactgtctcaggttgtttatctgtaatatggatataccagtagtgtctacttcatagattcagtgactactacaaggtagctagcacagtacctgttgtgtgagaagagctttttaaatgttaaccactatcgtcaacatcctccttatcatctctgaaagctcttaagacagtgctttgcttgctgattagcaaacatttttgctggggctgtttgaaagtgtatgtatactctcagttcaacaaagaagttcatcttccaatgtagtatttggttttaaatggttttctactgtgtctcccttgggctaaggtcctggtatatagagggaatagtggatgaaagaagttgttaaagccatcaatgatagagaaattagcaggtattgcccctttaactatttttagatcctgtatccagaaactgtatctcaaatcctatagaatatttagggtaagtaaatgctactggtgcatttgcttcacttagagcggacagttcttagtctgcacactgaaaaggtttccttttgagagctttcttcatattaagttgagatttgacctatagcctgagtttaaaattagtcttccattaaaaaaaaaaacgtaagtattcatttcaatgcagtttgataaataaacatttatgtaaccaacacatcattcaagataggaaaattctatttccccaatccttatgcccccttccagtcacttcttacccacctccacagtcactgttttgatttctaatagcataattttgttggttcttaatataagcgtaatcatacaagtatttacttttgcattctggctttttttgctcatcgtattgtttgagatctatgttgttgaatataccattaattaattcttctttattgctgaataatatttaccacaattttgtctatccattttccaaatgatggagttttggattatttgcagtttttgactattgtaaataaagccacattaaacattaagtcttttcttacagagataagtttttatctctttggggtaaataggaatggaattgggtcattaaggtaggtgtgtatttaactttgtaaagaacaacctaatccattttcaaggtgataaactcctactagtgatatatgagagttccagttgttccatatgctcaccaacatttgatactgcagatgtatttaactttagtcattgtagtaagtgaaaaggtgtatctcattgtgattttcattttcatttccctgatgacagtgttcagtgtcatttatcagtaattattccagagtcatgtttgaacacattcagttgctcatcaggtgcttattaagtaccttctgcatgctcagtagtatgtcgagcttttaggagtatggttttactttaaaatttaagtacttgcaagatttttaaaaaatgtttcatgtttacatagttttcagttcttaacgtttttgataatgtttcttaatatctccaactaggtcacgtttgtataacaaaagtaagattgtcattcttattaagtagctaaaactccactgttaattagtacatgaagaacatacctgtttatttttgttgctctctaattagatgatacttgatttaatttgaccagtggcctaattatcatgaaattcttaatatttgtacaattgcaggcccctagcagtcttcttgatgctttggaacaacatttagcttccttggaaggaaagaaaatcaaagattctacagctgcaagcaggtatatcattctttgtaggccaaaaagccagagtgatttttctgaggcagtagatgaaaccagctcaagttccaagctgtttaatttctctatatcttgatttcattttctataaaatgggtttaatcataatatcagcctcatagaattagtattaggattaaatggattaatacatgcaaattcttgaaattgtttctgaccttcaataaatgtcagcatctgttaagataatgacagtgactgcatagtttagaattgtgtttatgatgtcaaaatttctcctaaagatgctaatgcattgttttatgtggtgctttgtagttataagatacattttttttttcttcccccgaggcagagtctcactctattgcccaggctggagtgcagtggcacaatctcaactcacttgcaacttccacctcctgggttcaagcgattctcccacctcagcctcccaagggtgggactacagatgcatgccaccacggccggctaatttttgtatttttagtagagacagggtttcaccatgttgagcaggctggtctcgaacccctgaactcaagtgatctgcacacctcagcctcccaaagtgctgggattacaggcatgaaccaccgtgccaggcctataattgcaagatactttcgtattaatttgctcaatcctcacaatagccctgtgaagtatgtagtagcaatgctgggactcaaacctagaatatctgacatcaaattgcatcatctctgcctaatgccagttcatggggttgattattgatattttatattttaatcactttattatgttttaagctaattcctcagactaagaccagttaacctagcaaattgaaagtaacagaaatcatttcatatcagtctggtaacatgatttttgtattgggttaagaaattacttgagttattctcatgttttcttatgaacctttttttaaaacagcatgaagaaagaatttgtatagtgagaaccttcctttggttctttttagactttctggttgtttcagaacttttgatctttcttttagtaataaaatttaaataatttccaaagggaaatgccgttattggattttagtactcatttttaatcctagatttgtactttgaattttctagtaagattttcgaagtagcagtcaaaacaataagtctcatttatttgagagaataacgaaaaaaagagccacgtagttcaggtgcaccaatttacctgaaatgtttatcataaaatttattggttttcttgcatttctgtcacaactatgttattcttcctttgtcttctgaattgtacctttttattggcttatttataatactaatattacataaaatttaaaaggtagtttttaccactttacgtgcttaagagtagaaactaatgatgtttggtgtgtggtaaaaggaaaattaataaagctcaaggtagttcttcaggttagaattctttaccacttgttttacttagcctagagttaacatttggaaagttaatgttgaggtttatagtgtggatacgtttttgataaaagggaaaggaggtgccttgccagtgaaaaatgatacattgtacatgtatattaaaaaggaaattctggtttggcaaaagggcagcacatagaaagatgccaaatggcctgatgactagattgaaaccagtcttcttttgaaggaacctgaagtcctctggggatgttgttataggtgaaacatacctagacttacgttacgtgttactggtatgcatgttttggtgttcctgtggcactgccgaaacgtaggctgtaaattagcagagggttttccctgtgataaactcaacactttttcccatcagggattttgtgggattatgtgggctctttcccaattgcactggtttcctctcttggggcttggaagaggcaatgtgccccactctgttgtgaaccctttccaaagtcaaacacttactctgaaagcagtgagtgtatattaagtcaagatttttctaattgctttaatcctgtagatcactaggtagaatatttcatctgaagtactggatttgaatccagaagttaagtttataattatagtgcctatccatggcaaggttgccagaccatttcatgacctgggtgtaatgtgaagtgtttagcaaaaagccaaattatctctgttcaattatcctagggcaactacactttccaatgcagtgtcttccctggcaagcactggtctatctctgaccaaagtggatgaaagggaaaagcaggcagcattagaggaagaacaggcacgtttgaaagctttaaaggtaagtttgtgcattctccttatttcgaaaaatgagtacaggtgttcattaggtaaatggggcctctgcacagacttagagtcttaaatgtatagctacctaatgggctgaaactcagtctaacttttcgtcctgacatagaattaggtaaaacagaatatctgctatcagaacaaattagaaaatgcttttttcagaggctgtacaaagaaatctggtttctggaatccttatggtagttccctttcttaacaggaacagcgcctaaaagaacttgcaaagaaacctcatacctctttaacaactgcagcctctcctgtatccacctcagcaggagggataatgactgcaccagccattgacatattttctacccctagttcttctaacaggtaggagtagaagttaaggttacctttgaatatgtaggttcaaagacttctaatagaaattttgcagaacttttcaggtttacttttatttatgcttttataatctattcacacaaagaggtggcgataaatggtgatattggtataatacctaaagataaagtgatgagtttatattttacgtatttacgaaatggaagatagttaaatcactgatttatactaataggaatatagctgttatctctgggccaacttttcattgtgtaaaaattatgattaaacacatttatgaggcatctaatggttcaagaccctttatagctctttgacatatggatatgatatatatttcaaaataccatttcattagatattaaacgtctgtcatatctgtttcctggttttaaactctgtaatctggaacacagtgacagagtttagttgccaggtttcttggtattgaagcctaccagactaactttaataatcttgttgtctaatttaagctacttaacatggaaatataatattgccaggtaaagtaaaacaattggcattttctgaacctcagagtggcttaaagtagttttaaaagtcagattctggtttgaatcctggctctgttagttcttaactttttttgagaaaccttgttttcagatgagactgtggttctcaactttaacatcagaagcatttggagagtttattaaactacagatatctgagtcccaatcctagagttttgattcagtaggtggggcctggggcccaagaatttttgtttttaagatgctcccaggtgactaggttttagcacagtgcattattagcacatgttaaatgttccatagagagtggtgagttttttcctttcactttgttgttgctgtttattaactcacccttaaaagctcatctgcctgcctactgactcctaatagctgagcctaatagctcagtgtaagttttactacgtgaactgcttgctgtatgcatgctcagttgctacctgctccctgaaatcttagtaggtgtttgttgaatttagttcttttttttctttcagctttatgatttgtttgctcatgtatgctaccttctttaatccccagttaagtaacattgaccccattaaggggcaagttctcaacatggagatcttgaaaagaagtctgtcctaggagaaagaagtgaaaagaatgttcattgttcgaggctgaaacaaattattggataaagaactaatttcactatgttttatgtcacatactaaaaattttcacctttttaatagtaattaagggcaaatcttacagcccatttacagaattattattgtatattctatatgttccccaaagcactaaatgcgtttatatctactatctacacaactattgtacatctaaaagacatgtcttcaaaacttttttataaaaatacagttagaaggaataagttctagtgtttgatagcacagtagaattactaattaaaaataattgtattatctatatcaaagtagctagaagatttagaatgttctcaacacagagaaatgatgaatgtttgaggtgtgatagatgtcctgataattacatggtatgcatgtatcacaatatcatatgtatcccataaatatgtacaattattgtatatccatttaaaaagaaaaacattctattttggagaatatataagttaaaaattaggagctgggtgtggtggcgtgtgcctgttgtcccagctactcaggaggttgaggcaggaggaaggcctgagcccagccgtacaagctagcctgggcaacatctcttggtctgtttgtctgtttctctctcaatctctctctctcttttgagacagtgacttactctgtcacccaggctggagtgcagtggcacagccatggctcactgcagcctcaacctcctgggctcaagcattccctctgccttagcttcccgagtagctgggactacaggcgcactccgcaatgcccaactatttttcgtattttttcgccattttgcccaagctgatcttgaacttttgaactcaagcagtccgcacgcctcagcctcccaaagtgctgggattacaggcatgagccactacactcagcctccagaccccttctcttaaaaaaattatctgtactgtgtttgaattcttagacactctggggtcatgttttgagttgttcattaaaatcacatagaagtcggccgggcatggtggctcatgcctgtaatcccagcattttgggaggctgaggtgggcgcatcatgaggtcaggagatcgagaccatcctggctaacacggtgaaaccccatctctactaaaaatataaaaaattagccgggcgtggtggcaggcgcctgtagtcccagctacttggcaggctgaggtagaagaatggcatgaacccgggaggcggagcttgcagtgagccaggatcgctccactgcactccagcctgggcgacggagcgagactctgtctcaaataaaaaaaattacatagaagtcttgaggtagaaatatatcatgtaagccaggcatggtgcctcccgcctgtaatcccagcactttgggaggctcaggtgggtggatcatctgaggtcaggagttcgaggccagcctgggcagtgtggtgaaaccctgtctctactaaaggacaaaaattagccaagcatggtggcatgcacctttaatcccagcttcttgggaggctaaggcatgccagtcactggaacccaggaggtggaggttgcattgagccaagatcacatcactgcactccagcctggacaacagagtgagactcttgtctcaaaaaaagcaaaacaacaacaaaaaaagaggctgagcacagtggctcacgcctgtaatcccagcactctgggaggccgaggcaggcgtatcacctgaggtcaagagtttgagaccaggctggccaacatggtgaaaccctgtctctattaaaaatacaaaaattagccggatgcggtgctgcgcacctgtagtcccagctgcttgggaggctaaggcaggagaatcatttgaacctgggaggcagaggttacagtgagccaagatcacgccgctgcactccatcctgggcgacagagcgagactctgtctcaaaaaaaagaagaaagaaatatatcatgtaaatagtgtgttgtgtgatggggtggctctattcataaatgcatgtaaaattttttccctgtatcattgatacatagtttggacactgaggcactagaagtgaggttaatgagtattttactgtgtagtgtattgcaaatgtgattcaagttctgtgaatattaaaagtaagaaaagagttttattaaaaatattaaaattgctgtgatattttgtattttagaatcttgttgtttaggttcattttaatagggaaattagttttttctaggggaagacattcatccttttcagaagagctactgttctttgaatcttatataaacttaagatatgatattagattatttttccaagcctccttagaaatatgctgtcatatgaagaaactgttcctcttttgagatttatattaatgagacttttctcccttgtttttaatgtttttatctgtggtgggtggagaaggtgacactaaagtagcaaagtttttctggtaaataaaacacgtttccaaaatatctttctagcacatcaaagctgcccaatgatctgcttgatttgcagcagccaacttttcacccatctgtacatcctatgtcaactgcttctcaggtagcaagtacatggggaggtaagcattgatgaattctattttagatgttacatgcatctctcctcctcattctgtggtgtttacttatttgtagttttttattacacttgatacatgagaacttgataagtattaaaatggcaatgaagcaattttatcccttgaaggtatgttcatttattataaataatttaggaatttatgttcaattaaattatgaaatgacatttaataaagataaaactaaatgtaagaggaaggaccaagtgtgtttttaactatgagattattcttttaatgttgaatttttattccataaccagaaaatgcatggtggttatttcgattttggtgtagaattttttttttttaacttttggggaataacttatctttgtgttaagtatatgatatagttctaataaaactcagatggtattatcacacagggaacatgttgtgaccataattgtctcgaccagctttatggtcaagacataaatgttttaaatgtttttttaattaagacctgaaagattttgctagtcaaagaattttccccttgtaccaataagaatgtttgctgcccttaagcagttctgaagtgataggcttatctctcatagcaagataagttaattattctaatgagtttttacagtatataaacaaagctttttttcattttattttaatgatttgaatttaagaacattttaaattatttttttgaaggaactatatcctagaaagtaagctctgtgaaggcaggttttaaaatattttgttccgacaagtagtttgtaaatgtttgttgaataaggtggggcacggagcagatagtaaaaccctaaaacactagatttcatggtaattttgtgagcctgaacttgatttaaaaaactaattgactttgaaggctagtttaatttagctaagttttaagatctgagagtaattcctaaaaatgacaagatattaatagtttaaagttaagtattttagaattatttcagaatgaactatagatagtaaattaagattaagaaagcagtttcttaatatcctaatgttatgttctgatttttggattcttaattattttctgccttattgtgaattgctttagaaaaggttagtagaattaacatgaccatttaagcagtttcagcttatttccttttttaaagaaatgtagtagtctttttaaaactaaggctgagttgtttttctaaatagactaaaaattttatagaaggccaaataaaaatatattaaacatttcaaagaagctgaactgcaattcctgttttgtctggacaccatgtacaactaaaaatgacaagttgaagtttctacttgaacttgttaaagtcacatatgaaagcagatagactattactgtggaagaacaattctaagtaatttcagtctgtaagaattgttctatgtcctgttataagacattattccatcaaagtctctatgtgacagactgcaatatattggaatacatttaatcatgttttacttttctattttcggttattttgctttgtatgctgtttctgtaaaaatttcccccatattaagtcctataaattaatcagaattaaatcctgtcttaactttcatataaggatatttggcttctgagttggtgataaacaaggttttgacttctgcatgatactgaagagtactttaagccaagaaagttctaattcaagtcagtactcatatccaggacaatcagatcgatatattttttttaatttttaaaattaaagttagactaaactaacttaaacttagactgaaataaagaaatctcatataaggccaggtgcgatggctcacacctgtaatcccagtactttgggaagccaaggtgggcagatcacatgaggacaggagttccagaacagcctcgccaacatggcaaaaccctgtctctactaaaaatacaaaaattagccaggtgtggtggtacacatctgtaatctcagcttcttgggaggccgaggcatgagaatcacttgaaccccggaggcggaaattgcaatgagccgagatttgtgccaccacactctaacctgggagacagaaaagaaaagaaaagaaatctcatgtatgagaagcttagatcataacattaaatgcttaaggtattttgaagttaactatttacttgaacacttaaatatgtaacattttacatataatgctgctgttatagtatatgacaaagcaaaggtatgatttttttcataatccccaaatcttgtactgttcttttattggcttttattagctaaaaatgaatgccaataacagacgtagtatttaatttagttcttttaaacaccacagaaatgatgcgcattcctagtcatagattagtgataagatagagataaagggaagaaaagtttatatgtatatatgaaagacatttaagattctaccttttggtagaatgaaaatgggagaacacaagctctcttgttggcctcattgtattattaatgagccttgactttttcaacaaatgttgtggagtctaaacaagcagtcggtattgaatactaatatctgagaagacctaggttttcatcaccctgaaaattttggatgatagcaaactttgaatttttatatctaaaaatatacaatattatcagtttggtacactgttgaatatttgaagcaagatttcagattttagtttaggtgtaatagaattatccattctgaagtttaatttgctttacttttagctggcatgaaacacaaaacacttgatgaaaaaatttgattatctgggcaggtgcagtggctcatacctgtaattgcaatactttaggagaccaaggcaggaggattgcgttagcccaagaatttgagaccagcctgggcaatatagcaataccttgtctctaccatgtttaaaaaaaaaaatcagtttagtgtgtgtgaatgtaggtatcagttgtttaggacttaaaggcgataatatgactgtggtgccattttaatccttgttttaactttttttggatttttttagatgactctagtgtagcataaaattaaacttttgcgccaggtgtgtggtggctcacgcctgtaatcccagcactttgggaggttgaggtgggtggatcatttgacgtcaggaatttgagaccagcctggccaacatggtgataccccatctctacaaaaaatgtaaaaattagctgggtgtggtggtgtgcacctgtaatcccagctactcgggaagctgaggcacgagagtcgcttgaacctgagaagcagaggttgcagtgagccaagatcatgcccctgcattctagcctgggcgacagagcgaacctctgtctcaaaaaaatgaaaaaattaaacttgaatgaataatgaaaaaaaaagggacaaaactatatttaaaaattttagactgggtgcagtggctcacacttgtaatcccagcagtttgggagctgagacaggcagattatttgagcccaggagttcgagaccagcctggacaacatggcaagaccttgcctctacaaaaaaatcggaaaatagccaggcatggtgccatacacctgtggtcccagctactcagaaggctaaagtggggggattgcttgagcacagaaaggtcgaggctgcagtaagctatgattatgccattgcattccaacctaggcaacagagcaagactcttatttaaaaaaaaaaaaaaaaactttaagggatttcgaattgccagtttaataggttaacttgaaatagctggagcgttattattataccttaatgaattggtttttattattatagtgtaatgtccattaatagattaacatcttgtagattacctgtagtgttttgtcaagtagattaggaactggttttccttatctgattgatctaattatgaatgcatttgcaaatatttctgaatattcttctctaaggtgtttcacgtaataggaagtgattgaaattaggtgctagataaaacctatctgtcagtagaacagcggatgactggtaacctttcctgaacatgtgttttctcataaaccaatggatctgttacagaaataatgtgtctttaaaaaattacgtatttcatggctttttttgcgtgaaaaacagatattttacttgtctgacaaaatataatgtacttttaaaactctatgcagctgttaatatcatgtatttaaaaacagaacattcggccgtgtgtggtggctcatgcctgtaatgccagcactttggggaggccaaggcgggtggatcacctgaggttaggagttcgaggccagcctagccaacatggtgaaacccccgtctctactaaaaatagaaaaatgagctgagcgtggtggcacgcgcctgtaatcccagctactcaggaggttgaggcaggagaattgcttgaacccaggaagcggaagttgcaatgagctgagatcacaccattgcccttcagcctagacaacacagcgagttcgactctgtctcaaaaaaaaaaaaacaaaacacacccagaactttcagcctaactggccaactgtaagcttaatgcaactcctttcttatgcaagaagaagctagagtggccatcagtatatatattagctaaaatatatatatatttttagtactaaaaaccaatgtccttgttggctcatgcctgtaatcccagcactttgggaggccaaggcaggaggattgcttgagtccaggcaggtgttcaagactagcgttggtatcatagcatctctacaaaaattaaattagccaggcatggtggcacatgcctgtagtctcagctactcggaaggctgaggtgggagcatcacttgagcccaggagtttgaggctgcagtgagctatgattgtaccactgcagtctgcctgggcaacagagcaagacccactctcaaaaagaagaaaacaaaaaaacccaccgtgcccccctgcaacttcttgtaactatttaactattttctagtttctatttctgaattactgttttctgattcttttttcccagtgttccatttattgggggtggaatgatgggaaagatttcgagtttgaatagcataatcagcatattttgatagatttgtaggacttttttttttttagtgtgaattgatgttccataagaatactatatagaaaagttcttactacagaaaaagttgtatttaaaagatgtgttgtttttaaaatcataacctgagtattttcttgatttttttttttcctttttcagacagttgtatttgagcttgtagaatgcttgccttgaattttttgactttaaaggaagtgtgcctatatcatagtaaatgagctggtccttaggccactgttgccttcttaatgttcaatcatacaatcttaagagtaaaatacagtacctagtactatgaagataccacagtatatttcagtgaaggtcaagaactaaactagaacagacaagaagattccactgttgagaattacaggagtatcctcttattttaattatgttacaaagaaaaaattatactatttttgctgctttttattttttctttccccatttagttagctctttaaatcttgagaagtaaggaaaaatagatttcagtcattagaatgataattatcttgaataaggtatcagtataataattatctgactctagaataactttagataaaggatttgatataatacatatttatatcattctagtaggcaaacaacacttttgttgttcctttagcaattcatttaaagactaaagctcttagatagacattcaaaggtgttcgcagtctattaagtggacattctttcatctctgttcttaattatctaaaattctttcccccatccttagatttttttcttcatctttattttttattttgaatctatgcaggaattatctgcacatgccaaaaacagcttcttagccctaatttgtcattaccctctttttttctttgaaagtttactcacaacacacataccaattgtcaatatcaattattcaagtaaacacagctataccaccacgaccagcacactcacctaggacagggaagattggtgcaggatgggtggctctttatagaaacatcttggttattattccattttttaactacctgactgttggctttgtggtgttaacaaataaaaggattttttctaaggattcacttaaaaatatgttaaatgcaattcttctatcttgatgattaggtattttttgtttttgataatttagatatttaagattaataaacaataatatagttactacttttcactttgcatcttttgactaattacaatactaatttatttacttcctttcttcattttgctataatacatttggactgcacagatcctttctctgctactgtagatgctgttgatgatgccattccaagcttaaatcctttcctcacaaaaagtagtggtgatgttcacctttccatttcttcagatgtatctacttttactactaggacacctactcatgaaatgtttgttggtaaagtaccatttaacctttttttccaatcaatgtttatactgcctaactatattttacgtgtccattaattattttaaaagcactgcaatagttactttagattttaatatcaaattctaaaactaaccagccataatgtagtgaggtttttaaattgacactggtatcccaattttatttatacagacttttaggaaaatttctcttgatgttgaacttttttttttttttttttttttggtgtttggttctctgtcgtgttatagtgcaatactctagctgtctagtatcacatgcagcttcctgttttagtttggagaactggttgaaaagtaacatcacttaaacttacatgtttatatgtgattatatttttctctttgtgcttgggagagagggtggttaatcactcttagcagctatctttaatattttatttctcttttaactgttgcacgtcacagttttatattgtccaaaatctatgcatatcttttatcccattctgaaggatttcactttattgatagtatggagataaaagtaggaagtatgtgtttcattttaaatagtaaagcagaaacacgacttggatatcctgtaattacagtataaaaaggcagaatttcacactgaggttatatagggaatagtaagttttaaagtatatgctgaagctgaaataaatgtttttgaattctgctgaaaaagatgctaactctgctccccctcagccccaaagatgatgaaatttcttttgttcagttcagagaaacagcttaacggtgatgtgaatttaaatatttgattaaaacagcatgcagaaagtcatcagtataccctcaacaaatcatgtgaccacattctaaatattctcttagatatatataagtgagaggaaggaagagaaggaagaattaactagaaagcaagttagtagatcagacaaagttccaagtcaggtgttgtaaaaatatgactagtctaatagcttaaaacacatatatatccaaagtgtgataattcattgcagtaattccttcatgtcattttgatacaagttgccagcccttactctataggattaagaacaatccagaaaaatcagaagagctatgtatctagatagcctctgaccttgacagagggaagacatttatctgatacaatgatcagtgtaataggtagcttgtcctcattgaagctttaagaacactgaattgtacataaaggagagtcgtggtcttaactatgctgcatatgtgagtgtctgtgaaagtgtgtaggctttctttcttagctgtaaaaccacacattagaggacacgatagtgttggctaaaaagccaactgcctaatatttcttttctaatgagatacagtgttgggtttttctttctaatttatgcaaacggaatatgtttttttaatacttcatggagccttaagttctttttttagcaagttgtaatttgaagaatgccaagtgcttgggctccccccattttttgtttttcttgattacccatcccactcataactgttcctcctcttctctttcttttttttctcttcttcctcttcttcctcacgtgcctccctagctgcttccctgattctttccttccccttcccctctttttctccctttccttactcctttcctgccttcctgccttgtatgccttgtcagaattttttgtgtcacttaagtttgtcctaatacttcctttatgtgccttgtttcttctactgtagccagctcatttggagctagataacagtatctttacaacttatttatgcaggaaggattttttttttcttaaaatgagtttttataaacttggtaagaaaaaatatacttatttgctttcagagaacacactagtttttgcctaacttcatttgccttaattaaacacttggtggttttatgaatagttgcttatcatcttcttactttactccattctcaaaaccttaaattttcagaagcatgaaaacgttttaatattacaaggttatggaatctgaagttttgtattatctatgtctttccacatatgttcaaggccagtgtggtagcaataaaacctcaaaagtccagctgatattttctgtgtgcatagtagttattactgtagttaagttggcattaaaaagaatgtttgacacaactaaagaattgaggctcttgattacaagaattggacaggactaaatgtattttaaaatggaatttattagggcatttgatggtatatgcttggagcctagtgaacttaggtttgaattttagttctgcttcatgaacttgactttaagcaagtatttaacctttttaaggctatgcaagttgggataatagtgtcttgcaggattgtcctgaagtttacatacatgactatgtaacatctagcattttgctaggtatataaaagtatcaaaatgactactactaaaaaccatctcgggagctgggtacagtagctggtacccataattccagctaattaggaagctgaggcaggaggatagcttgaggccaggagtttgaggccagcctcggcaacatgcaagaccctatctctcagaaaatttaaagaatttaaaattcttgtatatgtggaccacatcataattagaatgtacttctcacctaaattattatgtagtcatcaactaaaatcttaaacattgattttttctttattgcttttagattttaaaattgccaaagattattcactttttttggtctaatattagcaatgaaaagctcaagaagttcataaaatttgggttgtttttaataatagttatagcaatagtaaaaaatttctttttctacttactatattatgtaaggtgaaatacttgggattaaactgaaaaccctaatagattctagaatcaaacaaatgggggttcaagtcttggttctgatgcttactaaatctttgaccttgggtacattatgtaatctctctttgtttcctcatctgtaaaacagggataataataactatgtcatagggtttatgtgaggtttaaataataccctgtttataaagcccttgcatagtgcttagtagtgtttaataaatggtagtagttactttgacaaaaaagtatgagtcctaatttattgtgaaactaccaccaaaatcaattaacaatccacccaaattttgtaaaaggtgtttggaatgtctttctgtccccaaagcttgttgatcttgtacttttcaattaatttattattgtcctcttgagatttaacctgcaggccagtggtttctaaatgataaactgtggattggtgctggttagtgagaaagttttcactgggccttggtgaaatggaagagtaagcaggacaatgtaatgatatcataaagttaaccttaactcagagctcagcgcctgctctttttagcatgtgcgcacgcgtgtatgtgtgtgtgtgtatttctgtaaactttctcttttagaatagtgatactagctgggtctttttgttttaaataacttttaaaaattaaaagttggcgagggccgggcgcggtggctcacgcctgtaatcccagcactctgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgcagtccgcagtccggcctgggtgacagagcgagactccgtctcaaaaaaaaaaaaaaaaaaaaaaaattaaaagttggcagtcctgatagtttcacaaaaagtcgataatgtgcattgaaattatgatgtaaaactctaaccttgttggtgtatgtgtttcaggcatgcagtaattacttaaaagatttttactttggaaatttggaaataaactgcttgcctccctgataactgtgtgactttaagcaaatattaatagccgattagctattgcaatttattaatttctttttttaacttttttttactttttccctctgtttatagatgtttttaaaacttgagatacaagttctgggttactttatagtctttctaaccttgtatacttttaggtaattatgtcataatttcacagattggtacctctaggcacctcaggagatggctcctctttttacagaaagtaatgaagtaatttctgtgtgactataaaggataggcttatctcttatatcaatcatattctagaaggctgaggcaaagtagcaggagaaaatgggaatttgatatattggcctaattttaaattgttgttccatatataatctaaaagttagtgacatcaatagccaagattattaccagaatgatttaaagaacattgtttgtactacttacactctgatgatagcatggacacataattaagcatgatggatttttttcttgagtagatacattcgctttttatgtaaagagttaagagaacaaccaataagctgatggcataattcttaaacatcttgcacacttaaaaatattattaaattggtaagtctaggattctcagatccttttgatgaatagtcagaagatttatatactaaattatttcgtattttgatagtgttttgtgttctcattgtatgaccaatgtctttgacttaatagtagtttaagggttacgtgattatggaacaagatcaaactggtacattctctaaaaatgtgtgcgctacagaatagtcattataggatgtgtaaaatgctactttaaagtagtatcattagtgtggatcagcttgtatggttctttgctaataataaattgttgtttctgtctttgaggaccttcttggacatctcaccaaatcttgtcctactttttacagttttctttgagatcagtctctctagtacagcatgacatcattatactttatgtcctggtgttacacattaagaattcaaagtgagattctgacctgaatagaggaggggaagaaagggatcctaaatttaggacaccaaaagtttaacttctccctaatggtgtagtttttaaccttctaatataggtggtttttgtttgcttcttgggttttttatattctgacttagtagaatttagaaaaggaagagaccttaggagccttatgacattccacgaggtgaaataatttcttctttgtgatccttgtgaagttgatatttatttggatatactcaatgattgaaagttctccaaatcacatgacagacctaatatttttaggggattttaattcttttcagcccctagacattcagaaccttacttaaatataacctcacataattggaaatcttatatttgttaactctgtataggctgatcttaaagatgtgagcttattgtctgtgtaataccactagcattagtgtaacgcaggcaagaaagaataaggtctgttaatggttttgtgttgcaaaactagagtcaccttaattagtatgcttgagtttgtgcttgtcatccccactgttgcaagtactaagttgaagttagagagtggttgagagttgaaagtggcatatcttttttccttgatgttttaaaagcatatggatacaggtggacataaggattagtgagttggaacattcagaatcccatcactgaacttaagctatttcgcttttgattaactgttgaaggaaggatggagagaaatacggaaaatgggtaggtgggagggagaaaaacttttatcttggggctactagaagtttcatacttgttttttaaagcaccacagaattcttactgcattctcagctgatcccttaaatgttttgcttcatgcaaaatcttgtaattttagatgtgtttagttttttaaagattatctgcatataaaattaaggtaaaagataagcaaagatttctgtaatgaagcatattttcagttcagtgtgagttgctcatttgttaattttgtcagtaggatgattttgttagggaaaacgcaatcactgcgaaaaatgtgatatagaaaacattttgcttgaaggattggctttgtttttgtgtggggaatttagtgcattttccattctattgtcatcattattaaatagtcgtaaatgtagagttattaaataattgagcttttttccattttggtttactcaggattcactccttctccagttgcacagccacacccttcagctggccttaatgttgactttgaatctgtgtttggaaataaatctacaaatgttattgtagattctgggggtaaggaaaaaaaattttattaaaaatattataatgtcctaatttagattctgtgtaaggaaaaataatgctgcttttaaaatgtttagatatattaaactggggtagccaaagaaattgtcccatccccccaagcactagatgagaacttcaaggagctgtttagtcattattcttttattggtgccaatttagactttgggaagagtgagttagtcctagagcaaaataagagagaaaaagagatttagctctgtagaatgctaagttgcttgtgactatgtgtagatgttgtgcctttttaggcatacaatttttacttttactgaaatgaataataactgtattgtctcttaatgtatgaaattggctatgtttgtaaactagaataatataacttgtggtaccttgacttgtttaaatagtctgtgtataaacaattagaatgtattaaataatcaggcctgtgggtacaggagctttttattgttttatgaatgattcttattatggttcatttgtcttaaaggaactttatagatctgtagaaccaggtttccactttgtgttttcattaataccttgttaatttgaagtgcctgtaaaactttgacactcataattctgttcttaccatcggatggcctttgattttggttagtaattaacttttagccatttagagagaatatattgagatgttcttaattttataacatataattagttatccttcaaaaactaagaagcaagcctataaagaatatgtatggactaagaatttatttttttctatgcactagtaggtttatgataatatttttttgctgcggtaggttttagtttgtcttgcctgggaaagtggaaagagagaccaatcattgttgtgaactatcatctttggtgactttctttttcaaactgtaatattcctagatcatactattgagtcccatagagggtttgtttgattggattttcttttattttctataatttggtgaggaaaacttaaagaattttattttcatttttaagaattgttctcatttactagatgggcttatacaattacagtatttagcagtttcttagatatagttcactcttacattctctgcttttaaaaaaaaggtctcgaccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgcagtccgcagtccgacctgggcgacagagcaagactccgtctcaaaaaaaaaaaaaaagtctataaaatcttatttcttaacgtaaaaggaacttttttcaaagttccagagagctattttttaacctatattgctttagatataagtgagtcttcagaaaattttgctgggctagcaggagaattacatttgttttttttctcttttataatacttctctcttatcccctttaaccctaatgtaattttgtcatgagataagagatgatttctgtcaaagcaaatacagccttctcagtcaattcagtatgaagtggtgactttcttcattttccatttaaagacatttactaatgtctattttttggataacttttccagtgaataaacaaggagaaaaggcaaagacctcctttagaaaaccatagcgtcataaagttccttacaaattctatttcgtctgtttgtaactttaaggctttgatgaactaggtggacttctcaaaccaacagtggcctctcagaaccagaaccttcctgttgccaaactcccacctagcaagttagtatctgatgacttggattcatctttagccaaccttgtgggcagtaagtagtctttggatacgttaatcttcttttatgttgttttattaaactgcgtctcgtgttataaaatgcttttttgtttttctcctttcctagatcttggcatcggaaatggaaccactaagaagtgagtgtttaatatacacattgttttctccgtgtgttatttagtgttttctccatgtgttatttggagggttgatttggctttcctctcaaaaatatgtgtagagatatcaagtctgcatcttttttttttttttttgacacggagtctcgctctgttgctcaggctggagtacagtggcgcaatctcggcccactgcaagctccgcctcccggattcacgccgttcttctgcctcagcctctcaagtagctggactacaggcacccaccaccatgcctggctaatttttttgtatttttagtagagacggggtttcgccgtgttagccaggttggtctcaatctcctgacctcaagtgatttgtccaccttggcctcccaaagtgctgggattacaggcatgagccaccacgcccagcctcaagtctctatcttactctgttcgatataagtatatagctaaggaaactttataattagagacatttaatattctcacttatgtttatttaaagtgatgtaaattggagtcaaccaggtgaaaagaagttaactgggggatctaactggcaaccaaaggttgcaccaacaaccgcttggaatgcggcaacaatggtgagttgaaaaagctcctgatagactaacagttgaataatttagttaaatatgtaacatgaaaatgtttttaaagtgatagacataaatagaaggattgttactgagtttagaagtataagtaattgtatttctttcaaaggaagctggttgcctatatttaccagatacattttagtggctaacaagtatttaagggttactttgtgccagacatattccagtaaataataatgttttattttttataatcctcctattaatgtgttagtcactattattatccctattttacagatgaggaagtggaggctcagagttattaagcaatgtgctcaggattacagagatcttaaatgattagttgaatttttataacctaggcagcctaactatagaacatatgtccttaatcactactctatattactgacctcaaattttttatttatttttctaaaatacaaaatcttgtgatttcattattggtaaagaaactatacttgcttgggttttgtcatataatttatatatatgacaatgtgtttggcaattatatatatgtcatataacttacacagttgatactcattatttgtggcagttaagtacttaagtcaccccaaacactgaattagtgaacactgaacccttgctgggggaaatatatgcatatatgtatatgtcacatagacggtccttttagaaaacctcattctagtatattctatttattttatgaaagaggaaataaagttcagaagtgttaagtgacttgcttaaggctgtcgcactaactggtgccagagttggaattttagccctgtccagctggccccagagtcagagtttcttgcagtatgatggactccccatcctccttctctatcctctggtctggtatgagagctgaaccaaggcagagtgtcctttgttccatctcagctggaggtgaactgtattggatgagtcaaatttttgcccctctgcaaatgagcatgaatggccttgaaagcaccaggagtgttgatttttggtgtcacaaagtttatcatgtaggtgaatttgcaaatatggaatccatgaataatgaggattaactgtattttctaattaaataattagcatctagtaatgaagaggttttagtatgttttaattactgtaaggtatggtagacccagaatagctctgtggctattctcctgtccttggccagtttctatcttaccaaccaacaaattttcgtcagtcaaagaaaactccttgtggaaaagtttgaagcattctttctccagacagtaggctagtagctgtgttttgattacacgggctacacgttactgacagctgtcctgttactgttagaggctgcggttgtccttatagccacttccagagcactgccctgttttccgtgggttaatgatatgttaaaattagtaggactgagctaaaaatagtatgtttgttaaaatttgtgcattttattatatagcttaagacttcataaatggaaagtaatattgagatttagctacctttttaaggcagtgtttttttgttgttgtttttgttttctttcagacagtgttcattgccatcactaattttattattttgtattttttttttttttgagacggagtcttgctcttttgcccaggctacattgcagtggcgcgacctcagctcactgcaacctctgcctcccaggttcaagtgattctcctgccttagcctcccgagtagctgggattacaggtgcccaccaccaggtccagctaatttttaaatttttagtagagactgggttttattatgttggccaggctggtcttgaactgctgacctcaagtgatccacccgcctcagcctcccagagtgctgggattacaggcctgagctaccacgcccagcctatcatcactgattttaaaactttgcatttaagtagtttagatttttatacacacaaatacacaatcttaaacatgtaaatgttgctgtcttgagggaattggagcatgtatcaccccacttctaaagattttttttttccctaagtgcaaagcagttgaaaagcagatttaagttgaaatccatctctttgactctgaatccagtctttttcccactataacacacctcactgactagggtatggtaggagtttagagtagtggattttatggactcgtgtgaattatgacattgatgatgtatgaggaatgatataaataccagtgctgctattaaaatataatgaatattttcttatattaagttagtattaatctatatgaagtattaggagttcatagatagcacttaagactgactactaaaatgtagtaggtatttagtcatgtagaatttgtatttaagttgataaggtaacagtctttatcttgctgtgttatatatggtaatgtgtatcatctcctaaggattttgctaaaatatttatatgtattttatggagttttctttttaatggctaatgtttggggctgataatgtgattcactacttaagataaactgctgcttttgacatttctttacatttctaacctttttattaatccttaaacactgtcaaggtttttcagtgttttttaaatttaacacaaattcattggaattttattaaaatatatattatactacaaattcttttaattagtgcttgctttttttctgtggtagacatctgatgcaaccctgtttatgcgatgcccaaaattttgcactgttgacactgttgatagaattgatgttttaatggtacttgtaatcaataaactattttttatataaagagatgaggccaaagactacaattcccttgtcaaccttgatagtgttttagtatagatgttctttcattagatactggaaatacaagggattttaggtagttagtgaatgtacatgtgaactaaaatgctctctgtgtattttctgttgtgtaagtacttgttctaatccagtgttattgcattatgtaattgttctccctgggaaaaacagaatggcatgcattttccacaatacgtaagtgaccaaaaacgagcctttttgcaataaattggcatgctattaaccactgctgtagcagaatctcataacctttcagctattacttgttttcacattcagattttcaatgtgccagaaattcttcctagcatctactgatttcatgggtgtgttgcagaattgattctgatggtggcatgggaaataccgattttttttcttgcttaatattccgccatttgctgccagatggctgggtgtctgtgtgtgtatctgtgctgccactatgcacttgatgacttctgaatgaagggaaatgttgattgtggtaatgtttaaaataacaactgcatgaaatcttacaggcttctgctcttcttggcagtttgtctactgctcttgcagatcttggttttaagtagggagagaccaataagtcctacacgctcacccgaatactaaacttataactattcactttagtgttatttttttaaagttatatttcatttaatttctccatgcatatgttcaaattgccatataatttcagttattttatgttttagcagtgttattggtctttcacctttattcaatttcagttttcattatgagaaacacacacaggaaatgttgttaagacagcaactatatctaaaatgattctgttctcaaattgtatgtttacagataatcaaagtagtaggaagaggggaacttaaacatcatagtgatagatggttcttttaaacatgaaagcataaactgacctaattgattgttcctcttaaataatttttggaataaattagaaagctaacgtacatactctatataagaactatggctcatagaaatagtcatactcaatagtagtttgaaacctttggagttttttgaaaagagtgagtaagatccttagaaactaactttttggaagatcaggttattgattgatttgagatctttacatttttttctttgaatgctaaagcaatcaggtacctaagtaagaaaacattcaataatactttttctgggtagacattttttaatgatagtgataggctttaaattttagaactatttagaactatttaagatacttttttaaatctaaagatttttaaagctgtaaaaagcatgatgaaatcttagatcactgctgtatctaagtttaagtggtatagttatccttctaataagtctgcttttctgctaatttcaaaacactttttttcactgaccattaatcgacagttcttaatgatcacaagtgtcacttactcacagctgtcttagcaattctttttagtggaactacagctactaattccttgaactcagttgacacacatgagttatactttcttgttcatttttcctttcactatgttaggcaccccctgtaatggcctatcctgctactacaccaacaggcatgataggatatggaattgtaagtattttcctaggtacagcttttggaaaaaatattgattcatatataacatgtttttattacaatttaacctaaaaaagaatttagtgctcctcatactcctagccctagtgcctaatgcagtagaaccatagcattggtttcataagtatgtctagaataatcattatacaagagatcttatgcattaatgttcatagtattacttggtttatttttctcctcgtaactttgctgggccttttatatttcaaacattaatgttaattctaagcctttgttgctgtgaccatatattaaataccagtgaggtcttataacctgatattgtagggcatgggagggattaacacttgaattgtatagagataaatttagtctgataaaggctagagaaattttcctgtgacaatgattattacagtacaaaaacagtcttttaacctttcaaaatgccacaatgtgcattttagattgcccttagtttcccaactctcagtatatagagactcaattagaaaagaaatggtgctagtagcttcaacccactggtatgtatttgaggaactgttcctggtagaaggcagtaccgtgtcccttggtattgctactgtgcctgctatgttacttctttatgtatatgatatggaagtaactccttttatacatgtggagaagtttcacagctttttttcatagtcattgcattaaaatgtctgctgaggctgggtgtggtggcttacgcctgtaatcccagcactttgggaggccaaggtgggtggatcacctgaggttgggagttcaagaccagcctgaccaatatggtgaaactccgtctctactaaaaatacaaaaattagctgggtatggtggcgcacacctgtaattccagctacttgggaggctgaggcaggagaatggcttgaacccaggaggcagaggtcacagtgagttgagatcatgccactgcactccagtctgggcaacggagcaagactccatctcaaaaaaaaaaaaaaaaaaaaaaagtctgctgagaaactcaggccataaacttaaaatgaagctctaaatgcaaatagtagtctgcttgaaacaataaatagaacttcttgaaaggaaagattttagagcattgcattttaaccaaaacagtattctgtttgtgcattatttttacactaggtattgtcacttactaggttaattttataccctgtagtggtaatttttaaagaaacatatttggttgagattgtattttcagttactcaagaaagagttaacctctggtttgtagtttaagctctttcttgattcttatatgaaataaaatggaagaactagagcaggcttattcagagaatcaactgtcttcacttgtgatcacttgcataatggcaaaagtacttgatttgttatacaaatttactttgaaatatcttagcagcgaagacagagtcttaagttttcttgatgtctaaacctgataaatttggaaactcttagtctaaatcattttatctgttgtaatacaataaagtttacattttgcaactcattgaatcgaaaaagttaggctttgttactacattttaaaaatgagcatgttaaagactttacttaccaaaagaaaaaaaaatactctcgaaagtttgtagctgttagtcttacttatattcagaggaagttaccctttgagtcaagcaaaggtactaggacctgtcatccctgttgtcattgttatttacttagtcacaataaggaagataggagtcagtatcttttgatatttttctcttttttagcctccacaaatgggaagtgttcctgtaatgacgcaaccaaccttaatatacagccagcctgtcatgagacctccaaacccctttggccctgtatcaggagcacaggtattacacactacatgtaactgtggtaatgtgtttgatttggaaggaatatgatactataaaacccttttgtacaacttgagaaacaagttactagcactttctaccttcattatggatattgcttgcttcatatctttcttatataagagctttaggaatattgattatttggagggaaaggataagtagatagcaaatactaaagacagaaaattcttggtaacttatagttggtagatccaaaggatgatttttctgagattaaggagcctacttgctcttcgtgattctggtgtagtatcctttgtgaacctcaaaaccattaactcagagctttagttccttggctaatggctagaatgatgctacagcagggcgtgttggccttgagatgcttgtgaaactcttggcaactctccaaaaagttttgaatgttattttttcgttagataactttctgccactgaggattgttttcaaaaaccaaaaaaaggagtcaaaaagcttgaaatgtcatgctaaacttagatggtttaatccagagactttcctcttgacgtgtttctaaggcttttctctcccagttcctgaaaatacaccataaatatacattgttttttgtcccattattgttgcattagaagaattttttttttttaatgttttacccgttacggttagaagatataggaaattcctttgttattcacttctctggtggcatactctgggatgaggctcttgtgaagtgataggatggtttatccttctgtgtctgtggctctgctcgtactgtttgacatctagaagtggttaattatatgcaattgttagaacacccctccttttcttaaatggttgctaatgctaactgattggttatgtgtttaatgcttgaaaacatttgaatgagcatttgcttagtggacttgttattcccctttcacttgaatgcatatatattacatttgccaaagcatatagtcttacattgccaatattagtttatttgatccaatttgaatctagtctctgtgcacggtagtcccctcttctctttgggggatatgttccaagacccacagtggatgcctgaaaatggggtagtactgaaccatatatatgctatacatacatacctctgataaaggttaatttataaattaagtacagtaagagattaataataatgaataatagaacagtaacagtgtactgtaataaaagttttgttaatgtgtgctcttgctcacggacatgcttgctctctccctctctgtctttctcttgaactatcttaatatcctctacttacctattttcagaccacggttcactttgggtaactgaaaccacagaaagtgaaatagtggactgtatttcatagactagtgaagcctaggcaatcctttcatttctcagccgttttgaataatgcgtctcttaataaattgatatctctgtttggctgagagtgggtagtgaatttagttctgattaaggggtaaaattcatgttggttgcaattaatacatttaccaacatgcctctttttttaccccaccctttgtccatgttaaaatgacttcctccttgttctttaatcagttaagtatttacagtgaaaattgaaaataacttggagtgagggtaattgacacagtcattacttttataagtcagtcactttttgtgcatttgtttttataaaatagactatgagtgtttacagtatttatagtaattgttattgaacttttaccagcagtaatctcattactggtttaacttgataatcttttaagaagtatatggatgatttccctatctgttgtagatgttttcttgatacacagttaatgtctttttcatgtccttttgttttttattttgttatttgtacatttaacttcagatatgtatcatttactttaaaaattattattattattttggtacaagagactaagtgatagaaacctaaatgtatttaagtaattttttttaaagctatagtccatgctaaaaacttattagggaccttcgactacagaagtgtttttcctgatatgtagttaaacccttcacccactctgcatcttgatttgcaggctgttgtcagaatatattgctaccttaagcttggatactaccagacaatttccaattactttcacatacattgtgttagccgattctttaaggtagatgggtctgctctcaccgtcacatttcataggtaaagaagacagacttggaagggttcttcaactaattaaatggtgaaatcaacttatccccaggtgtgtctgattcctagtccagtgctcatttataccacagtctctctgctagtggtactgagcccttactggccaatacggtagcaccatcttctttcgtcagcagtgaacagtctgcacactccttaggtttttctgctaaattgtaaaccacatttacacattcaggatgtaactactatagttgtaaagaatattctctacagttttgggtaataaccttcaaccttgaaacattgtgtatgagttttgctttttaaaaacctaaacatttttttttaatgttggcaaaaatctacctttaaaaaatttcttgttggccaggcacggtggctcacgcctgtagtcccagcactttgggaagccaaggtgagtagatcacctgaggtcgggagttcaagaccagcctggccaacatggtgaaaccctgtctctactaaaaatacaaaaaattgctgggcttggtggtgcatgtctggaatcccagctacttgggaggctgaggtgggggaattgcttgaaccagggaggcagaggttgcagtgagcctggattgggccattgcactccaggctgggcgacaagagctaaactccatctcaaaacaaacaaaaaattgcttgtcacccagcatctgctctgtttttgttttgttttttttttttgagacagggtcttgctctgtcacccagactcgagtacagtggtgcgatctcggctcactgcaacctccatctcccatgttcaagccatcctcccgccttggcctcctgagtagctgagattactggtgtatgccaccatgcctggctaatttttgtattttttttagagatggagttttgccatgttgcccaggctgttcttgaactcctgagctctagcagttcatctgcctcggcctcccaaagtgctgggattacaggtatgagccaccgtacccacccagcatctgctcttaacccaggttttacgtcctgttgccttctaaaacccacataaccgtttcacagaaacaccagaaaagtgccagaatttccttgtgcatgaaaaaaaacagggacagaaataccttttcttaattactttatatcagaagagaagtgaatgagaacattagggtaataagtttctagttgaaagataaaatttgaaatgagtacttaagtattactgaaaaagcaaatgaaggaagcaaattgataactaggaaaataaaatcaggcagcaatgaaatggcttgaagaagctttggtctctctacatagtcatttgaatcatttgaaagtcagaatcttaaatttgttaatgttacttttaattcttttgtaattcctttgttctgcatgtatctaatcacaaagtctcactaattattcctctgctataattagacccacccttctccttgcattctacagctttcacccagtcttggaacctctttattcacacttgttttgcaatagtcactcatgttctctgcctccccgatttaatccgttttgtaaatattggaacaatcttttgtaggcagtatttgtaatacccatctccatactcaaacatttagggaggtgaatcttttttgtgtgtgggtaatggagtctcactctgtcccccaggctggagggcagtggtacgatttcagctcactgcagcctctgcctcctgtgttaaacctcctgcctcagcctccccggcagctgggattacaggcacacgccaccacacccaactaatttttagtagagacagggtttcaccatgttggccaggctggtctcaaactcctggcctcaagtgatcctccctcctgggcctcccaaagtgttgggattacaggtgtgagccactgtgcccagcctaaggaggtgaatctaaatataactgaacatttaaagccttttctcagctttccttccatcttaaaacaacctcatgaagcctccctatttataagactaataatgagttaacggaatattcaagttcttcgattccatgcttttacaattctcaataagtatccagtgttctgctgttatttgtcttttccataagtccttcacctgccataaagtgggtttattctttgtccagtcttcagtcatctggtgtccctttcacatccttatgagatctggaattcttttccttattctgcattattttttcttacagaccttgtgactacctggcatccatccagtctagcaagggctttctttactagattataagcttcatgaaggcaagcttctctggcatgtttacttctctgtccctagttcctagaacagtgcctgacatgtaatagtttttggacattatttgttaagtaaatgaatcaccttgtaaacttacctttttcatcatataacttactctgcccctccttaatctctcatttcacttacttgtaaccattataataacttgcagtggtgttcaaaattggtttgatttgttggctaatagttatggtgagctaaaacattagacggctcacctgaggaatgaagacagctttattttatgtttatgattgaacatttttaataattaaaaattaaactgttggccgaacacagtggctcatgtctgtaatactagcactttgggaggctgaggtaggaggatcacttaagtgcaggagttccagaccaacctgggcaacatagtgagactgtctgttttttaaaaagaaaaaagtaaactgtttatctttgaactagataaggtttttctcatgctttaaagcatgtttaatgattctcagccagtctcttggattaattttgtccgtagaatgctagccgaaaccaaaagatttttcttaatgaattaccttttaattgttctttcattgttttgttccctttttttcaattggattaaaaaattattaagggcagagatcatccatctctttgtatggggtaaagtaaatggtagtttaaatgaaaaatgaaattccatcaaaatggaatcttttaatcaaatctaatttctacagctgttcccaaaattcttccttgctctttgaagtgtttgttttgagagctgttacttacctaaggcataacttgtagctcttggtctcttgcctgattactattatatcaagttaacatttttgagagagctctagccctctcagatacctttatcttgttgccatttagtgagacattccagtgtgttgtgtgtcttacattttatctaggttactctaagcactgcattagtgcttgtttatgaggaagcagctaacaccttccagatggctgttagctcagacttgattcaattcttcaggaaattgtcattatggctttaattcagtagactgcgctgtagctttgaacttatgaattcctatacacatacccttttctccgtgtgtgtgtgtgtgtgtgtgtgtgtgtgtgtgtgtgtgtgtgtgagtcatttttctgtattttttagatattttcatggaattgtttaacaacagatactattgtttttctgtttcatgcctaacattgtagctgtctttattatgttgttctacattagtgcatcttcctagatgtttaacttcatgataaattctaggtccttgtggttttccttttgtttctcttctgtgcttcctcacagtcttactatttggttacttggtacagattgctagtgtgtctggaaaggggactcctgctttctcttactggtgctttacataaattgaaatgtccattgctaagccagtagttcataaactaattctttagttgcaatatacagctattatgttattaagcatgaagacagttatagtttcaattttcttctgaaagtcattgtgatatgaaataacactttttaaatgaatgtttatatggcagtttaggtatttttgaagctctttgggggtgacaagggttgttgttgtcatcttatttccttatatgaaaaattcccactgatcacatatcaatctgcctattttcccagaagcaatatgaaaaatacagagtattacctttgggcatttaattttaaaattaactgttggtttcttttttgttgtttttgtttgtttgttttgttttgttttgtttttttgagacagggtctcactctgtcccccaggctggagtgcaatggcacaatcatggctcactgtagcctcagcctccagggtagctaagactgcaggcacacaccacaatgcctgactaatttttaattttttgtagagcaagcatacatcagactggtcttgaactcctgatctcaagcagtcctcccaccttggcttccaaaagtgctgggattataggcatgagccactgctcctggccaagttttgttggtttcttgactggtattaggcctttttttaaaggaggactgccagttttgtttatggaggatatggttaaagatgcaaaatggctgctgttttttgttgttgtttgcagtggctaattttaaatcagtctgacatcagttaagtgtctgaaaggaaatgatggcttgttgtgagtgctttttatccttctaaatgggaacactgttgcctttagatattcgaataatttaagtcttagaaaaagccttttaaagtactttcttgtatttaagaactagtggctgcttttaggtttcgttttggttttgttttttggttttgttgttgttgttttattctcttggtgtgttaattgtgagtattggcagtacctcctctgtcagccgatctctccagctggatttctgtgaagaaggctttttgccttgtaagcaatgtgttgtgctcattcatccttgcctactgcagaataccatgagggacgtttccttggggattgggatgtagtaccataggtgaaaactagctcctagtacacacacctgaatcattcgaaatagaaatgttagaagtctcatctgctgatcactattgctaacaagacaacttatagaataagaccttgcttattactaggtttttgctgaggacattctcgaaaaggaaatctaatttcttgtcttaataaataaaaccagaaagtattcttaaagtccggggtgcctgtgaagttctgcagaatcttcatgacgaacatcagtgaccatgtataatactgtgtatacagaaagaatgggaatgtattgtctcacatttactagaaaagttcctttaaaaaattatttctctactccaactttaactttttcttgtaaattcaatatagccgtaaattctagctgaattgaaattaattgggatagcagagtttgaagaggaaaaaaacaccagccttggaaccagcagatctgcattagagtttatattatagtttcctaggactgctgtaacaaagtgtaccacaaacttgattaagcatgttaaaagtttttaagctcttaaaaacagaaattaaaacagaaatttgttttctatcacttctggagaaatcagggtatcggcagagccatgctccctctgaattttctagaggagggtccttccttggcttttccagcttttggtagccccattcgttccatagtttgcatctgtagccatttagtctctacctgtcaacatggaattctctctatgggtctctacctccacgtgcctctccttataaggacactggtcatcaaattagggtcactccaaagacctcatcttaacttgattacatctacaaagaccctgtttccaagtagggtcaaatttatgggcaccaggggttaggacttcaacacatcttttggggggtcacaattcagcagtcttgacttgactcctcagctaaccatgtgttgagagcaaattctctatgtaactttgagccttagtttccttacctgtaaaattgtggtattactttgtgtactttatcattttgctgtaaggatcaaatgaaaatatttgaaactgactaagaaaatatttaaaggttgccctgtttttggaaattgttcctattccctgaattgtccttattctctaattctaagaggagaattgggcacagtggctcacacctgtgatatcaacacttttggaggctaaagtggaaggatcacttgagcccaggaattggaggctacagttagcaatgatcacaccactgtactccagcctgggcaacagagctagaccctgtctttggggggggaaaaacagttttagagaggttcagatacaacatacattcaaagtggaatgctcccaggtcactgtgtggcatcccctaaaacaaaatgcgtaatgcgggccgggtgcggtggctcacacctgtaatcccagcactttgggaggctgggggaggggtgcagatcacgaggtcaagagttcgaaaccaggctgaccaacatggtgaaaccctgtctctacaaaaaatacaaaaattagccaggcgtggtggcaggcacctgtagtcccagcaactcaggaggctgaggcaggagaattgctgaaacctgggaggcgaaggttgcagtgagctgagatcgcaccactgtactccagcctgggcgacagagagtctgtctcaaaaaaaaaaaaaaaaacaaaaaaaaaaacaaaatgggtaatgcattcaaggtgacagggttaatgttggcattactttgttatgttgttgatgggcagaaacccaaggtggggttttgttgagcataaacacaagaagcaattatttgtggcactagacttaacccaaaggacagacccctacatgtatatagtagagaaatcctgtcttttagcactatctcacaggggaagctgaggaatcacattatctttaatataaataaatgaaatgcagcactgtataatttatatccttaagcaactggattcaacgtaccactaatggcctggtcatgttttaaacattaccccaaaacagcctaactgttctgtgactcagtgtctctgtggaatcctatttagtagcaccatggtctctaaatgttttgattacacatcagtattaggaaaacatgtttgaagcattgtctaagtctgtttgtgctgatgtaacagaataccatagactgggtagtttataaagagagaaattattggcttacagttgtggaggctggaaagtctagtatcagcgtactgggatttggcaagggccttcttggtgcatgatagtatggtggaaggtatcacacggcaggcagaaaggcagagagagaacaaaagggggcgaacccactcccttgatgagaacctaaatacctcttaaaagtcctaactctcaatgctgtttacaatggcaaccaaatttaaacaagagttttgtagggaacaaacactcaatcaaaaccatagcaagtatgtaccatgactgtatgtgtatttataaaatacattcatatatttctacagcaatatatatgaggtacatttaagcatgtaaaaataggaatttttaaaaataggacagttgtaataatttctttgtacattccactttggagactgtttttatatggagcttgttttatcaccaaaaggcattttaattttgcacactttagaattcttacaatgtgtaattgactgctagttgctgaacaaaggacagataaagtgtttcctgcacctgagcagcctaaaggtgagtgtaatacagatgcacaagtgactggttgataatggaatgagaccccttataagaaagacatacagagcacggcagaggagcaagaacaacacagaggcaatgacatttgagctaggcctcttatatctgtagatgaacatttgatggtaggtagtagggaagatggaactaagaatatttgagctacttaatatatgccaggcagcatgctgagtgcttgtgttcatttaattctcaagacagccataagcggcaatacaggtattgggcctattattctaaatcccattttataagagagttaggattagattcagttccatctttctacaaaacctggcactgtcattccaggcaaagggagtacaatccatttttctcttaagaggttgattttgccaatgagacagaatgaatctctacagcattgttaagtttctacccagtcttttgggtgactgaaaaattcaaatgtaaagatgtggcaaaattggttctctaaggattttaagtacagccaaatgatatgtcacaagttttttcctaaatatccaaccatttagtctttcataagcttttaattccactagcctcactttctgagattgttgatgttttcttgttctaacctgaaattttctttgtttgatgttaacaggagtataatgaaggagtaaccatttttattttatgatagtctatcaatagactttttttaaccttctttaagctaggtgtgtttgtcctttattaaagtcagtttgacccagcctgtacaacattgcaagaccttaactttaataaaaaaaaaaaaaaaaaaaaaaaaagccaggtgtggtggtgcatgcctgtaatcccagctacttgggaggctgagatgggaggatcacttgagcccaggagattgaggctgcagtgacccgtgactgcgccactacactacagcctgggtgacagaacaagacactgttgatagatagactatatgaaacacgctctataaccaaaaaaatcattgctctggatataatgcaaagattttggtaacattttaccgtattttttcttattgattgattagagtagtggaggaggggagaaggaatttaagagatactatcatcaaccacttgcagattttagtatatttatacgctgctcttctcagtatttcatttttctatacatgagaaaagactatgtctgtattggaccattacaattgaccactttgttgaagacatcttcagttgtgacataggtcattttgatttgaacgaactgatagctataccaattttttttggctctgtgggaattttgggatagagaatgttatttgaagtaaataggtaaaggctctttttgtttttgttttgttttaattttatttgtgatagatacctggtgatgtaatagtagggcttgactggaaagatcaattatgatttgtcttggtgtccagaacaacaaattacatatgctctcttgtaaaatttgatgattttgtgctttatgtgaatagctttatgtgaaagcaacagcttttggttgctggtttgtgtttttaattttttatcctctagtactttaaccttgcctttttatgttctttagcaaccctacatcatgttctttaatttactcacagaaataagtagagtcaagtcagctcttatagttttaaaattctcctacttctcacctaccaagaacccattgcctcttcatgctattttgttcttgattttcctgagcagtaattgggctactgaagcacatttcctttccttctcttatttactctctggggtgactactttctcaccagtgcatggtgtgtctgtgctttggaatagatgccaggaaggggtaggatggtcaggggctgctgtatgtcccactccttggagctgtgcagtcagcctagctagccctggctatggtttcatccgcttgatacagatattgatgataagaaacttattccagggatgttgtcttgttttcttattggtggtctctgtcatgttttagtttggctacatttttatagatatgagacgtgtatgtgttttaccaatttaagagactactaggagttctaataaaaaaccagctctttttctcaaggaaaagtaatccttttcaacattgtttataagcctctaggacttgtctagcagtatgctcacatattgaaaatagatttgtctcttccgtattcttcaggggcattttactgtgggtctgtcaggtcttcagactgctaccctggtgaaaacgtgatttaagaaggtatttcggtgtggggctatcataggaaacttctgattttagatgcagtctatctgcaataagtaggatttgttgttgctgttgttttaactgtaggtgaaaaagaaaatctgcttcagagagaaaccaagttcatcttggagataagtgtggatgttggactccctccagctcagtaactgaggatcactttacttgaaatcgttgtgcttttgattggccgtccgtggttgcgctgaagagggaggagggggagtctttccagtagttataccttaatttgtctctgcatggatgatatttgaaacctcaagcccaggcatgctgctctgtcctcccatctgtagctgcctgcgtgattccatcatcgttccatttgtctcttcccattgtctttgaacatttgtttttgggaacaagatatgcattaggaaattactcaaccatgagtataactgatgcctataaattgatcttggcatccagaacaagttgcatatactagtgatgtaatatttgccgaagctcattggctgttcattctctgtagtgcttttccgaaaataaataaataaataaataaataaataaataggtagaaagaaatgaaatcacttggcaccagcaaagaaatcctctataggatttgaatgttgaagtatgaattgaaactatttccagttagtcaacttttattactcactaggacatccctaaaagaaaagctcattttgtaatagtcctgtgcttatatgctttgcaatcttatacagagggagaaaaagaattaaaagcttgttccaaagtaaaaaggttcatgtcgggtttgaaacgctcatgtcagcttaatgaaggatacatgtatgaaaattaatatcttggttcttcaggaatagtctgtgtttgggagaataaagatacatactgaattcagttgtttacttgccttacagtatattcgaattaaacaataggacagattctaagaatcaagtaaatttgtccaaacaggaagcagaatcaaagatcttaagtattccccatattcagggcagtatgtggacagttacagtaggtgacctctaaggtccctttcacctcccacagtatgtgtgtcagctgcagttcgtcaagataaatgagcaggagacaacttcgtgtaaaaagtgtgtgaacctaggacaggacttttcgacccttatgaagaaagaaaggaaagaatattgcagctagatgtgttgggtccggactgaggtcagagttgcacagctttggacagatagcctggacacaggaaaccatgttctctcaattttaaacaaaaatgcaattatgtattccctcccctatccccccaccaccccccatacacacattaaaattcttaaccatgggtcagcttatatcgaccttttgggtaaaagacattattcctttgaaacttcagaagcacgagtttgttttctgaaaaacacatgccattgcataccttttaacttgacatatgactgaaacttttgtcttaacaatccattttctacaaagactgcccttatatttattaaagatgacaaaaccaaaaccacttcttctttcatacattttctgctttcatgttctgtcattctgagatctttttttctttccctctctctgtcttcttttcccccagctgtcggcagcatccagcccctccagtcacagtcctcacagagcttcaggaaaggacccctttgcagagctctctttggaggatttcttataaatcactttaggtattgctacttgttgtgggagatggggacttaaatacttaaaaacaattaccaaacattaaacacaattcacgcttctctttcatttctttaaaggactctaggctccctctcctcctcctcctcttcctctattctttaggtgcagaatgaaaagataggacataaggaaaaacaacttttggaaaatatctgtaacataattatttaaagtaaactcatccactgctcacagtaaatggatgagatcggataaagtttgctttttaattaagggcaagtgaatacttaagccctttcgattagaaggattctgcatatgatccacactgcctctgtttgctggaagacagtgtaatttgttcttcttgatgctctagcccccagtttagatataccttctagatctttgggagtttatagtcttctgatttggcaagtttattagcacatctacttcagtaatagatctttggatgggcagtttaagggaaattgtgagtgaaatatctttgaatgaacagtagtaccctattgaaaaatatttttatggctctttcaggttcttatttatgttaataaaaagacttagtataatattactgttccctttattgtctctaattgtatatcatttggaaataatatttcaaattttgcttcccaaatgagattttgcttgtggtatttgtgcttatggagagatttttctgaacttgtcatgaaaaaataggtcattgatcttctttcttttcctcctccacatgctattcctctatttttagcagttaagtatttggcctggatgtggttgcttatgcctgtaatcccagcaccctgggaggctgatgcgggaggatcacttggggctagtagttcaagatcagcctgggcaatacggtgagaccctagtctctacccccacccaaaaattacccaggtgtggtggcgactgtctgcagtcctagctattcaggaggctgaggcaggagggttgcttgagcccaggagttccaatgagcttttttttttttttttttttttttgagacggagtttcgctcttgttgcccaggctggagtgcagtggtgcgatctcagctaactgcaacctttgcctcctgggttcaagggattctcctgcctcagcctcccaaatacctgggattacaggtgcccaccaccacgcccagctaaatttttgtatttttgatagagatggggcttcaccatgttggccaggctggtctcgagctcctgacctcaggtgatccacccacctcggcctcccaaagtgttgggattacaggcgtgagccactgcgcccggccaaggtttactcttgctgtttgtatgttctatgggtttggccaattgtatggcacatatccactgttgtagcggtacaatgtttatctgccctgaaatactctgtgctccccctcgccatcccttctcttccccagccactggcaaccacnnnnnnnnnnnnnnnnnnnnccccgggttccaaaaagtttttttttttttttttttttttgagatggagtttcgctcttgtctcccaggctggaagtgcagtggcacgatctcagctcactgcaacctccacctcctgggttcaagccattctcctgcctcagcctcccgagtagctaggattacaggcgcccgccaccacgcctggctaatttttgtatttttagtagagacggggtttcaccatattggccaggccagtctcgaactctcgaactcacctcaggtgatctgcccacctcagcctcccagagtgctgggattacaggtgtgagctatggtgcccagccagagctttgatcatgccactgcaatccagcctagacagcagagcaagactctgtctcaaaaacaacaacaaaaaacattatttggaagtccctatatgtgtcaaatattgagctttctggcacataagttgataatactgactttgttttataaacagggtttgtgataagcatgttgtgaacacttctgggccagttaaatggtaaagaccacaaagcatttttatttatgagaagacatcctacaatacaatgaattaacatacccactttttttttccagatacagtttatgtaacttgatggaagaaaatggaattactccaaaaagacaagtgctcaagcagcaaaatccttacttccagcaaaatccaaactgctgtctcttaaatctcttaaactctcttcttccattagaatgctacaagtaactcagtgaaggcccatgaaggaaattgggactagtttataggagaacgtatcaatacagtttataaagccaagaattgctatgatttaagactaagatctgtctttttggtgactaacccttcaattctttcaactcctgttaatacccataatcagtaacctatcaagaaaagcccttatttggaaagtgtgaaatttgtatttggaaaagctgcctggagagaagaactgtgtcctttactgtatttcaacaggactcttttgggggatcaaaattaaaattcctaattatgcattatctttcttttctccagtcctcacaaatacagaaacaataactgaaattaacttttctttttttaaaaaaaattatattcagtttgcagtagacattccttaagtatttgtatttatttatgattatcaattttacataacattaatattgtatcagacctccttatgaaaatgagtatggatgtgcacagtatgtttgatttttatccacaagaatgaatctgattcagaatgcttttctcagctgacatacagagcactaaatattttaaggcaagtccataggtctgaatctcttaagaattctcggcctctgtgggatttagggaagcattataaatgcattaatccttatagtcaattctgtgcctaggattttgccagggaacagttcactgactaggaaaagcactacattttaaattcagcattagtgcattgggaaggatctttactgctttgtgcttggcatgtcattattttccatttgacattagggcctttccaaaatgaatgtgaggaattgctttcacttcaagactttccttcttttcactaaaactctagaaggtgttacaagggggagggaaggggggcaaagtccttgaacattttctttggctcgtgccatgttatgatcatataccttttaaataaggggaaatagtatctttaaagttaatgtctagccaagagtttagtaaacgaagaattaaactgcactgttgatcggtgctttgtgtaaatacatctttaacatttgggtggagaggggccttaagaaggacagttcattgtaggaaagcaattctgtacatgagtttaagcattcttgttgcattgtctctgcagattctatttttgtttacaatattaaaatgtatgttagcaaaatgggtggattttcaaataaaatgcagcttccacaaaagttttgttatggtattctggtctgagatgcattttcatttttcctttctctttttattatcaatattgtcatttttccctaataaaatatacccaggtgattatatttgttgatctaataacatggaaggtttgttttatatgaattttcaaaaagatgtctctttacactttttgttaccttgtagactcttattgataaatgcaactacttattaaaattgttcactttttgtcttttgatcagatgcctttagtcaggtaagtttaagggaaaatacgcagtttaatgttttggtacatataattatgtctgccaaagaaacctttgattgtatcatattgcctatttagtagtgcatagggttcagagtacatgataaaggatcaaaagctttgcattgataagtgtctcataatatttgctgtgattggagaaaaaatgtagtcgtagccaataaattttatcagcttttaagtttcagtattattaaaccattttcatataaactgggaagttgtacttttataagttaccctccttaactttacaaatttttgtcttttgtggtgtttgaggaggtgtttatatttaaggtctgtggcttgttttctttcatattgcctttttttttttaagtatgtttcagtatgtgacgtgcttcatagccatttttatttcattgtttaaacaacttttgggctatgtttgataagtgttatccatattttacccattttatatgtaggaatcagaaatcagaaaaggagctgggtgcagtggctcacacctgttattccagtaatttgggaggctgaggtacatgatcacttgagcccaggagttcaagaccagcctgggcaacatggtgaaacgctatctgtaccaaaaatacaaaaattagccaggtatatgcctatagtcccagctacttgggagactgaagtggtaggatcacccgagtccaggatgttgaggctgcagtgagctgggatcatgccactgcatactccaccctgggtgacagagtgagaccctgtttaaaaaaaaaaggaacttgcccagatgagtaagttaacagatggaaatcaaatctttgctttcatggtcca

SEQ ID NO: 14280 - DNA, 77535 bp, Human; identical to SEQ ID NO: 14279
  misc_feature (1)...(77535): n = A,T,C or G

SEQ ID NO: 14281 - DNA, 77535 bp, Human; identical to SEQ ID NO: 14279
  misc_feature (1)...(77535): n = A,T,C or G

SEQ ID NO: 14282 - DNA, 4833 bp, Human
ccaaacagagatatagaccaatggaacagaacagagccctcagaaataataccacacatctacaactatctgatctttgacaaacctgacaaaaacaagaaatggagaaaggattccctatttaataaatgtgctgggaaaagtggccagccatatgtagaaagctgaaactggatcccttccttacaccttatacaaaaattaattcaagatagattaaagacttaaatattagacctcaaactataaaaaccctagaagaaaacctaggcaataccattcaggacataggcatggacaaggacttcatgtccagaacaccaaaagcaacggcaacaaaagccaaaattgacaaataagatctaattaaactaaagagcttctgcacagcaaaagaaactaccatcagagtgaacaggcaacctacagaatgggagaaaatttttgcaatctacccatctgacaaagggctactatccagaatctacaaagaactcaaacaaatttacaagaaaaagaaaccccatcaaaaagtgggtgaaggatatgaacagaaacttctcaaaagaagacatttatgcagccaacagacacgtgaaaaaatgctcatcatcactggccatcagagaaatgcaaatcaaaaccacagtgagataccatctcacaccagttagaatggcgatcattacaaagtcaggaaacaacaggtgcgggagaggatgtggagaaataggaacagttttacactgttggtgggactgtaaactagttcaaccactgtggagacaatgtggcgattcctcaaggatctagaactagaaataccatttgacccagccatcccattactgggtatatacccaaaggattataaatcatgctgctacaaagacacatgaacacgtatgtttactgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactattgcaaggacaaaaaaccaaacactgcatgttctcactcataggtgggaattgaacaatgagaacacctggacacaggaaggggaacatcacacaccagggcatgttgtggggtgggggtaggcgggagggatagcattaggaaatatatctgatgtaaatgacgagttgatgggtgcagcacaccaacatggcacatgtatacatatgtaacaaacctgcacgttgtgcacgtgtaccctagaacttaaagtataataaaagaaactcaatatttttatattgattacacgttgaagtcttttggatatattaggttaaaataaccattaatttcactcatttatgtggctattagaaaatttaaaattacttacatacgtctctcatattcaactggacagagtgtctagaccaccctttttttattattatttttatttttttgagacggagtcttgctctgtctcctaggctgcagtgcagtggcgtgatctctgctcactgcaacctctgcctcctgggttcaagcgattctcctgcctcagcctcccaagtagctgggattacaggcacgtgacaccaagcctggctaattttttttgtatttttagtagagacggggtttcaccttgttacccaggatggtctcgatctcctaacctcatgacccacctgcctcagcctcccaaagtgctgggattacaggcatgagccactgggcccggccccttattctttttttaatgtttactcttttttttttctttctgctctctttgccacagccatagttttgggtaatttcttttaaatgaagcttcccttatctcatgggttacttacaaagatgataaggaactccaaagacctctgtacttaacaatgcttccgatcctgctcctctgggttgaaacccgggcgccgccaagatgctggcttaccactcttctctcatggatcctgacatcaaactcatcggaaacaaggcactgttgcctatcagaagtcaattcaaacgacctgcccccagagagacaaaagatacagatattgtggatgaagcatctattacttcaaggccaatatcttcttcaaaaactatgaaattaagaatgaagctgataggaccttgataatatataatgatatatataactctctacatttctgaatgtctgaagaaactccaaaagtgcaattccaaaagccaaggtgagaaagaaatgtatacactgggaatcactaattttcccattcctggaaagcctggttttctacttaacgcaatttatgccaaacctgcaaacaaacaggaagatgaagtgatgagagcctatttacaacagctaaggcaagagactggactgagactttgtgagaaagttttcgaccctcagaatgataaacccagcaagtggtggacttgctttgtgaagagacagttcatgaataagagtctttcaggacctgggcagtgaagggagcccgggcagccaccgtctccagagccctgggcagcattttccatcaagatgtacacaatcttttgcctttatttcgtaaagttttatacagaagagagaagagcatgtctttacttgaaaaactcttgatcaagaatttgggtgggagaaaagaaagtgggttatcaagggtaatttgaaattttctgcagcattaagctggcgcttaataagtaataataaagaaatttctaacattcaaaaaaaaaacaagcttcctttgtaacagttctgatattcaaaatgaacaaatgagacaaatctctttaggagtctctacctatgaaattaccttgagaacattgccttttacgttcctgaatcttccatgaaagcttgggttttattattggattctttgcttcctgaggtaatgtgaatttcatttctgggaatttggaagtgattttttggtaacactttagttgtttccatttccttgtgtctgagaaaaggtacattgcaataatggaacagggctcttgggaagatttattttgacttttcctcattcatgggcttggtgtgcttctccttcccctgaggggtctccacagtctctggtgtaccacagaggagcatttgggcctttcctttccactcctctttcaaagaggggaattcagaacactggcattatatgaggggagaagaggtaggatctgatcagcaaattgtctcatgtgcagtttagttactgtaatttggttttatcaagggggacacaggtcggtagcctccaccttggcttctctccttcctcctctgctctcagcactgggtgatggtaggagggggatgtggggtgggggaaaacttcataaacatcttccctgggtggacacaaattatgaacagaaaagccatcattattcttaccacaatggcattaagtatctcagatcaatagcacacccaactgtggagttcaaataagctggtcaatgttagaactcttagaaaagtgaggccactcagatgtaaattagcatgggtgcagaggggagaaaccaccaccatgagaagtttcttagaagtgcttcagcaagccttcaggttaagccctcaattactaaaataggagaaggaaatacaggatgagctgtacttggccacttcaaattgggcaaagtaggagtcgtcgtgatagagatggataaggcctgggggaagaattcacttctaacctgatgctgtcacccactctggacatgttcagaaggcattcatggcggcagatgggggtctaaataatccctcagcacatgggcatcaggctgtgtgccaggtgctgggagcacagggatgtggaaggcaccatccagcctcaaggggcctccaagacagggggagacagacaaagccatcaacgtagtgcagagtgctaagcactgaggcaaggagcaatagcaagcacagagggcatctaagtcaggacaaagggagtggcaggtcacgaatacttcctgctggggaggctggaggtgacttctgaatagaatgtatgaggcggatgaggacagacagcatccgagaaagcagagaggcttttaagaaacagtgcacgaggctgtgtaagagatgagagggagagtagtggctatgtgatgatcttcaagaggtggggccttgtatggtctaagaaacaaggttcttctttgtcctgaaagccacgaagagtcccaagggatttaaaagtgctgatggtggaatggtagggagagtttgcatgatcactgctgcattctagaaagtccacagacagaaaatgtgttagctgggttagatacagtaagactatcagaggaattcaggagagacaagggcctgaatgacaccactgggaacagaggccggcctcagaagactgttaagggggtaaagctacaggtctctgagacagactgggtaggatttaggttatctgtgctgacagagtgtagtgtagccccatgactcccacttaagagtgtgggcaggacctgtgacttgattctagccaagataatatggcaaaggtggagggttttagcagatgtgattaaggtcccaaatcagttgattctgagttaggcaaaatgaattctgccaacaacctgaggcagctttgaagcagctctttccccagttgaccttccagatgagaatacaaccttccacaactaggctgtagcactgtgaatccctgagcacaggacctagctgagctgtgtc

SEQ ID NO: 14283 - DNA, 33748 bp, Human
  misc_feature (1)...(33748): n = A,T,C or G
gtactaagcaaaacccagtgaataacaggaaaggggccttcatatctaagaagaggaaaatgatggagtttaactttaaaatgtgatccttcgatgtgtttacattctttctggacatcgagggcccggggacgggaaggaggaatgaaggaactcggaagcacaggctgaggtcgcgttctactcatgtcctcaactgtaaaatgggcactaatagtgcatagctcacagggctgcagcacaaagacggtgggtagaaagtgcttagcatagggcctggggcagggtatgctctctgcaaacgtcagctaatagacgtgccttcgctcacgggctatggaactttgattcgcggtcaggcaaagacaggcactgtctggggcctctggaagctcctaaatcaggtgagacgcgcaagcaggctggaacctgcattcccaggcccagccgcgcgcaggcaccctcgccgaccctccgctctcccgagccgctccaggacccgcccgctgtggccccgccccggcaccctccaggccccgcccgcgctgccccgccccttccgccgcgcaggcccagagcgtgcggcacccagactcttgcgggagcgagtgcgtctgggagccgcggccggagaagggctgcgggttaggggggcgcgcccgcgttcaggtgaggcgggcaaggggcgctaaaaggtttaagtgtctcctgggaattgagcgatctggagannnnnnnnnnnnnnnnnnnnaactacgcacatgggtattacatccatgcgcttaccagactccgtgcgaccgcatcgtatcatgtcccttctcgcacaccggcagcgattcgccccacaccatgtttcacttcgtcgatcgcacacacttgcgacagcgagcccttctaccacccgcgaatattatactgtcactgatttaggctcctctctctcctttgcagacgacatgcgtaaggctcgacgaaatcttcatgcgctatcttggactacaacgacagacaaaaccccctctgtcctccatcctgcgtggatctgaacctatgagtcctatcggcacctggaagcgatcctacacataacagggcctgtcatggttaggcacggcgtgggggagggccgggccgagccgtgcagttctgaggattggaccgcggccgtgtgcagccgggctggcaccggaggggaatttgctgcagagttgagggctttggagccggcggttgctctggaaggacccgagggtttagcttctgcgttggggagggtccagcggggaaagttagaccaggtgctgaaagccagtgatgagaggccgagaggccttcgtggtctagtgaagaggttcagaacgcccgaagatctggaaatccttggcttccggggtccaactccctggcagctgcctggttttggtattttgagattctgttcagaatagtggcagagcaaaggttgtcactggactagattaactttagctagacacgcaccgtcactgaagaaacttgtgagcaagttgtatagagacctcctaagaggcaggtaggacactgactttgcagttgacagtctgttctatgccagttctgttaagaaggttttattctgagcatcaggttgcttctgcaatttttttttggtgctattttgaagttttgttaaactcacatgctatgtgctgtctcacccgcttcacttatttaggcataggcatgatgaggatgtcatttcaccatgtgctgaagggtgatgagggggcacagttgcttggggaccacccacgtgacttgactcaacacttaagtttctgctatatctttacatggatctgaaatctcttcaagggagcttgaaataatttagtggaacatgcttcattttacatatagttattctagaactgttctttatcattggagaattttggaaaagaaaagtacctgtattacgtaattcacactgtcactcatctagagattattcattgcaggattccagaattggaaataacgggagggaggacctggtccagcttcccttcctcaaataaggaaattgacacctggcgtggtaagatttgtggaatgtggtgtttgtggaatgtggaatatggaattctggtgttttgactgttaacatccttttttcttttcattttagtatgctttttagcccactttgtaggaataggagctggaaaggatggatttagtaaatgttggtagagtgattgagtttaagctccctgtggtcctgttagcattgtgcagtcctgtgctatcaacttgacccctaatcccagccatcagtctgaaaatgttgtggtatgtagttttctgaaggtgatcagcagtgttctgttattacacgaaggagaaaagtagcattaatttacatgattatacggatcaaatggaccaactaaaggcagattggccattgactttactggtggttatggtcaggtgtgtggaacctcaggaatttatatggactaataaagtcatatcagtaaggttcgtttttattatttaaatgttgcgaggttatacaagaggtattgtgtgtagcattaagcacatgggtttgcaggcaggtagacctgagtttcagtactgcctctggggttgggcaagttactgacctactctgattttcagttttaattccgatgtaataacccatgaccttactttgcacagttgtaggaattaaatgagatatgtgaaaggcctggcttttaataggccctcataaagtgactgttagcatttgcattttactagtgtatgttgattttcagcaaattttcttttgtgaaagaacaacaaacaatattctttctctttttcctttcctttttttttttttttgagacagggtctctgttgcccaggctggagtgcagtagcgtgatcacggcttattgtaccctctgcatctcgtgttcaagcgatcctcccacctcagccttctgagtagctgggactacaggcgtgcgccaccacgcctggctgattttttttttttttttttttttgtagagaaggggttttgccatgttcgctaggctggtctcaaactcatggattcaaggggactgcccgcctggacctcccaaagtactgagattgtaggtgtgagttactgcacccagccaacaacaaagaattaattgctaaaaaacagttgttacagaaattacattgtgggagagtgattattggtctgggaagtgtaaattatagattgtgatctgtttatcatttattctcagtctcattttactcatctgtaaaatgaaggcatatgaaatttatgaatttaggagttactgtaggagcattctgagaaaagagctcttccaggtaagacttgaaaattccagtgggaatgctgtggtgaaagggagggaggagagctgtttagctgtaattagggtgcaaggataaggtgtaagaactggctggaggttgaatgttttcctggaggagtgttagcatcaactagatccctggaatttctgcctttctgtctcaagatgcatgtctttgtccagagtacctgtggagaagaaacaatggattccttagaccatatgctgacagatcctctggaacttggtccgtgtggagatggccatggcacgcgcatcatggaggattgcctcctgggaggcaccagagttagtctgcccgaggaccttctggaggatgtgagtagtaacacggttgtgaccttttcctctctgtcagcttccttgtaacagctgtgggaaaccttttccactctacatttccagtcttttgtgctcccttttgttcattttctacattgcaggcagcctgatctcttatcttttttttaagtttagagtctatttaatatccgattaaggaagaaaacaagctacgttctgcatgtttaataacatgccagaataacttgataacatgatttaagccctatttttaacaagataattttcatccattaaaaatggttgtgtattttaaccatggaatactactcagccataaaaaggaatgaaataatggcatttgcagcaaactggatggaattggaggtcattattctaagtgaaggaacttgggaatggaaaaccaaacatcattctcacttataagtggcagccaagctttgaggacacaaaggcataagaatgataatggactctggggacttggggggaaggatgggagtcgggtgaggggtaaaagaatacacattgggtgcagtgtacactgcttgggtgataggcgcaccaaaatctcagaaataaccactaaagaactcacccatgtaaccagacaccacctgttcccccaatactattgaaataataattaaaaatagaaaaaaaaaaggaagaaattatggaaaacaaatatgaagaaacacatcagtgggtatcttttctactaaaaccagaagattgttatgagtacttaatcttcactgtgaaatatttggcagttaatctctccctgacccagtgtcttactgtgttagtaaatctgttagttaatagttgcagtatttcttttaaatgtttttggtttaaacttaaaggtaggctcctttatttgtttggttcttttcaactgtttgagacactttcattccctgatatttatgaagtacatgtttatcactaaatgtagtagtttggtttacattaataatttgatgtgtggtctaaaaatgcagtcactaagagggtgtacactgtggttacggattgattggcagtggagtaccatggaggccactgcagtggtgctaatggtgctaaggctagcggtggaatttctgtgtagggccttaagtcctggtgactcagggaatccatcacagcctgggggtcgttcaccccagttcactccttttctgtttggcctagattgccccatggcttcccctcatcccaacaactgagtagggacccaggaatctgaatgagctgatcattatttatgttcagatgagtaaatgtccagaccagttaaactatggctgtttttctggcggtctttatctgcagggcccaaagttaataaaccataggaaatagactgtcattcttagtttgctgccagggcttattttagattcagcgcgtattggtgcatgggagaggtagtgtcgtttgctctgattttcaaccagtgggctagctggcatcttttgtgctcctggcttttttcagtcatggcacgattgcatctcctagctgttgcttttgcccagcaggataatattgagtcccactgcaagcacggacaaggcctctggttctggtcaccactaccttttcaaccgtagaacatcactggaaatgcttaatgcctggatctattttctaccaaaaacagttccactgggaagtctttcagtgggaaatgaataaatgttatacattgttatgttcagttatgtcaataagaccacttactaatagaaaataaataaacatttttaaaaggtatattttaaaagcagaattatatatgtgtttaaaatggttaccatgttgtggaacattaaacaaaacctacacgtattttctgtatccataaggtaaccctctactcaataatggtacgtgccctgggatgggatgccagcttgtttttgtccactttcacaggcaagatgcgtcattgtcatcattaaggtggctaccgtttattaagtgcttattatttgcaagccactatgtacgtgaaaacattcatttaattatatatttcttttgttttgccatattttgaacatacaggtgtggagcatggtatagcaaacagtcatctatgcatcacccagttttaagagataatttagtttgtttgtttcacattcttctttggtcgtatgccaaacattatggataaaatgaaagccaccagtgtgctgttctctgatcctccctcccagctacagtaacaactgtactgcagttggtgtatatacttcccatccatgttttcttggcatactctttcagggcagtccctttatgttactcatgtagtcagcaaacacttgttctattaggcgcctctatgccagacactgagttagatgctaggaataaaatgtaggcaaaaataggcttgcaggggaagatcctgggcattgggactgaggtgtttttgatacgttcatgcaaagatgcctggagtgggtggttggatttctgggttgtttcctgctgaaaccctttagtgggtctccattgtccttagggataaaagtcacaactacctaaaatgcttgccgtcctttgcatctttctgctgtctgctgcctccacctccctccctgtccttgatctagccaaatattgcctgaactctaaaaaaacaaaaaaaaaaaaaacaaaaaaacccaaaaagtatcacacagaagcgtatataaaatgcatacacacacacacacacacacacacacacacacacacacgtaagacaataataaaacgtgcatgtagccttcagttagggtagggacactactaagaccactgaagcccaccaccacgtaccctgtcttatccctctccattcccccacaggtaactgctatcctttcttttgtgttaattctttttttgtttttctggtgttgctctgtggatttctaaccttctcccccaccgtcttttttctctttcctcatccctctcctgtcttaaccgttttttggtgagcattctctgacattgtaaatgtgggatgtttgcttctatacacatcagcacttctttaactacattgtaactgcatgtttaattgttccccacctcagaccatatatatgccaggccaagttagtattttgctcgtggaaggtatccagtatataactcgggagttgaaaatgaaccccatcctgtttcttctcactcttagctggtgacttcagtccctcaagttcattccttctatgttaaccttttcctgccactcagttgaggcggaattcagatgtccaccctcataccctcgttggcagaggtggcttccaagtgggattctctactaaaatgattttcctctggataattatttactgttggatacaagactgtggctcatatgtagtctttaatctcaagatcattggaattttagtttattttaaaaaatcttaggccaggcatggtggctcatgcctgtaatcccagcactttgggaggccgaagcaggcagatcacctcaggtcaggagtttgagaccagcctggtcaacatggtgaaaccctatctctactaaaaatacaaaaaataggcaggcgtggtggtgcgcacctgtaatcccagctactcgggaggctgaggtaggagaatcgcttgagtctgggagcagagatcgtgccattgcactccagcctgggcaacgagcaaaatttggtctcaaaaagaaaaaaaaaaaaatgtaaaaaattagtagtgatagttgcacagcaaatgtgaatgcacttaaggccactgaagtctacacttaaaaatggttaaattggtaaatcttatgtatattatgtaatgttttgtatacgcatacatacaaaaaactcaaaaatttattttacttttgtttacttttcctatttctcctagcctgagatcttctttgatgttgtcagcctctcaacatggcaggaagtgttaagtgattctcaacgtgaacacctccagcagtttctgccccagtttcctgaagacagtgctgagcagcagaatgaactcatcttagccttgttcagtggggagaacttccgctttggaaaccctctgcacattgcccagaagcttttccgaggtttgtagctcagtattctttctttgaggggggtggtggatgggcacacgttcactttatgtgggtattcctttcttccttttcttctttttatcttcatgtacagatactgaggcagcaaagagcggttttgtgtaacactttgctgtctaggctgtgttttaaaaaacaaaaatgtattgacttatatagaaaatacataatatgaattcagcttgtaaccagcatcagcttgtaaccagcatctacataaaaaaataaaacatttccagcatactagaggtgcccttcatgtctggtctttaaaaaattttaaaaagagcttgccatttgctttattgcacgtatcaaggttcgtgtgtgtgtgtgtttaggtacacacacactttttgctgcagaaaatatgacacttcactgccaagcacttcagcatgtccatgtctcttaacagacactttcccatatcatcaccgccctgttaccacactcaaggaattttacattgagcagataatatcataggctatttcatgttcaaattttcttttcttttctttgggacagagtctcgctgtgtcgcccaggctggagtgcagtggcgcaatctcagctcactgcaaactctgcctcccgcgttcacgccattctcctgcctcagcctccctagtagctgggactacaggcgcccgccaccacgcctggctaattttttgtgtttttagtagagacagggtttcactgtgttaaccaggatggtctcgatctcctgacctcgtgatctgcccgcctcggcctcccaaagtgctgggatcacaggcgtgagccaccgcacccggccttcatgttcaaattctcttgattgttcctgcaatgtcctttagagtagctgtgtaaatccaggatctgttcagggttcatgcattgtgcttgggccttacgtctctttagctttttgaatctaggtagggcgctttgccccttttgtttttgtctttcagtacacgaagagccaggacacttgaattataaaatgtcctgcttcttgggaatttgtcattttgttttctcatggttagattgggttaaaggctttcggcaggaatatgatataggaaatgtggtctttcccattgtgtcacctcaggaggcacatggtatcaggttttccattttggtaaagccacatttgctcacttggttaaggggtgtctgcggtacctcttgcttgtaaggatactttattcctttatcattaagaagcagtgtgggatgatactttgggatcatggatcatgtgatagtctcattttccaaaagcctttgtcttacccagtagtttctgcttccatgggtgattctcaactgcatcagttactatattgggggttgtaaaatgctttgggccactctttaagttacagtttgctttctggaccatggagaggagccaaggaagcctcttcctcttcccttccagggtgactttgttctggcacaaggccctgaatgggcagcacatctggaattctgttaaacttgacaacttgacagctgctaatgaccagagagagtagccttttcacctgaaatcgcattatattaagggtgtaaaatgaacattcccttctttggtgggttactagtgtaaaaaggaattcccctctatggttggcagagatctgtttcactacagctgagggtgcactgtctcctctgatagagcagaagttggggacccacttggctttagaggggctctgtaagggaccttccataaaggtagcactgtctcttttgctggcatgtttcccccgaaacagtatggtcgtctggtaaggatacagatgaggaatgtcaaggcaggacttcctgcatattccactctgacccatgccatgtgtcagttctagtgctgctgaagacagttgcattactgtggctgtgatgatcatcagccttaaatgagctgtcattgcttctcagcacgcttttacttttggttctccttcttgattctcttaaatgttcacttttcccttaagttttgtggtacagagtttaccatgttaagcactcattcaatatatttgttgactgatgatgtatatttgttgattgatgtaaatatatatacctttatttttttaagacggacactttaaccccgaggtggtcaagtaccggcagttatgcttcaagtcacagtacaagcgctacctcaactcccagcagcagtatttccatcggctgctgaagcaaattcttgcttcccggagtgtaagtagtgctgggaactggatataaaatgtgggcagtcacaggtatcatgacttcaagaagcaattcaggtgcaaaacacaaaaattgccacgaagaaaaaaatgctaccaattaatctgtgacacagttaagctatgccatcctttcttatgataaacttcaaatgtgtcctgatttcagagatgttaaaacataaaatgtgcttcttaaaattgatgaaattatagtagcttcagtgtttacgaagataaacagatggattttggatctatcatgggttattaagggaaacgaggattccttggaatggatatgaaagtgtgcatgggcctctgaatgctgtgatggatggtagcataacaggcccaatagcccctgggtctggaccagcctggaaattcttagaggcaaagttgtttggattttaagtcatcctttaagctttggtgtagaaatacttgaatgtctagtataaaaaagtattcattcctagtagagcacttcaacagtcagatttgggatttttcatgtaatcaatatagattcttcggatatattaatatatatgtgcatctttctttgtgatctggagggagggagttgggcttaacactgaagagaagaaaatgtagacttgtagagtgttcattgttccagaacaggtcttggatgatgacttgtacccccacctgatctctacctaggatctgctggagatggcccggcggagtggccccgcccttcccttccggcagaaacgcccttcaccatcccgcacacctgaggagcgggagtggcggacccagcagcgctacttgaaggtcttaagggaagtgaaagaggagtgtggtgacacagccctgtcatctgatgaagagggtgagtgtcctcgggcacttggggtagctggggtattggatggataccggccacttgtccggttggagccagtggtagccatttatctccccagcaaagaaaccctcttgagttgtctggtctggggtgcatagcgggactcagaaggccttggtctttgggttgctgagacattgccatcagatggggagtgactccatggcctttttcacccttgtggccatgtggcatttgagcttagatgagagcccgccagacgactccctgcacgacggggttctccacagtgggcctgactggtcccatttgccacttgagagaactgttttccccttacaggagagtagtagtggctgttggcctgctgcaatgcaaccccagcactctgttgaagtctctcttcctggaagagccgttagatgacctaagtgtgctccagctcctctggggtagggtcagaaaggattgtggaaccctggcctccatgttgttggcttagccttgttgaacccaaatggccacttacccaatctcccctattggagtccacagccacgttggatttacaagaacaattttcttttgaagatctcagctcatggcttccgagctctccagcacgttctcctagtcctgcggtgcccctgcgggtggtgcccacactttcaaccacggatatgaaaaccgcaggtgagaaccaagctgccgctgtcaccattctgggacattgcggtggagacctgaaaactcctttagagggaggtgggtgggggcagattcctacctaccaggaaaacaaaactccctagaactaggtgatttgtttggcaaagtttttgtaccattttacttttttttacatctggagataggcctgccttttttcttttgttttaaaattttttctcagaagctgatattttgggctaaagaaagcaaaatcttgaaacagtagtacgaaggggcagtgcggtaagcggacaaaggaataaccagagccaagccgttctccagagtgtctgtgagtttggagaagagtttttgtttggaacaggaagcaaagatggttaagaactttaagtgtgttttaggaccagctgagtcacagaagtcatatattaccaacgtatggaaaagtggaagtgtcgatcctgtgactttaaagatttttggtacttgtagttcacaggtgtcagaagggaaactcagaaatatcttacttttgacaagtgaccagaaagatgtaaattggagaatcatgatagtgaatatggtttggtttgttttctcagataaagtagaactgggggacagtgacctgaagataatgttaaagaagcaccacgagaagcggaaacatcagccagtaagatgggaagggcgtgcggccgtgtggttttcagcctgatgtctcaggattggctgtcctgaggaagacacggggcatcactgcctcgtctgtatgtcctccctaccactgtgggcacaggagcagctggcgaggctagctagcatcaacgatgtgaggcacggtggctttgacttcgcagggcctgctgaatgtagtgtctgccttaattgttacagtgacactgtcgagtataggaatcgtctccacctcagcagtgctcaagaggttagggagcttgtccttggtcctatagccaggaagcagcagagccaggagttgggccctgggtttgtcccactttttactgtttccattattccatgctaccaagttgaggtagctagcaccaagccagagagttcagtggagaaaagatgatacctttttgggaagaaaagacagtccttctaagactaggaggtgagatgggaagaaccccacatcagaagtcagtactgagttctctctcttttctagttactgtgatacttctctaaagcccatttccagactctgtaaaacatagtaatacttaacaagactgtttgcaaagcacatgagacaaggaatgcagaagagctttataattaaatgctgtacggtagaaagattggaactgggttctgtgcagcagtatcaagttaattaaatggggatatgatagggaaaaaatgaatagttttatctctctatatttttgactcaatgtgatttccccaagtgtacctaacatctaattgttacataaattggcaaagtcacctcagtttttgctcctttttgggcctccatgaccaaattctggatatcacatctaggatcacccggaccttttgacaggggacctgactctcaatgacatcatgactcgagtaaatgctggcaggaagggctctctggcaggtaaatgactgggcccctctaggagccttcatctgactatggtgttaagttgcgtgagcccataacatggcaaaaataaatgaaaccatggcctctctcatgctggtaacctttattattacctcttacaggctaacaggtgggaaatgaatgtaaaatcagtacaacagagcatcagctctttaataaatattaaaattaagctgtatacttgggaggctgaggtgggagaatcgcttgaaccggggagattgaggctgtagtgagctatgatcgcaccactgcactccagcttgggcaacagagtgagatcctgtctcaaaaaaaaataaagctataaatcactcaatgaatttggtttcattgagtgttttattactgagacttttctgtctttggtgggccttgggaaaagaatatgcagataagacccctcacttccctgtgtaggagatacatttctgtgactggtgttactttgcctttctagccttatatgacttggctgtccttaaaaaaaaggttaaggaaaaagaggaaaagaagaagaagaaaataaaaacgatcaaatcagaggcagaggacctggccgagccgctaagcagtactgaaggggtcgcacctctctcacaggccccctctccgctggcaattcctgctatcaaggaagagtaagtgagcaacagagattctgtaattctcagggtgaatgggtaagccataggctgtgccctggcccctagggcttgtcgtagctgtaagtatgttggacttgtagacctgaagtcccagggatactgctgggaaaatatattgtttgctcctttcttgaactcttttatgactgctaggaggcttgggcgcctgaatcaatctagggatgtgttcttggtctttttggttcttatatttttcttccctcattaggccccttgaagacctcaagccttgccttggaatcaatgaaatatcttccagcttcttctctcttctattagagatcttgctgctggagagtcaggctagccttcctatggtaagcgttttggaaaagttggaggtacattagagttttcaaagtgttcaaatcctgaatggtctatagcttgagaagtggaactctgagttcctctcaacgctctgtagttaacttgctttgtgattcggacaaacaccggatgcatatactgcaggttgtggtggcacttgtgtggaattgctggtgtggaagagaagtctgactgggttctgcctttgctttccctcagctagaggagcgagttttggattggcagtcatcgccagccagctccctcaacagctggttctctgcggcccccaactgggctgagttggtactaccagccctgcagtatcttgctggagaaagtcgaggtaagatgctcttttttgtagggtcagtatttttcccccttttgtctaattaattattagaataaactgcagctttgctcgtgtaatccatcatgcctttgcataatgctatgccttgaaggttcctgcttttctaatacattgtggaacactcaaaagctgtttcggagctcagggacgcacctgtatggtttgtttatgtggtccatttcttgcagctgttccttccagtttctctccatttgttgaattcaaagagaaaacccagcagtggaagttgcttggtaagtgatccgtattacctaccccaacaggttttcgttctcccatttcttcccctaagtttatttgccttccagtcaatatagtcctgcagattggttttaaaaagcaatatcagaccttattttgctctgtgaaggagtccttcaacaccctttttgtactctcaaggtgggttaactaactcctctggttggaccaaagctgagatggaaggaatagcctttctgtatgatgtagtctggtgatggctaaatttaaatctgcaagggtattttgcaagagcatcgacatttatattaatcatacagatgactttggattaatttgtaatataaattttttctttcctaaaaatgggctttgctattgaggagagtgtgcagcagccccgaataagttgtttctaaagaacagggttgttatttttaagtttataaagcccacttagtgtgtaagttgtcataacatgcatctgaagtcacttggaggctgttacctggtgatggtgaaaagagagaaatccagtgttggtttcttcttgaaattcacaggcacttctctgtgctgagtggtctgtggagaagcgtatggagagcaggttatgaaaacggtagactcattcattcgttatttattacatttattcagcttctgggtgtcaggcactgttaggtgctgggggacacaatggcttctgagacagtgtgctcctctcgtagggcctaaggtctgtttggggaagaaatacttacttagatttaatgacaaaatgatcctttctgtgaaggaaaagtaccagagaggatgggggtttatgataataggaattgatgtagtttgcagagtttggaggaccttcctgaggaagcagcatctgagcagaggtgtatgatgaatagcactgagccagacaggcagaggggaggcagcagcatttgagatggaggaggtagaacctttccatggggaagatttgatctaaaacagccacacaacccacgggctgtgagagctgacggtaatttagacacagggagagaggatggatacgtttgagaaagacttaggtgggcttggttatggcttggctgtggggaatgaaggagaatggtgtgaggcatggctcctgttagatttgcagctggtggaggaaggtgttgtttgtgcaggtagcagctgtggaggactggacttggagggtggagatcccgagtttagtttttaaaatttatttatttattcatttattttttgagacagagtcttgctctgtccccaggctggagtacagtggcacgatcttggctcactgcaacatctgcctcccgggctcaagcaattctcctgcctcctcctactcctgagtagctgggaccacaggcgtgcgcaaccatgcctggctgttttttgtatctttagtagagacaaggtttccccatgttgtccaggctagtcttgaactcctgagcccaggtgatccacctgctttggcctcccaaagtgctggattacaggtgtgagccactgcacccagcctgactttagttttagagctgcatttgaggtatttcagtggagttgttgaatagacagtaggatgtgtgggtttagaattcagaccagagagtttaagggggagagtgttggcatgtgtgtggtgcagggcacagatgatgctgttacctgaggaggaagcacagagtgaggagagagggccgaggagggctcttcacggcagaggggctgagtgacagcatgagagtgcgggggcaggggttgactatagagatggggaaagcctggagcagggttttcctgagtcttgggagccaggagaccggatcgcctgagaagtggggagtggtcatttgcctccatagttcctaaaagattcagtaagataaagactaaagatttgcaaacatggaggaagttgtgaatttttcagtgagcgtgattctctagtggaacggtggaggcgaagccaccgtgagctgaaggtgatgatggtagctgactgcaagcactccccccatctgtcaggctgcagtagccatggagggagcacatatacctgggcctggcagaatgtttcttgtagggccagataataagcgtttgaagcttgtcggccagatgctttagttgaagctactctgccattgttgggaggtttctgcaaatagtgatattgtgtattgaccatgaaaacaaaggtaaacagcccctttgagaagggtagctgcattcatcacataagcagacctggccgatgatggtcctgtggcttctatgctgggcaggagacacaggtgccatcagggtctcagacagcctgaacagagtgacctgagaagagggcacaggagacagggcttatctctttctaggcgggttgtggaaagtcaagctttttcctgcccctgggtcttaactgctatgctagtgaatagaattttctctgtgccccactagccagaagcctttcttacctacaaaaatagaataattaccttggtataagctatgatgacatcctttgtgatgcttaccactttttgaattgattttaaaatatgtgctctttcctcacttgactgtaaactcccatgagggtggggactgaattcaccgagtaaccttagcgtcacatgcagtgcgtggcacagtggatactcagcgaatgcctacggagtgaatgatttcattaggtggcatccaagagtggtggtccaggctgacttccgccagctggaaggcagtggatgtgtgaaggattgttgctacagctcctgatagaatctctctgtgttgtagttacagctagtaaagagaaagcaggattctcaataataccttagaccttcttatttttttatctctttattcctctaataggccaatcccaagataatgaaaaggaattagctgccctcttccagctatggctagagaccaaagatcaggccttctgtaaggtatgtttttttaagaaataccagatccttctcactgggtttccagagctcttaagtttgcccaaattctttagtccatttacctgtcaacgttttctttttctccagcaagaaaatgaagacagctcagatgccacaacacctgtccctcgggtgtgagtacaatactgtagtggtgggtggtgtcctgggaaactgtagttcagatactgccttggttttgttaatacttcttggtatgctagagctgtaatgggcttcagagctctgaggagtcccctggttcttcctgacttggccgcaccccctgagtgaacgggactccttgtggaaggggctgtggtggagagaggggacggcaggagagcctctaaggggcatatgacctgctttgtaggtggacatacttttttaatgtgtactcctccctgggctcctacttgagaattattcatctaggccatcttagtccagtaaatggaagcatgaagttgagtgacttgctgaaggttagcagcaggaccccagctagaacttagatctcttgactcttagtcctaggctctttatatcacattgtcccatgtttctttttcttccctggcatggttcggtagttttctgacaccaggacagaggcccggtctaagtgtggcagaacttttgcttcatgtaatagaggtgtagatctcaagccccgggtactttccctggaggtagaaaaacaacccttatctaacacacctgaagccctttgttcctctaaggccgaattgtttgttgcctttagaacggacctacttaacagcaatattgaaagcagtagttaaagatgtcagcctcttgtccatctatccacccagtacctttctgggtttctaagaatcaagtgattttggaattaccaacaggagttacttcgtaggagctggaaggtgggctcttcgcctttgtaagaattgagtgcttcttgagggacatctttccatgtcacagtgggaatggttctgaagcaggggcaatgggtctgacacacgtgccagctgtcagggttgatacagaattctttatattccagaagaactgactatgtggtgcgtcccagcacgggggaggagaaacgggtttttcaggagcaggtaagaacctaaaagccagtgtaagtctctgcctctgtgagccatgcagagagatgctctgagcctgactctcctgcatctaccttcttgcaagaaactcatacctttccccttagaccttctgttggctgggattacttgttgggggtggaaacggtgtggggaaggggagtaagaaatacttggatgatcttgtcttccaggtagcaaagtgccttcatattacctccttgtccctctgctcagtgactggctctgagaaccatccttttcccactgtggttggctgaacattcctactagaatcatagaatcacttgttccttcctgttttaattgttccatgtggatctgcttatattgtaaggaagcccgagagagaaccccactaattctgacctagaactcttgtcccttgtctcttggtaggagcgttacaggtatagccaaccccataaggcgttcacctttcgcatgcacggctttgagtctgtggtggggccagtgaagggcgtgtttgacaaggagacctcgctcaacaaggctcgggagcactccctgctgcgctccgaccggcctgcctacgtcaccattctgtctcttggtaggtggcacgtgtcgattatcagagatccctttcttcaccccgcagcttttctcttaccaactctgaactctgtcctctccttacccctccacccagggtaggctttgagaacaaggcatagtttttcaaagcattgcagtttgggagctgaaggggacatcttcagctcccagtcttcttccttaagtctgggcttacatttatgttcatttaggagttgctcccagaccagctaaataggttaaatacaggaatttgctttctccaggctatgcttcatttaacagtgaggattcttagctttttgaatgccaggaatccctttggcagtctggtggaacttgtggaccccttctcagagttatgcttttaaatgtatgaaataaaatacagttacaaaagagaccagttgttttgaagtagttatcaaaatgttaaaacaagtttatggtgcagaaatatgtgttgttactatgatgttatatgacaagatctagcaggaggtctgacatttcttgaaatttccaagtagtgatgagtataaatgatattcttagctatctgcagtagctgtaatatatgaaaatgtctgatttctattacaccatcacagcactgcagtatatggtttgttccctttgttcataattaaaggaaatacttaatttcagtttaagatgtaattttgcttcccacctgagttcacaggccctctgaattcttaaggtgttacctaaaagtgactcttaaaagtgtgtaagggctggatgcgatggctcatgcatgtaatcccagcactttgggaggccaaggcaggcggatcacctgagctcaggagttcaagaccagcctggtcaacgtgatgaaaccctgtctctactaaaaatccaaaaatcagctggacatggtggtgcacggctgtaatcccagctactagggaggctgaggcaggaggattgcttgaacctgggaggtggaggttgcagtgagctgagatcacgcccttgcacctcaacctgggtgacaagagcgaaactgtctcaaaaaaaaaaaaaaaaaaaaaaagaagtgtatagggaactccagtggctgagctgccagctgctggagggcagagtgcacctaatccggcatcagggaaggtagaggagcaggaaccccaggcagctttgcccatcactgcaggtacaggagattgtacctccgtaggaaccctgcctgacttgtggactgtgtgctttctcatgtcatcagttcgggacgctgcggctcgactgcctaatggagaaggcacacgggcagagatctgtgaactgcttaaggactcccagtttcttgcaccagatgtcaccagcactcaggtaggacggagaagagattacttttgctttgttccagaatggatttaagaaaacttatcaggaaatacaaaatataacaaaatttttaaaaactgaatgaagtgaaaaacataccttgaaaaatgcatagtgatcaaaacgcttgctgttagtgaaacacaaattttgctctaggctttcttttagcttatgataaagggcagactggtcacttacttcacagtatccttatagtaaaaatagatcaatacctcagtagtcttaacagcatttattgtctcgtcaaacgatttggggaactattgggaatacgcagctaggctgagatagaatctgcatcagctgtgatttagatacaatgacatttttttcctagagtccaaataacttctgttatctaagcttgacttgtttcttatttccctttgtctgatttgtaggtaaatacagtagtgagtggtgcactggatcggctacattacgaaaaagatccctgtgtgaaatacgacattggacgaaagctgtggatctacctgcatcgtgaccggagtgaagaagagtttggtgtgtgaggcctctgggcactgtccgaccagactggggatacgttctgactttctaccccaattccattattcttttcattggcatataggtaggacaagatggtagaggcaggattcagtccactggcaaggtgttggtttttaacaaagcccctctttttagtttgctaaggttaaactctggctgaagcttgcccctcttgttcacagagcggattcaccaagcacaagcagctgcagctaaagccagaaaagctcttcagcaaaaacccaagcccccatccaaggtggtaagtgacttcaggagagtgtctgccctagggattctgggatggaggcaactaagagtggctgctcggctttcacttggtgtggggcatcaggagctgtaggggtgtcccttcctttagggggatcttcacgacaccaggtgggttttctttgtcttccgttctagaagtccagtagcaaggagagctccataaaggtccttagcagtggcccttctgagcagagccagatgagcctcagtgactccagtatgccacccaccccagtcacacctgtaacccccaccacaccagcattgcccgccattcccatctcccctccacctgtatcggcagtgaacaaaagcggcccttccacagtctcagaaccagctaagtctagctcggggtaagttcctccttttcttcagctttttcgttctagagttcttttgtatgcatgtcctaagtttttgttttttgtctttccccgatgttcttcatagtgttcttctggtgtcttcaccaacaatgccacatctgggaacaatgctttccccagcttccagccagactgcacccagttctcaggctgccgcccgggtcgtgagccactctggctctgctggactgtctcaggtgcgagtggtggcccagcctagccttcctgctgttccccagcagtcgggagggccggcacagacattgccacagatgccagcaggaccgcagatccgggttccagccactgccacacagaccaaagtagtgccccaggtaaacagggaagccgtggtcattgggaagcagagatgcagacccagaggtgggctgatgagtcagatgggcagtgtctgggtaaggactggggagccatagattattgctactggtgatgacattcatcggaataagccactgaatgttcagagctgtgtaagcgtttttagatagtgtgtttatgtgttgggaatcagatcttcagagcagtctggtggtttccccgggaccctaacatcaggatcttcgtagaggcgggttgtaaatgcggaccttgtgagtctgcctctcaggctccttctgctgtgcctctagtcttagctacgccatgaactagttgtgtgagtttacagaacatttgtatcctctttgtctcagtttcctttgctataaaaggggtaagatagtatttgtcctcagtgtgtaggaataaaatgagatgttaaatgtaaaattctgaaaattaagatatacacaaatgagacatttacagtgtccattttagagagtggtgtgccttaagtactgtgggattagaagctctttgagagcaatgcttccggggtgctgagggagactcttgcttagagtgctggtctgcatcttagagtctaattaagctctcggcctcatgccctcaactagacagtaatggccactgtgcccgtcaaagcgcagactacggcagccactgtgcagcggcctggacccgggcagacagggctcacggtgacaagtctccctgccacagccagccctgtgagtaagccagccacgagttctcctgggacctctgctcccagtgcctccacggctgccgtcattcaaaatgtcacaggacagaacatcatcaagcaggtaggtggggctctttccacgtggatctcaatccttcatcctggagcagggaccactggagctggaggttcttggccagactgcatgcccatgggaagaagatttgtcatcttcgactctcagcttatagatacttaggtgtgagttcccaccaaaggcaaaggcagtgcagctttgatagatgctgaagagatttcttctgtttcattccgtttaattcagcattcagtagtcgagtttctggatttagaatagactgttcatgagtttatttagtgaaattcccatggccacattttattggcttctcagtttaccactcgtgaaagtagaatttgcttctactttcttggttgtgaatataaaagaataatcatcgaacttcaaagaatcgtaagcagtatagcaactaatactgataggagtgcctcctgtgtgcctgcaccgcgttaagcattttttgcttgttaaatagtctaatcttcttagctctgtggggtaggcactcttattatttacaggtggagaaatggaaccacataacgataaagtaatgttttttttttgttcaacaaacattaagccagagagtgtcctaagtattggagatttaatggtacattaaacagactaagtccttgccctcgcggaactcgtattctcatagagctaagagacgagtacctcagtatgagatagtaataaatgctatgctaatcagtaggcaggctcaggggtggagagcagtagtgtgttattttagctgcagtgattggagaaggcctctctggggaggtgacatttgaaagagatgaaagaaagcgtgccatgaagtgatgattgggagataaaacattcgaggcccaggaatggcaagtgcagatgttttgtgtcaggaatatgattgaggaacgagaggaaaatcattgtggctggagtgtagggagcaagtgtgagggtgttagaagatgaggatgggagaggttgccagtagttagattatatgggactttgacgttaatttaaatgtgagggggaaccactggaagatggtgagcaagggtgacttgatctggtttacatttaaagaaacatccacctgctgggtagaatgaacaatgggggacaagaacggaaatggggaacccctgtaggaggcagtggcagtcgtccaggtgagaggcaaggctgccgcagatgggagtgaccgttcatcagaggtggagggagtagtggggtctggatgtggttgaagtgggagccagtgcggtttgctggtggcttgagtaggggtctgagaggaggaaggtgagacttaccccatccatggctttggcttgggcgcttggttagatggtggcatcatttattgaggtagaagaaaattgaggtgtggagactgcaagacagagaaaagtgtggtcgggaaggtgtgaggtgtagtggcagcgtgagatgagactcggtggatcaggataatgcgtgggcttcactgggccagtggattggtggcttttggggaatgggttcaaaagagaaggcgaggaagtggagacagtgagtatgattggcctctgtactcgtgggttccacatcctcagattcagctaaccatggattatttggaaaaaaccccagtaaaaaacaacaatacaacaaaaaataatacagattaaaaaaccaatacagtatagaagctatttacacaggatttacattgtattagatattataggtaatttagagatgattttaactacacgggaggatgtttgttgcttttatggagatagtgcattttgtgtaagggacttgagcatctgtggatgttaatatctacctaggggcatcctggaaccagtctctcgcacataccaaggggtgattatataggtagtttttagaggaattttgcttctgaagagagcagagaactggagttgaatgtggagtggagtaggtggagggaggtgtagagttagccaggattggttgttttttagggtgggaagtattatagcatgtttgcattctgatggccgtagtccagtagaagggagaagatagatcatgccacagagagacgaagtccctgagtaaggttaaaaggcttgcatctgttacacatgagggaattggccttaggaggtgggaagccgggctcagttgtacacctgtagtcccagctactcaggagactgaggcaggaggaaatttaagcccaggagttcgaggctgcagtgagctctgattgtaccactgcattccagcctagtgacatagcaagaccccgtctcaaaaagtccttttctaggttattgatgtatacagagatactgatcagtaaaataatagatcttggatttactttaatatattctaattcctccctcccccaccacagtggggagggatagctaaaacaaagtattaatttttgaagctgggtgaaagggtataagggtttgttatactgttctctacttctgtgaatgtttgcaaaataaaaagttaaaaaaaaaatacaaaacatctacccatgaaacggaagtttgtctagttgtattttgtaaccggtttactattgtgaatccctcatcagtgctgcttctccccattcaggtggcaatcactgggcagcttggtgtgaagccccaaacaggcaacagcattccactcacagccactaacttccgcatccagggtaaggatgtattgcgtctgccgccctcttccatcaccacagatgccaagggccagacggttctgcgaatcactccggacatgatggccacattggccaagtcccaggttaccacagtcaaattgacccaggacctcttcgggacaggaggcaacactacaggcaaaggcatctctgccaccttacacgtcacttccaatccagtacatgcagctgatagccctgccaaggccagttcagccagtgccccttcatccactccaacaggtaccactgtggtcaaagtgactcctgacctcaagccaacagaagcctcaagttcggcttttcgcttgatgccagctcttggcgtgagtgtggctgaccagaagggaaaaagcacagtggcctcttcagaagcaaaaccagctgccacgatccgcatcgtgcagggactgggagtgatgcctcccaaagcaggccagaccatcaccgttgcaacccacgccaagcaaggggcctcggtggccagtgggtctggaactgtccatacttcagcggtgtccttacccagtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgtgagtaactagtggtaaagcttaggccttcttttttagaaaacttaatcaaggctcaactgcccattacccgagaaactccctaaaaactaggaaacttctttttaggagtggaaattagaggccctaaaagcacctcgtttaccccaaatagatttatttactgataggcttttgtctgtgtttcctttgaaacacaatttatgtgtcagactgtgtttcctttgaaacacaatttatcaaagtatgatacttgcatacattcttttcaaatggtaaagaacagtgcagacaaaataaaacctgactacgttccagttctcccttcatgaagactaattgctgttggtagttcggcatttatcctcctagtccttttcttgagcattttcatacatgtacacgtagtttaaaaaacacccatgagagactttatatattctgtgatttgctttatttgtttgtttatttttgagatggagtctcactcttgttgcccaggctggagcgcaatggcacgatctcggctcactgcaacctccgcctcctgggttcaagtgattctcctgccccagcctcctgagtagctaggactacaggcatgtgtcatcacacccggcttattttgtgtttttagtagagacagggtttctccatgctggtcgcgataatcctgacctcagatgatcctcccgcctcggcctgccaaagtgctgggattacaggcgtgagtcaccgcccacggccgctttatttattttttagaaatgtcttgatggtcgttctaggccatacacagatactgactggggtcttttgaatggtgtagtaaccggtagaaggggctctgctaaaggatgcgtttccactgttagccaggcagtggcgaatgtgtctgggcttatgtgtgaacgtttctgaagcggagagtgctagtgcgagccttgggggtgcgcacatggagagttgagatactccagcggtgccgcctgaaaggccacatccacatgtgccccatcagcacgcctcctgtttcccctagaccttaagcagtgctgataccacgtctttttaacctcgcatacctgtcttactggtgaaaagggggttcttttttgatttcatttccctgatatgagtgaagttgagtatccattcatttggagattggcatgtgctccctggtgagtaaatctttgccactttccttttgaggtatttggcattttcatattgtttgaggtggctttttataacatccagaagatacggaatctgtggatgtgaattctttatatacatagaaaatatttttttccagtctgtcatcttttaaccttatatatggagtcttttgctctacagatctttataattgtatctaattagatctatcagcatttcctttaatggtttctaggtttcgtgtctgtgtcttccttaccccaggatcataaaataccttgagttttaaaaaaaaaaagtataattgttaatgcatttgaaatatatttttgtgaataggatgaagtagaaatctcacttcctagttttcaaatttgccaaaataatcaactattgcttcccccactagcttgaaaggctgcatttatcataaaccaaatccccatatccccacacaggtgtctgtggatgcatgtgtgtttactcttcagcctctaggtaaggagcattgttcagaagaggggtgtgtatggacagtataaaatacagtttcgctttactgagcaagctatatagggaagccttcataaattgggataaaagccagagcagtgaagaaggatataaacataagtcaaatgaatacccaaaacagaaaatcttaacatagtgtggttaaaaaagaaatagttggtcaggcgcagtgtctcacacctgtaatcccagcactttgggaggccgaggtgggcagatcacctgaggtcaggagttcgagaccagcctggccaacatggtgaaaccccgtccctaccagaaatagaaaaattagccgggcgtggtggtgggcaccagtaatcccagctactcagggggctgaggcaggataatcatttgaacccgggttgcagtgagccaagatcgtgccattgcactccagcctggatggcagagcaagactctgtctcaaaaaaaaaaaaaaaaaaaaagagttacttaggtttctgcatcatagaagttgaaataaggaagcgggaaactgcactcacttgatccacttttgtttcttttgaatccctctaacagaaaggttatatcaagtgtcatctgtcctgttataatcaacctgggtaggtgcaactggagagcatttggtggggcaggaagtattgatggtgcttacttccccctgtctagtcagctttttggtagttcctgaagggatcattctaggcagtgtactggtctgagatgttttaagcaacaaaggcattttgaggaagaacaaaaccataagtaaatgtatctggaggtaccatctcaaggtattctgttgcctgttgccctctttgcatgcttttttaacaggctccaggctgtgggtgaaccccatggagataggtgcggggacctgccgcgcagttgtgcagctgagtgcccatctccttagtgttagcctgcctctgtggaatgctgatgccctctcccagcatcctgtcagccagccctcttgaattttttaaaactcagatttaatttacataagatttcactgcatagaaattttattaccagtcaagcattaaaatcaaggccatctgaaaacaggtaatgcagtgacctatcttaaccatcctgaagtcccaaagactctaggccttctcagtttctaaaaaaaattcttcttaggctttattagcttgggggttggacttttcacttgattgagtttattgttagtgtcccctagctaacctctcttatctccgggagaaatggaaagcaccggagagcatggcctctccctaatctagcatgccctgctgtttgttcctcaccagtggccctgcactccaatgagtagttgtgcgctttaggtattaactcttgagctcctctgtccttcctcaaatttatttcaccaaatagtgattgtgtgcccagcactgtgccatgtactgagggatacagagataagcctctgtcctccaaggaactcagaatcttggactgtgctaaagtgaggacacacctgcctttgtgatttagatacaggttttatcctgttgaaagcagatagatgggttgctgctgcttctggtggcatgaaagaggatgataaaagatcagatttcacctgactatggtatataagtagttcgttagggttttctgggcccaaacctcaggagccttgagaccctggtgggtactggggactgacagcatctgtagtgcttgcttctcagttcctgatgccctggaggtgacacttgctggttttccttacctcctgtcttacaaaacctgactgctttttttttctaggggaagttgcctacacggatcacagttcccctctctgtgatcagccagccaatgaagggcaagagcgtggtcacagcccccatcatcaaaggcaaccttggagccaagtaagtactatgtcatggtaaaggaaccaattcgggggtggaggtggcaggcagggcttaccagtccttgtcaccgagtggcaaagtggctggtctttctggggcccttctttgacacctctgctttattgtgctcatcaacagtatttattgagcatccagtattgttttaggtgcagtgattaaaacagatgaaaatccctgctgttctccaagcatacattgtaaagtagagaaataataaaaaagcaacatgcgtggtgatacatactggagagaaaagggtgtgggaagtgctaggatggggctcagctaggtgtgagggaagcctccctttgacatttgagctctgaacctaagcagttcagggaatgagggccacctgtggccttaatttaaacagggataaagggcacgatgaaatgagtctgcagtctcagggcagcttgtgagatgtggctattagggggagcgtttcttgcagaagtgcacacctctctggggccctgtccactattcctgctggtcggggccaggagccaagggccattttatccagagcactggggtcttctgggattactgtcttctcctgccatgggaagtggtgaagctggaagaaaggtggtctcagcagttggtttccatttcaatctgaaatgctgggattttcattggcacagacctccctgttgtccttcaatacatggcctaaatctgggccagagaatacctgtcgatatcattatatctcacccctgctttccctccacagcctcagtgggttgggccgcaacatcatcctcacaactatgccagcaggcactaagctcattgctggcaataagcctgttagtttcctcactgctcagcagttgcagcagcttcagcagcaaggtcaggccacacaggtaaggcccagggcaaattcttggccatatccggctcctctctgattccactgctgttcttaactggtgagcccgcttgcaatccattgacctgaccttctgtttttgcaaacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccagaccaatttgtgtttgtattatctgtggctgctttcagattcgaaggcagaattgagtagttgacatagagactggatggccctgaagcctaaagtatttcctatatggccttttaagtaaaagcgttttttgtttgtttgtttgtttgtttgtttgtttttgtggccagaggcggtggctcacgcctctaaatcccagcactttgggaggccaaggcgggcggatcacgaggtcaggagatcgagaccatcctgaacaacatggtgaaaccctgtctctactaaactacaaaaaattagccgggcgtggtggtgtgcacctgtagtcgcagctactcgggaggctgaggtaggggaattgcttgaagccgggaggcggaggctgcagtgagccgagatcatgccactgcactccagcctgcaagactccatctcaaaaaaaagttttttgacccttgatccagagtagagatggtggaggacagtgggggtgcaaggaacagggatctgtctgcctggcagtaccagccccaaaagaagccagtctagatttgcaggtcatttaatcctggctatttcacgcttctcagcctctcagctacaggcagagctcaggacgatattttaaaatgtaattaattcaagcactggttgtcaacaatatatgcatctcttgttttggggcagcagtgagtggtaaaggctttctgaggtgatggtgctccctgtttctcttgaaagagcccaagttattaaaaacgtatctttggccgggtgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagattgcgccactgcactcccgcctgggccacagagcaagactccgtctcaaaaaaaaaaagtatctttaa

SEQ ID NO: 14284 - DNA, 23927 bp, Human
tggctcatgaaaagggaggaggaaactggggaaggacaagctcaggacagagctgggccttaagagaacaataacaatgtctatggattcttgatacggctgaggctgacagtggtaatcagaggaacagcttcccccattcctggggtggggcgaagactcaaggagcaggcacactcaccagtcctccctgatgtgccctaggaatatagcacgacctggcgcagcagacagggctcaaaaacctcatcttgatcaagaaaagacaagccctctctacgcatgtcttccccgctgtctttcatcttggccctgtctggtttatcattagatacccccacaacattctaagctccatgaagacagagatcatatctgtatggtgcacaactgaatgcaaagtgctagcacagtccttggcctttaataggtactcaatgtcttggatggaaagcctgtgatttcacagtcagaaaccactttgccaggcccgcccttaagtccgaatttggatgcttaatcaaatttgcctcatcccagccaagcaggggcaactcagctcctagggctttgttccagacagctctcagatgtcttttcctgtagttgtgaccaaaaatacaagaaggaggccaaagtgcccagcctcagccttaggctccctgagggcaaaagatgagggcagcataccttgttccccttgcctctggagctcccaaccttacctcttgccggtgataagaggtgtttaggaagccgtgatagcgctgccgcagggcctggcccagttcccagtgctgtagcatcccctcctgtgggcaaacccaagggttaagagggtctagagggaaggggtggcttcaagccccatggggtttaggccctgttgctttccaggttcacgctttgctggagtcaattaatctgatcccagaagtctttcattaagtggccagtcatgcacagcaatatcatgggcacagagattaaggttatgaaatctggtcaaagtcagcacccatatgggaaaaggcagtttagtaggaccccaagttttgtagactgctctagacgtcgctcattctgcagctcatcctgaggaaaggctggcttctgacccaccttggttaactgaccaaacccctggggccattcttcttcctgataggggtccttgggatatgtcttcactggtgaacggtctccatggcggtacagctgagagaataaaatggtttgcctataggtcagaagcatccccttgatagggacccagagcctaccttttgccccatgttagggaaggaagtctcattccctctgggaagcctactggctgcaaaagaccccagctaggagtcagtcacttcttccagattccagagattctaacttagctaagcaatgctactggagaccataggcaaagccaaggtacaggtaggaagggaaaagagaagtgaaagcaacgtatgtggtggggacaactggggaaaaaagataaccaaaggcttctttagggatgagtcttaaccattcaaccacttccctgtctcaaggcagactcaccccgacgtattcggtcatcctgactcccataagccagggctccaggtcaatcctgaatccagcctcccaactacccaggccagtcgtcccctcctaaaccagctgttccttcccgagatcctcgacctccaccagctggcctttgcccttttagcttcagggaagtctttggtgagcccatctctcattaccaaggtaacgaagcgcagactccgggcccgggtgggcggcatcaccaccaggttcacgccgagaaggagctggaggagagccgcccggctccagccggaccgcttgcccgccatcaccgttgtaatctatgcagcaaacaagctggaacccgctgggtggcacctgcaagcagccgcccggacgcacccgtaaggacacacgccggaagtgcgttcgccgccatcttacttagggacctgctggggtgcggggaaaaggcgcagtctcggtgggattgcgtgcaggagggtcgtggtctggctgtggcggaggagcataagaaggtaacgcgacctggcgcggcagacagggctcgaagacctcatcttgattaagaaggccacaaattcgcgtttgcctctgctcggagaaatcccttaccaaggtggcacttgcagtgggcgggaccatgtctggagaaccagcgtcccctccaggcttgaccccatagctagatcgggtgcagaattgaggcgagggatgggaaagtagaggtcgcttctctccacgcccctgcctttgtggggagattgagccctggccctgttctccaggagatgttttgcttggggtgcaggacacagtatgtaaacaaccctttggactccgtgtgtccttgaggttgccccagtctggcctaccgttcctgccctgcacaaagcttcagtagccctctcactttcccttccagtcctttccctgtcctccctcccctccacttccaagttttagttaattagagtcaagacgtcatgtcatgcctcttcccaaaggagttgggttgcacaggatgttcagactttacaaacccaaagcactgaatccctgggggaggaatttcagaccagtggggaggtattttgaggtaagggacaggcgcatatcataaagtgggagtaggtggggtttccacagaatcaatggccctcttggcattgaccattaggattcaggtgcagccagtttggcctcaggactttgtgactcctgtgacggttgcaggtcagatcataggtcctggggatgctttgattcagatctgcctactggaagcaaatctcctcagatctttgggaaacaaaactgatcaggcttggcctgggcgccgtggctcacctgtaataccagcactttgagaggccgaagcaggcagatcacctgaggtcaggagttcgagaccagcctggccaacgtggcgaaaccccgtctctactaaaaatacaaaaaaaaaaaaattagccgggtgcagtggcgtgctcctgtaatcccagctactctggaggctgaggcaggagaatcgcttgaactcggaaagcggaggttgcagtgagctgagatcacgccactgcactccagcctgcgcgacagagtgagactgtctcaaaacaacaacaacaaaaacctgattaggcttggtgtggtggctcacgtttctaatcccagcactttgggaggccagggtgggaagattgcttgagcccaggagttggagaccagcctgagcagcttaggaagatctcctctctacaaaaaaaagtttaaaaattagctgggtgtggtggcacacacctgtggtcctagctcctcgggaggctgaggtgggaggatcaccttcagcccaggaggttgaggctgcagtgagccatgatggtgcaactgcactccagtctagatgacagagcaagactgtgtctcaaaaagaagaaaagaaaaaaaaagatcaggattatctgtctttattttgtcctaggactccagattcaattatttatatatacttcaggatttaaactttgcttccagagttgtcatggaggaggccaagaagcaaatagagtaagagccaaagcctgggtagccaaacagttcttaaccttcttatttaatcacaagcccctttatgaatcacatgaaaattttgcacctctcctccagaaaaatgttcacacatataaacacacacatggaattttgcatataatcccaaatggttcacaaagaccatttattacaggtttcataaatcagcatctctgaatacctgatttaacctagtcctcttactttacagcttaggaaacaaacctaaagagaggaagtgacttgcccaaattcacagtttgggcatgggcacagtttgagaatggattaaaagtcaagttttggccgggtgcgtgctcacgcctgtaatcccggcactttgggaggccgaggcgggtggatcacgaggtcaggagatcaagaccatcctggctaacatggtgaaaccccatctctactaaaaatacaaaaagttagccgggtgtggtggcaggtgccggtagtcccagctactcaggaggctgaggcaggagaatgtcgtgaacccagcaggcggagcttgcagtgagcggagatcgtgccactgcaccccagcctgggcgacagagcaagactccgtctcaaaaaaaaaaagtcaggttttgtgattttcagttaaatagtctataatgggctgcttcttgcaggctactcaaactgcattactaaactgtaattggtgatcccgaaatcctttcaataaagaggtatctgtcaaaggaaaccttttcaaattagttggactaaacgggacctaggccggacatggctcacacctgtaatcccagcactttgggaggacgaggcgggtggatcacctgaggtcagcagttcaagaccagcctggccaccatggtgaaaccccatctctactaaaaatacaaaaattagccagtcgtggtggcgtgtgcctgtaatcccagctaccggggaggctgagacaggagaatcacttgaacccaggatacagaggctgccgtgagccgagattgtgccacttcactccagcctgggcaacagagcgagactctgtctcaaaaaaaaaaataaaataaagagggcttgggtaattggcaaaatgctgcatattagtggtagtgggaggcagttgagtgttttgttttaatgggcctcttactccttgcaaactagccagaccattgtactttcagagtgtaaatctttggctcaccaaatttcagctatctctcaaattcagcttttgcttttcttcccacttgctcaaatatgtctatattctttgtgcatgcaagtatcccacgtaggagggattgatgaagcagatactatttcagtttttatagggagaaactattccaggaagggtggggattacagcgcaagtagatagtagagcctgaagctgagccctagtttcttcacccctttgccttcagcttttgcattttctgccagatgattctgtggttcttacactttggttcgtaactacaggtgcaaaaaaaaaaaagaaaaaaaaaaaacacatgtagatagatggatatgtgggcctatcccagatcaaataaatcagaatctctgaaggtgaggacaggaaccactaccatattctgtgttggcagaagcaaacctaaatccaggtatgttagccattttttttccatctgaagaggcagtttttgttttgttttgttgttgttgttgttgttgttgttgtttttgagatggagttttgctcttgttgcccaggctggagtgcaatggcgttatctcggctcacagcaacctccgcctcccgggttcaagcgattctcctgcctcagcctcccgagtagctgggattacaggcatgtgccaccacgcctggctaattttgtatttttagtagagacagcttctccatgttggtcaggctggtctcgaactcccgacctcaggtgatctgcccattttggcctcccaaagtgctgggattacaggtgtgagccaccgcacccacccggctgttttttttgtttgttttgttttgtttttgtgacagagtctcccactgtcgcccaggctggagtgcagtggcacagtctcggctcactgcaagcttcacctcccaggttcacgccattctcctgcctcagcctctcgagtagctgggactacaggcacctgccaccacacctggctaatttttttggctttttttttttgtatttttagtagagacagggtttcgccgtgttagcctgacctagtgatccacccactcggcctcccaaagtgctgggattacaggcatgagctactgcgcccggccccagccggcagttttatataatggagtgtatttgtgatttttgtttgtttgagcttgagctcaaacttttgaatcagctaaacttgtattctttttttttttttttttttgagacagtctccctctgtcacccaggctggagtgcagtggtgcaatcatggctcactgcagcctcgacctcctgggctccaacagtcctcctacctcagccccccaagtggctgggactacaggcagatgccaccacgcctggctaatttttgtgcgtgtgtgtgttttctgtaaaggtgaggtttcgccatgttgcctaggctagtctcaaactcctggactcaagcgatctgcccttcttggcctcccaaagtgctaggattacaagtgtgagccaccacacccagtcttatacctgtattcaaatttgatatttgccccttgctagtaactatctcctagagtttactgtgagaataaatgaaataatgcatgtaaagataaatgtatgtagtagggatgaaataaatgtcacatctttcctttctgccttctgtatcatctctgaactcaggtctgggaatccaggtttctggattattctctatgttgtgattggaaggttgggcagaagtcacttgagtagatacgcagtggtctgcaagatgatccctgcactttccacccttccagaacggtgaaggagggaacaagaagcagttctcctggtccatccctgcagaccttaccctgtggcctgcttcatgggaatgagtactttcagggcagttagccagtactacctgtgaccatggctggtgaatgctcctgtttctgcttcaagtttctccttgctgtgagaagaaacctgtggaggttctggggggccagatatgtgacttggtagatccccgagtgtgttcccagagacattgcctcctgcaggagccaaggaaacacagaagaggcccataggactgggggactttggacctaacaactgtgggctggtgggactgtggcacgggggtggggctgccaaagtgggaacatgattccagctgctgatcacttcactgcttgccctggcttgaagtaagtctcagtggttggtctccagaaactccatggaaatactgcccacaggttttggtcttctcccattttcctctccttttccctctttgtagggatgagggttggggtttctgagctgtaacctgataggacggctctggcagttgaagtcctggttataattcctcctaaacaggagaccctagcctgcccacccccactcccacaagatggggctcgtatgtggtcctgggtcctgggaagccacctgtggggagactaggtgtcaggggagggagttgaagaacaaagtggatgaaagaggcttctcccagctcccagaagatagggcaccaggccccagaccattgagtcctgagtttcttgaaaccagccatctctgtgacatctctggctgccctgctgggctggagcttctgggagcagggaggtagaggagggagctggactggtgatgtgggtgctgggacagaatagtgccagtctctcagtgactagagtccctggtttctgcttttccaggacagctggggccttgtgaaaatcagagagggaacacaggcgagaggaatggagagccttgtgcttgtgactcagagatacccagaccagggtgggggccttgggaggggacgaccttgtgatgagggggaacaaaagcaaaagctggaggcagaagtctgagatgggggtgtcacaggggcttttctgaaatgtgaaaatgaatacatgggcagattttgcaacagcacccagcctgctgtcttctcacactctgctccccagccccggcctgttccccctctcccaccctgtgcttcctctcatctttcaccaggctgctcttctgcctcagccttcatctttttctcatctggttccttctgtcccatctacaccccctgtccactctttccctgtttcctgtgttctcttccctggtgccctgttcatctgtttcggtctctttggctgcttgccctggcccccgtccttctatgctttaatgtggggcccatgggaactggagttcatagcaaaacaggaagagccggtgagcaggaaactgggaatggggcagggggtgaatgaccagcagtaacctcagcagcttgcctcccacatctggactggagcatctgcagggttctcagcctctcccctgtagcccaccagccctggctgcttccattacagcacttcactggcccaagacgcaacaagacaagattgtcctggactctgacacagcaaagggactggagtgaggacatctgggttctgatcccagcccagccactaactgtgtggtcttggaaaaggccctcacatgagtttcagtgttctctgtcaaatggagctcgggttacttaccctcctttcctcccagcgctgctctaaggaccagaaaagatagtgaagggtttgtgctgtgtatggaaacaagtacaaagttcaaaatccaccaagttaaagcaatgggaagacctacagctgaaagaactgggagggtgatgataactcgtgccatttctcaaacactatgtgccacacgttgtgatagactctctttctttctttctttttctttctttctttctttctttctttctttctttctttctttctttctttctttctctctctctctctctctctctttctttctttctttctttctttctttctctttctctctctctctctctttctttcttctttttttttggagttttgctgttgttgcccgggctggagggcaatggcgcgatctcgggtcattgcaacttctgcctgccaggttcaagtgattctcctgcctcagcctcctgagtagctgggattacaggaatgcatcatcacacccggctaattttttgtatttttagtagtgatggggtttcaccatgttggccaggctggtctggaactcctgacctcaagtgatccatctgccttggcctcccaaactgctgggattacaggcatgagccaccgcaccctgcatgatctgtagtttcaatcccacaacaaccttgtgtggtaaaaattactattatccctattttatttatctttctttctttttcttttttttattttgagatggagtctcagtctgtcacccaggctggagtgtggtggcacaatctcggctcactgcaacctcccagattcaagtgattctcctccctcagcctcccgagtagctgggattacagacccgcatcactatgcctggctaacttttgtatttttagtagagacggggtttcaccatgttggccaggctggtctcgaactcctgacctcaagtgatccacccgcctaggcctcccaaagtgctgggattacaggcgtgagccaccgtgcccgttctatttatttttcaacacaccattgctggctcaactattcttattttaaagatagggaaacaaagattcagagacgttaagtaacttgctcaatcaagatcacataggtaataagaggtttaggatttgaacccaaaatctgagcccagagtctgaacgctaaatcaacatgctgagttgaaattgactacagcagttgtgatggcgtgtgcctgtaatcctagcactttggaaggctgaggtgggaggatggcttgagcccaggagtgtgaagccagcctgggcaacatagtgagaccctaccccaaaaaaggtaaaaaaaaaaaaaaaaaggaataataaaaaaaattgactagggctaataagtacgggatagacgagaataatatttcttttttttttttttttggggacagagtctcgctctgtcactcaggcaggagtgcagtggcgcaatctcggctcactgcaagctctgcctcccgggttcacgccattcttctgtctcagcctcccgagtagctggaactacaggcgcctgccaccatgcccggctaattttttgtatttttaggagagacggggtttcaccgtgttagccaggatggtctcgatctcctgacctcgtgatccgcctgcctcggcctcccaaagtgctgggattacaggcgtgagccaccgcgcccggccgagaatatattatatttttcttgttattcattcaacaaataggaacacagtacctactctgttgccacatctatgccagccctgtttcaggggtgttgggggagatgaaatcaataaaatatgatgtctactttcagggatggatttcatgccccaggcagcagagtaggaagaatgactatagtctcagtagctgctggttggagcctgccatcacttcagatggggttgttccccagaagaggcaacccgcataccttcccaggtccatcctgggctgccacctgagttgcctgtcttccttctgccacctccacccctatcccaggcctgccactgctcatagcagatttcctatcaaaggctctcctggcctcctctcttatctgtggcccccgcagggcacccactttcagaaactccctggaaggcccagcacctgcctctctccacccctggatttctaccagcttggctgaggcctggggctagtggggagagcttcttggcctcttcccagaggcaagggaggaggagggaggctgggaaagccgctggggctcagtgtcgcaattccgggccgtgctgggacctttgctccacgaggtgcctatggaggggagggaacacgattctggaggctgctgggattggggtgggggttcctgggaggcagtccttttgcaagagctgctaagagcgctgggtaaggagaggaaggggagagacatggaacttggctggtctgcagggaaatgccactgttttggccgggagtagggggcgggagtggcgggagagggggtggccggctggggaggagccagcctggtggagaagctgccctgtgggcgggggtgaggaggggagggctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccgagagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccaggaagagatgtccttgtggctgggggcccctgtgcctgacattcctcctggtaagcttcattccatccctctcccctgagcccagaccgcaggctccacgcctcctgtaggaatcagcctccttcattacctgccttcttccttcctccagagagcagtccagagtcattcttagtcgtgcttgcctcccgcccagatcacctctcccctggttccagtgcctggcccttgcaggcacccgcccagtcctccccagtctggatttgctgctagagagttggccagctgagtgcttaccctgctctggctttgaagagttttatctgatctctgaaatgcatacactccagccccccaaagggacaaggattaacatcttcatttaaggtcctgagatgtaagaaactacaagtgactagtcctagctagagcccacacagactctagggtcccaaagcctgagctgggactttgctgccctctaagggtggggataagtttgcagtttcccagctaggacgctgggccgtggagccgggatggggcctgagacccccttgtgcctctcttttggagctcagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgaggagcttctgggtttggaggaggtaggggtccagattccaggtcctggatctggaagaggttccttgggggtttttactttatatataatctcatggttaagttcagaggctttagagctaactaaatctgactgatctaagtgtgaattttgtctctaggcctttctgagcctcactttccttgtttataaaatggaaataaaaattatggttgtcataaggatcagtgcatataaaaggctcatacagtacctagaacataatggcacttggcaaatgagggctactcttctcataaaagagagactggagtttgtataatgaagggaatgaaggtcactgagtgcccagggcagtggctgagtcagggagaacatgatgtttttcctcgggggagagcgttgaagcactttcctgtatccagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgagtttctggggctggagtggggaagaggctgaggggaaagagggggccagggtgtgacccaaaacaggtgcctgaacttgcaggggctaactgatccctaagtatggatcccagtatctttcttgaccgggcgcggtggctcatgcctgtaatcccagcactttgggaggccgaagcgggtggatcacctgagatcagaagtccgagaccagcctggccaacatagtgaaaccccgactctactaaaaatacaaaaattagccgggtgtggtggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcggctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccatgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcaggtgagaactgagatcacacagggattggggttgggtggacagatgcttctttttttattttttatttttaaaaattgagggccaggcgcggtggctcatgcctgtaatcccagcactttgggaggccgaggtgggcagatcaccaggtcagtagatcaagaccattctggctaacacggtgaaaccctgtctctactgaaaatacaaaaaattagtcaggcatggtggcacgcgcctgtagccccagctacttgggagatcgaggcaggagaatcacttgaatctgggaggcagaggttgtagtgagccaagatcgcaccactgcactccagcctgggcaacaacaacaacaacaacaaaaattgagatagagtcttactatgttgcccaggttggtcccaaactcctggcctcaagtgatcctcctgcctctgactcccaaagtgctgggattacaggcgtgagccacccaccatgcccggccaagtactttttttttgtttcatttttttttttagacagagtttgctctgtcacccaagcaggagtgcagtggcgtgatcttggctcactacaacctccgcctcccgggttcaagcaattctcctgcttcagcttctcaagtagctgggattaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaatgtttgggtggctggtaagggaaggctcccttgttttttgaagatagaaaattggaatgctgataggcttctctcagctgctccagatagacccctgtcctctgttgctttaggtcagtggttttcaaactgtattccaaggaacctgagagatatatggaatggcaccttggaggagaaacagggaggcacaggaatgtccttcatctttactttagccaaacaagaagctccatttaaatctgcattatatattgcactgctacatagtattttgcttgcagattttacagcttgaaaaaaaagtttgaaactcagtgcactcaactttttagtagtcaaaaagtgaacaaatcttcctcacatgtgctctttggggatcatgggggctgatttcccctacttttttttttttttttgagataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttctgcctcccggattcaaacgattcccctgcctcagcctcctgagtagctgggactacaggcgcgcgccactacgctcagctaacttttgtatttttagtagagatggggtttcactgttttgcccaggctggtcttgaactcctgagctcaggcaatccgcccgccttggcctcccaaagtcctgggattacagccatgagccacttgtccaggcccctcccctactctttttcaattgcactttctgacgaaccagaaccatggcatggcaaacatgcccagagaggatgtacaataagagcgaatgcttccatctccatcctatatctgaagtattttctccaaaaattagttcattctgcggctctctatctgatgctcgcttgggagctacgcagaaggggtttcttcatattcaactattgataatgtttgtatcatgagaactggcctgggaaaggacgggaggctgagggagttttggagggactggaattgagcttcagcaggaaaccaagtagcttaacgactggatgagtggggctgtaaaatatggctgatgccctgactccactctcagggctggtagatctgtggccaggccagtcatcaagccttccttggtttctgataactcaggccagctcacgtgcctcttgctctcccaacgcagtccacccagtgagctttctaggaaggccactcttcgctgtagggcataacagggctatgttggcaccttttgccttctatagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttcttatttcatgagtgaggtcttggggagaaggaacaggagctctgcttgtcaagtctcctcccctccctatccgctactatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcaaaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagtgtagcagatggttgctaaaagaaatctgacaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcacgaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactattattattcccattttacagatgggaaaaccaaagcccagagaggttaaataacttacacaaggtcacactgccttgtaagtggtagaggcaggactcaacccgaggcagtctggcaccaaaatccacatcctcacccatactgcaatattccctcgaggatgtgatacatgaaatgtatctctagtgttcaaataagtaaggccaatgccagtgaaaaacaagtcttttttttttctttgaaacagggtctcgctctgtcgcccaggctgaatgcagtggtgtgatcaatcatggctcaatgcagcctcgaccttctgggctcaagtgatcctccttgagtagctgggactacaggtgtgaaccaccgtgccctgctgaaaaaggattttttttttttttgagccagaatcttgctctgtcgcccaggctggagtgcaagtagaacaatctcggctcactgcaacctccacctcccaggttcaagcaattcgcctgctcagcctcccgagtagctgggactacaggtgcgccaccatgcccagttaatttttgtatttttagtagagaccgggtttcactgtgttgcccaggctggtctcaaactcttgagctcaggcaatccgtctgcctcggcctcctaaagtgctgggattatagggataagccaccgcatccagccttttttctttttctttttttttttttgagatggagtttcgctctgtcatccaggctggagtgcagtggcgtgatctcggcttactgcaacctccgcctcccagattcaagcaattctcctgcctcagcctcctaagtagctggaattacaggagtgcaccaccacgcccagctaatttttgtattttcagtgagacagggttttgccatgtcggccaggctggtctcaaactcctgaactcaggtgatccccctgcctcggcctcccaaaatactgggattacaggcatgaaccgccgtgccttgctgaaaaacgattcttgataaacaaaaataagagttgcctctatttctagaaatgtggagccctcaagaattttaatgacagaattggcaggtgatggtgtctggtgcctgtaatcccagcactttgggagggcgaggcgggtggattgcttgagtccaggagttcgagaccagcctgggcaacatggtgaaatcctgtcacaactgaaaatataagaattagctacttgtgatggtatgcacctgtagtcccagctactagggaggctgaagtaggaggatggcttgcacccgggaggtcgaggctgcagtgagctgtgattgtgccactgcactccagtctgggtgatagaacaagaccctgtctcaaagaaaaaaaacaagaataccagaattattatttaattcagcacctcttgtgtgccagacacagcgctaagtgccctgcatactttgtcattgaactataccaacaattttctgagaagggttcagatatgattcccatttcacagatgaggcttatagaggggttaagacatttgctcaaggttacacagcaaagccttgtagaccttttttttttttttgacggaatctcgctctatcgcccaggctggagtgcagtagtgcaatcttgggtcactgcaacctctgcctcccgtgttcaagcaattctcctgcctcagcctcccaagtagctgggattacaggcacctgccaccacgcccggctagtttttgtgtttttagtacagacggggtttcgccatgttggccaggctcttctcgaactcctgacttcaggtgatccgcccgcctcagcctccgaaagtgctgggattacaggcgtgagccactgtgcccggcctcagtaaacttcttagtgagttcctaatagttccctaaggtgaggagagaagaaagttcctgctgctcctgctgcttgcgtcagcctcccttcttcctccccagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttccccaggaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtggtatggccataaatgcctcagcgccgcctcactgataggtctggtactgtttgaacaggaagatcaaaatgaatacaaaatgagagaaaccaatttctggattgggggtggggacacggtaatagaggaggaagcctgcgatctttaggatccgcctccaggcccagaggagggagagtcacaaatgacagccttggccgtgagagggggcctcttcttactaacccccactgcgccatatgggtaaatggaatgctgaggcttaggcgcccccttcccctgctgggatccgggtaggatccggttgcctttctgcggtggaggaggaagtgttggatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgcggcggggctgtcctcgcggactgactggactccatctcccagcgcggcgccgcggcgcggccacgcccccccacaacacacgccgcccggtggaggtacacgcgccgcgcgcccccctctgcccccgctgcccaggattggtaggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgacgcccgtcgggtgagagtctctctgagcaacccaaacagaaggtactgctgtgggtcccccacttggcacgcgacggcgctgggtcggcctggcgcgccctcctacgcgcacgggcgctaggctaggtctgtgcgcagccgctgtctcccgaggttcggccccgcctcgcggcgctcggctcggtgcagccccggccccccgggctgaatggtacggccccggccccggcctccccctccgcaccccgcgcgagtggtgcgtgccccccagtgcagacgcggaactggcgcccgctcggagcggcgccgcgctggggagcgactgacgccccgctgccgggggacgtcgggctgggcctggccagtcccccagagcttgggaggtaggagagtctgggccggtggggtcctgggcgagcgtctggggactccgagcgggagacgggctctgagaggacaccgtggctcttggaggaaggggtctctcaggaggccctgggggagtgtgaaggggcgtggggacgggggtctgccgaggaggggcggggacggggatgggggcgccccgggcagaggagggggctcaggctactgggcttggttcctgccgagcgggcggctcgggttcaggttcggggcgggggcgggggcgggggagaactgtccagcaggtgagggggcgggcagagctggccagccctggggccgaacccgcacagcgcttggcgggtgtgcttgtgcgtgtgcgtgcttgcgccttatttttggctagaatttggagaaacacgtttggttctcaagaaattttttttttaacttgatatttcaaaattgacttgctggagagagaacaccatttcatctttctgcaatcgctctcctccccatcctcgtgtatctaccttcttccacctttccctgccctcccctctaccccaaccctgccagctgccagcctccttgctccagttctcccatacg

SEQ ID NO: 14285 - DNA, 8260 bp, Human
gcgcctgaacaggagttagagtttggtggaaagaacaagtcctcaattgtgattaggagagcagatcctatttaaaagctctctactcctgatagttgttgtttttaagccttgatgaggtttgaactcatgatgatgatgatgatgatgatgatgaccatgaccagcaacaacatttgatattctggtcaattagtatctgccaaccttgagatgtggagtctaatatcactccattttatagaatgggaaactgaggcttgtagaggtcaaattatttccccaaggtcacagccgttgagtggccaagttggatcacactccaggtctgtcccgacacgtcaacatggagtgggaggccttgcttatctggaagaggatactcttcagcattccgaggacaggaattaagccccaaagctcctgtgggccgcaaagggttctcacgagctgcacgcccagcaggactttagacccaagtgaatccctggtgggacccccaggttctatttgctttctagctcctagccacagcaggggagaaacagaccaagctgagcggagaagcctgtaagtcctgtgttttcctccagacggtagcaagtagtggcagtagacagcctgggagtgagggacttcccaacgctgtcaaagaccttagggaacccagattctggggccattatcgtagggacaaatacccgccccacacctcctcaaccccagagggctcactgcagcccaaccctgcagctccctagtcctactgcagggccacaagagaaggcaaaatggtgttgtgtcttcattcttctatttttatttttttttttttgagacagggtcttactttgttgcccaggctggagtgcagtggcacgaacatggctcactgcagccctgaccccccgggctcaagtgattctcctgcctcagcctcccgagcatctgggactacaggtgtgcgtcacatgcctgactgatttttgtattttttgtacagatggggtttcatcatgttgcccaggctggtctcgaactcctgagctcaagtgatctgcccgcctcagcctcccaaagtgctgggattacaggtgtgagccacttcgcccagcccatttttatttttttattattattctttgagatattaataataaaaaataataataaataatatttttattattattatcactctgtcacccaggctgcagtgcagtggtgcgattttggctcactgcagcccggaactccttggactcaagcgatcctcccacctcagcctcctgggtagctgatactacaggtccacaccaccacacctggctaatttgtgtgtgtgtgtgtatttattttattttttatttttttagtagagatggggttttgccatgttgcccaggctggtctcaaactcctggcctcaaataatctgcctgcctcggcctcccaaagtgctgggattacagatgagccaccacacccggcctaacatttttaaaattataaacccacttcatacgtgtgacaatcctgtgcagtgggtgctgctttcacccaccccgctttacagatgaggaaaccaggtgctttgagattaaagagatggcagtgctaggactcagagacaccctggccccagggtctgtggacatgaccactgcctgaactgcctgcgaggatgctcctgacccgttagccttagggttatgggcccagcatgctcccaccgtacaatttgctgtaagagggacacacacggggcttggagtacccctgaggcttgccaaaggttggggaggcagaattgtgctgcggggggtgagggggaagggacaggagccagccagggacaatgtggccctaccttctccctggagagacctcagctctctggaattcatctatatttagcaggtggctggacaggaggcagataagcagagcctggggaggggggaggtccccatatatagtgggaaggacaggaccccactcagtccctctttgggtgacctgtgcctgcttcgtgcctggtgtgacgtctctcaggatgcctgagccggggaagaagccaggtagctttaggactggggttgggtctaagtgtgggagcaggggggtgtctacaattggggagcagggctaggagggagttcttgagggggttgacgaggacgtggcctctgagccccaggacaggggcagccagtcctccagggtccttttttgattctcggtttctttttcccatccctctgatgagaggtgaaggtaaacccaaggtcagggacgcagagaggggacacagccaagacaggaagcacccggggtcaacccattctgagaatgcaaagggaccccttccctgtcccattgccttcaccttccacagcaaggttccccgcggacagagcccacgtttagtatggagctgagccaggctcacggcatgccttcagaccagtctctacccactatgggtctcagtctcccaacctggggtgccgggggtggtggtggcattgggttggttcctcctggctgtgacattatctgcttcatgagcctgtacggtgtggcccccatgttgagggtgacacagcccctcttctctgagagaggacagtcaggagcccctgaacccaggccaagggcagggaaaatcacagcccagggacctgggcctgggctgtgcccttatgaaggttgtccagggcagagatccaggtccccatcccccagcgccctcccaggccagctttatctcagttgctgatacccagcctgaggtccttggaggacaaatttggccacattccaagtaggcagacttccccgccccctgccaagggcccgaaatggttgggggaaagggagctgggttcatcacgggtgtctccaagcagggaaagtggacacatgcagaaaaagtcttgttgggaggtcaggaccacagccctggctctcccgactgctagctgtgtgatcttggaggagccgcttagcttctctgagcctcagtgtcctcctctgagaaatgaacagaataactgcaactacctcagagaactggtagagtattacgtgaggggatgcatagaaagtgctagcacagtatttactgagaggggctgcaggggcggggtgcacgctccaaccaggggccgctgtagcctccacctggcccttcagtctcagcttttagcaagaagccacggtcagtggaagtggccgcaggcagccctgccgtgttcgaggccgagacagagcgggcaggagtgaaggtgcgctggcagcgcggaggcagtgacatcagcgccagcaacaagtacggcctggccacagagggcacacggcatacgctgacagtgcgggaagtgggccctgccgaccagggatcttacgcagtcattgctggctcctccaaggtcaagttcgacctcaaggtcatagaggcaggtaagatcctgatcagccttccctgaggtttgggctgctgggggaggggcagcccagcgactctccatccatccagggaacaggaggtgctttcacactttcttgcctttgctgtggctgtgccccccgccaggaacgccctttcccccttttctgcacatgacctctctgagtacccccatgtgccatcctggcttgttccagccatggggtaggtgggagagatgaacaagacacaaccccactctccccctgcagacctccctggggagatgaccctgcacagacggccgggaagccccaggagctgtggatgaggggagtgcagcccagtctgaggggctgctctaaggctggggcagagcagggatggacctggagctgttcagggcagatgcagaggacatgggaactgatggcctgggacggggaggagaatgtgagaggcaggctggctctccagctcagcatgagctgcctctgaggggcccaggcagcgggaggacagccatggcagactttcctcatccacagcgggctcatgggtccaatgctcaggagagagagggtggaggggtctctggttagtggctgcaccacgactcccatctgatcccctccagagaaggcagagcccatgctggcccctgcccctgcccctgctgaggccactggagcccctggagaagccccggccccagccgctgagctgggagaaagtgccccaagtcccaaaggtgagaggggctgggcagggaggggcaggatccgtgggtagggcgtgtccagggcaggtctcaaaagcctttgctgggccaggtgcggtggctcaggcctataatccccagtactttgggaggccgaggtgggcggatcatgaggtcaggagattgagaccatcctggctaacatgatgaaaccccatctctactaaaaatacaaaaaattagccgggcgtggtggcgggcacctgcggtcccagctaacttgggaggctgaggcaggagaatggtgtgaacctgggaggcggagcttgcagtgagccgagattgtgcctctgcactccagcctgggtgacagagcaagactccatctcaaacaaacagaaaaagcctttgctcacagggtcaagctcagcagctctcaatggtcctacccctggagcccccgatgaccccattggcctcttcgtgatgcggccacaggatggcgaggtgaccgtgggtgagtgtgagctgctgtgcccagcattggggtgggaagggggggcagcaggacactccccaagccgggcctgtcgccctgcctttgcaggtggcagcatcaccttctcagcccgcgtggccggcgccagcctcctgaagccgcctgtggtcaagtggttcaagggcaaatgggtggacctgagcagcaaggtgggccagcacctgcagctgcacgacagctacgaccgcgccagcaaggtgggtccaccggggtcgtggagacacggagagaggggacatggagagccctagaaggcacaaggcacacagagggcaccatgagacccagaggcacacacgagctgcaagcaaggggtgtggggaatctgggaggcaggtggaggggccaggggcccacagggagatcccggaggcctgggggccagggagtgcgatgaggctcatgggagcactgtcggggacctgggagacttggtggacatgatcacctcaagggggcacctaataaggtttggccgggggtgggggggcgcccagggtggtcaggaagcctggaggacactgtgaagcatgggggcaccagctagtggggttgtaaagcccctggatgggtgagtatcagggctaagggctcaagggactctcagggattaaccagaacaattcctcattatacagacacggaaaccaaagcttgagaggttaagtggctgctccaaggtcacttagacataggcctagaaccttaagccttcgttttttgtgttttgtttttttccgccctgcccaccagaaccttaaggcttaagtccccttgtttgttcactccaagcctctgcttttcccaaccttccccagtcctgggctaggcaagggggcctctagcaagagaggccaacatgttctgctgtgcggggctgtgcattgcacaaaagcctgtatttcaccacaaccgtgtgccagcagatggcaatcatgggtttcgagatagtcccctttctctgtacaaaaactctgtatgggttaactaaagcctgagggtgcgaagatcgatgagcatttgtcactcccagcctcctttaaatatatatatatatatataatttgagacagggtctcgctctgtcgctcaggctggagtgcagtggctcaatctcggctcactgcaacctccacctcctgggttcaagcgattctcccacctcagcctcccgagtagctgaaactagaggtgtgcaccaccatacttggctaattttcgttatttttagtagagacggaatttcaccacgttggccaggctggtctggagctcctggtcttatgtgatccgcccgcctcagcctcccaaagtggggattacaggcctgagccaccgcgcccggccactcccagtctcctttaagggtgcggagccttgtctcccggcccctggtgtcccctgacgccccgtccctccatgcacacaggtctatctgttcgagctgcacatcaccgatgcccagcctgccttcactggcagctaccgctgtgaggtgtccaccaaggacaaatttgactgctccaacttcaatctcactgtccacggtgagggggccctggtgtctgtcctgggctcgggctccccatgggtcctggtctcctacctccttttcccaacactaaggaggatgcctcgtcccatccagacatgagtgctggccacgtgcccagtgctgcacacacagggtgtgagagaaaccccaaggcttgcagggtaggcgtgggggcttagggctgagtccgggtctcatctgggtgggactctgttttatcatcttggtgtcacggctcctggcccacggcctggcactgtctgaatgtttgggcgatgggtgaaggtgagttgagagatgggtgggaattggggacaataaaccgtcccacctgcctggtaccttgaccctgggaaaggctgggaaggtgagatcctggggcagatgcccagcctcatggggtcatgaatgggcaagtctgtgaatactcagaggccgcccccagggcagggcttctcaaacggccccctctgaagccccttcccccatctctccaccctttgaacccagaggccatgggcaccggagacctggacctcctatcagccttccgccgcacgtgagtggccatcctcagggcctgggggaggccagtgctggagtctgaggcccttcagggtctcgactgggggtcagggctggggatgatttgcggggcggagctgaagtcagtgggggctgcaggggagagcaagcttcccaggcaggtgaggatactgagtctaacccccacaggagcctggctggaggtggtcggcggatcaggtacccctgccccaggccctacctgcaccatccgcagacccccaggggtctgagacgggtgggagcccaatctggctagtgtccctttctccctccccactccactcccatcctgctcctaatccctttccagtccctcactgcagcctcactgggggtccctctccatagtgatagccatgaggacactgggattctggacttcagctcactgctgaaaaagaggtgagtcctgggtggcagttcctggggcagctggtgaggcctggctccaaatcccagcactgtggtttgccagctgtgtgaccctgagcacaacactgcacctctctgagttggtttccttgtctgtcgaggggatgatcccagtgtggaaggagttaaagggctctgcagacattatgtcccgtcaacagtcatcctcacagtgtcccccacggccactccacacttgaggctgcaaaagctccctccgtaaactccggggacccagaaggaacagagagagggtccccagagctgcagggtctaccaggtcggcccaactgacttatgttctctctgccctctctctccctctcccccggcccctccattatggctgctgctgctgtggcccagagagtaagaatcggggtctgggtgtttgggggcggcagggcgctggtgggtgcagaggggattcccgtcccctctctgagaggctgtggtgagagactcagagcagggtgcggctccccacggacaggggtgagtctctgtgccttgggcttctcctgccacccacctatctgtcagagcttaggagggataagaaaaagtaatgcacacaggaggtcctgccagagcctccggagcagcatgggtgccccacaacacagggagtgcaagtgcggaaaatagggaggaagtaaaggcccatgggtggggtccaggtctttgagggaaggtggccatacctctcatgtgccacctaccctttctcccacccccacccctggagcagcagtttccggaccccgaggtgagtgcccaacatagcacagcaccctcatcacccctaattctgccaggagcccctccagatccccagcccctcttcagctcccttggcccccagtcctgcctggcctgggacccagagcagctccagctgccccaccagaagggaaggggcagagggacaggggtggctacagctccttggtc

SEQ ID NO: 14286 - DNA, 8618 bp, Human
agcttgggcaggagggccgggcagggtcaggggttagcctgaatccctggcctcgcaaggctgttagaacactggcaacgtgccctggctctgtccctgctgatacccctgcgggaagcacaggcccgcttctctaccccagaaaacaaaggcccagaaagccctgactcagatttctcctttctgatcttgctgaatcagtgaagggggttccaggagaacctcatgcctgtgccaccccacccagcccctggcctggtatcatccagacctttgtggctgctgtgggccagaaagctgctcccaagatgccatccacagcaaccctggccccttggtgagtggggcctgggagtctgcattcagggtcctccattgtcagccctggaatggaggaccttctatcctggcctcacagatgccatctgaggtccttttctcccagcttgaatggggaagctccctctggcagggttcttacatagtccctgagtttctcagccacaatcaggatcctaagctgagaccctggccctgggtcctgtgtcacatcctcttatgtggcctcttggctgggacagacctcatatgactggcgtactagaaaggaccctgctcacattattacagggccgtcttcctggatgtgactgtgccctaaagcagtcagcgtaatggagtgattcaacccgagggccagactgacccaggcatctcaacctcaacactattgatattttgggtctgataattctttgctgtggggacagtcctgcaccttataggatgtttagcagcatacctggtgttcagctatcagtagtgcccccaagttgtgacaaccaaaatgttcctagacattgtcaaacgtcccctggagagcaaagcagcctctagctgaggacctctgaacttgtctatggggacagaagttggaagagtggttacaccaggggtgtggagtcaggtaattgactgggaaaaggtacaaggacctttatggaatgctgggaatgtcctgggtggtgtttacacaggtcgtgcatacccatgcgtgacatcaagctggacacgtgatctatacattttactgtatgaaaaatgtacctaaaaaatgcaccttagcgtcagacagaaccagacttggatttcagtcctgattctgcccttaaggttcattttcctcatgtgtaaatgggggcaatagtaggaccctcctcctgtggctgctgtgaaggttaaatgagatgatgagtgtaaagtaacttcacccagttcctgcctatggtgagggctcggagaatattcgctatgataatggacagggccacttcctctttccatgcctgagtttccacagctgtgtctgatggtccctaagatcccttaaggtctctgtcactgtgactttttctgatggcctcggagctatttctttctcagtctaaatactttcaaggcaggtgattctatcgaaccaagcaaagtttgtcatcagagttgctggggcccctggagtagatgaagtgctaagaaggatccaggacatcccagtcagaagttttaggtatagaaaaaaggaaggtcgagggctacggtgaccttgcaaagcacagagccactctgcacccaccactttcctcgcagaagctcctggcaggcctccgcatctcaggtcccgttctaatactgggtggggctcagagcctgcacagtgaactccttaagtggaggtgaaacagaattcacttgtcaaaagggcagtctcaggcagaatgctgtcccctctgaatcattctttttgttaaggattaaaaaaaaagccacccctaaaaggcacaacccaccctggagagatcagagataactaagcttgtgggaaacagaagtgtagttggcaccaagtcagagggtggggaagggaggagagaagataaccagcccctatggaggtgtataaaaggtgtccactctggggaagagccacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaaggtgagcccttggaagctgaggaggggtcctccatgaagggcagagcctccaaggccaagaaacacagtgttgtgggggactaggtgtggacggaattcacaaacttcttgcaggggaaaagcctactgtttgactaccaagagtctctacctctgatgggctttctcatgccacaactccccaaatgcattttctctcattattcatttttatgattgttattactcaggtcagtttttttactgctttccagacagttatgttattcatgactcgatctctataatcctaacctactgagttatctggaaacatgacaggtttaaaagccattaagaatgcatgaaatcaacagagaaagagagacgtgttcattcattgccctgggaataattgtttactttgtaggggacccattcaaactggtattctcaactggcgatggccaagttgggggagagagaggcagaggcttaggcagtgccgagcctgggtgccctttgttgagccctgtctgttgtgctgtgataccagcctgttggagcagaaatctaccagcctgggctgagtctcagccatgtggagcaggctttcactgctttggaatataaacgtttagacaagaaattcaaagggatgggaatatttgttggatttcccctccactcagctgggaagtcagctctagcaaagtgattgtgagatatgtggcaccaagccgagtccctcctgactttcaggggatggatctcaagacagtggcctagggagggtgctagtctgaggctgccaagacatgacgaaccaaagatgttctcagcaggtcgttcctcagaaatgcactccctgcatctcccccagggtgctcagacatggaatattaaagtgttagaaacgattggaggggatgcagccccactcctcactttacagaagagcaatggaggcccagagggaaatgccttgtcccagctcacaggacagtttagaggtagagccccatgggaaccaggtcctgcccatgttttcccaggccacctcctcaagcacgtggaccccccagagcaagcttgtctaacctgtggccggtgggctgcatgtggcccaggacagctttgattgaggcctaacacaaatttgtaagctttcttaaaacattgagtttttttttattttttatttttgccaatttctttttagcccatcagctatcgttagtgttagcgtatttgatgtgttgcccaagacaattcttcttccaatgtggcccagggaagccaacagactggacacccatgccctagaggttaccttcttctgcattttgtagatcctgaccgccaccattgaaaacaaccgggtcatcctggagattgacaatgccaggctggctgtggacgacttcaggctcaagtgagttttttttttccccctccctctcctttcccaggagtctcttagtttagacaaaagctcatctgaccaatgacactggagcatcccaggagtgaaggtctggaagtactggagtctcgtgcaggggtagggagaatgtctcatatcatttatgtcttgctttttcaaaaaacatttcatttttttactattttaggtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggtgagcggggattgcaggctgccctgggctcaacaacctccagtgagaaggaggagccctcccctgcaactggacacagtcctccactgtgggacctggaaacactctccagaacactctgccagcactcagagccaaggagagggaggatgagtagcctcacacatcttcctttcccatccccacaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaaggtacccggccctcccaccccacatagcccatcccatatagccaggggggccgggcggacacagcctcttggtcaggctgctcgagctgagcttccccaccaccttcttcctgcttgcatttcagagtgcagagctgaacaaggaggtgtctaccaacactgccatgattcagaccagcaagacagagatcacggagctcaggcgcacgctccaaggcctggagattgagctgcagtcccagctgagcatggtatgcctgcagcctcctgcccggtggcgaccacctctaggtttccctctggcctggctccctctgtaacttcttgtctgtcgctccaccagaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagtaggtcctctccagcctctttcttaggatagtgactgcaggacccgtgggtgtcagagcaggcagggccttagagatccaccccctcatgtcagagaggagacccctcactgtctgactttacggggacatttccttggtaggctgcagggttaacacctttaaactttctaatttgggcctccaagttagactggagggaacagagaccatggagggaacatctgatattggaaaaacatgagcttggatacagctcagctgaacaaagctattactatggtgctttaactgcctttagaccctttgcagaaatcaagccacccctgtgggctcagggctcaggtggagggttgcgggtttgggcgatccagagggaagacaaacaccctgaatcttgtggctaataatatctccccttgagacctctcagacagacagacaggaaagacagacagtcccagtgggcacctgatgctgctgtcccttgagctgggggcacagctaggaggcactagagtccagcccaggggcttgaaatgataagccgaggcacttccccagaggaacaggtaagcacctgccctcagttaccctctgctcatggccacctctgtcctctctcccaggatgattggtttcccttcctcagcaggtaagggaacagccccgtggtgtagggggaggcagagttagcctcccattcactgccccaatgggggtgggagctggcggggagggagggagccagtgctgggctctccagtgtagggagggggagagctggggtggaagtggtcattcgctcactgattttccttttgaaactgatggctctgccccacagagctatttggctgtcttgggaagagccatctttggggacaataaagagtctccatccacgcaccacctgactaatgaggagtttgtgagccctccaggggggccctgccctgtcctgaggtgggtcttctccagcctgagcatgtcttgtctcttgtttcccaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttcctgtcggatctctctcctctctgacctggatacgctttggtttctcaacttctctaccccaaagaaaagattattcaataaagtttcctgcctttctgcaaacatatttttgattctggcctggtttcttaggtggcccctgctagggccctggtttagcgggtgagggggacacagctgggcggagtagctaatccagacaacgacaagcctggggagcttcctatctaggaaggacagacataggcccatgggccatctgagcacacagacacaacaacggcaaacacaggggacacaggcagctcacagacgatggtgtccagcagacatggacagacggaacacaccagagacagcgcaggggcacgtgagccagttcaacagccttgcagattaggatgttcagtgagaatggcagctgatagtagagtcaagggagcgtgaaacatgggcaaaaagtacagatgcctctggggcaggctgcaaggggccagtgaaggggtgatctggggagaaggaggcccagcccccacctgctacctccctgcttcctgcagagaggtttattctcaggcaaatggctccttgttggcctgaggcatccactcctaatgtcctccccagcccacccctaggtcttgccactcccaaccactcctgggaccagctccctggctggccgctgcactaacctggccccttctctctgtgctccccactctctccctgccgctttggctgcccctgctctgattcgcaacctcttcctgctctgctcactccttgcacgttgactcacctcctggattccggtgtgggtgttcttctctttttcctcttcactgtccctgtgggtcatccaggacataaccatggttacagttgcctgtatgttctgataacgcccaaactcgaatctccactgaggcccctcccagcctcagactcccattgccaacagtgagccaacagtgagccagacatcacctccttcaatccacccatgcaaaagagctcccatcatcctcccagatctgctccttccttgccctttatcccggagaacctggaaagctgagccaggagcccaggagtcatcctggcctcctctgtccctcacccccttcacaatgcttcccgtggacactgcattagccataatgtccttcctggtcctaactatgggcacgtggccacagcctcctcactggcctccctgcctccatgctccacactccagcaggggtgattactggaaactgagtcttcttctcagcttagagacaccccaatcgctccctgctggtcactgaggaaagcctagacacctcgcctgcctccaggtcctggtggtgcagcttcttctggcctctccccagctctggctcctacactagcctccctcactcaccccaaattcctgccatcccaaactgcccttgaggaagcaggcaggtggctgggcaccctggggattttgttcggtgacagacctctgtctgacccaaccttcttctctcctctctctccacactcctgtcatcattttattggagactaccagttttttattcaaaattcagactgagatggatgccccctcctctgcagcacctggctggggtggggcacacttgggtgttcacatgtgtgtgcccacctgtcctagaactgacagtatcactgaagtgtcactgaagtgacagtgagaaaggcagggctgtgccttcctcaaagcgggcggggggggggtctctcatccaatagagtgcaggtgggctctgtcagtgctgatgaaaggcagaggtgaatgaacaaactggggaaatgcccctccagtgccatttgattttcgttaaggggcttaaggcagagggtagatggagttccggcaccctggccatctgcccccttcctctggcaccatcttcatattccctcccctcccctctgctgctcccctgtgtggtctcccccttccttgtcttccttctcttcccccacctcaagcctgagtatgggctgcacacagttgtcttattcacacagtggttgctcagacatgcctggcccagcttgctaaactagcagaaaggtgtctacc

SEQ ID NO: 14287 - DNA, 7125 bp, Human
  misc_feature (1)...(7125): n = A,T,C or G
gggggtgccgggcagacacctccagcaggttatccacagtcctcacagtcacctcgtctggggtaaagtggctcacatccagaaatgcctggaacttgccctcactgagcctaagctcggaggcccctgccctgctgccctccccagctggggcggcccgaggccggacatagtagccatggtagagtgtgggggtcaggatctcttctggcaggaggcctaaagggcagagagaaggcaagaggcaggatgagggaggatgaggctggcacaggggcgaaatgggaaatctggagaggagggattgggaagagcaagaggggagtcaggaggagtagggaacgggagggaggccacactgtagctaggaggagaaggcagctcggaagaggggaaaccaccaccaggggagcaagcactgttcaattaggagcagtggactgcttctgaggcaggaaacagcatacagagactgactgaggcacaggcatatgaggaaagcctacagctgagggaggggaaggaacattgaggaacgaccctccaacaagcagctgtccctaaacctaactctagaagacttggaaaatggtggtgcactgaaggtaaccttaacaaaaatctcaatcccagctcagcttctgaccaaattaactcaactgtccctaccgatggcctggaagnnnnnnnnnnnnnnnnnnnnggggtggctggtcccaggagtcagttaagcccagagtggggtggaggccagcaacgttgggaggtcagcccagaatttcagggggtgggggtggggggcaagggggtggtgtctgtgccataccttctccgaagcgctgctcacccaggcggctcgggttggcaaattcgtactcggcggtggccgggtgggcatgtggcactgagcggcccgacatggctgcagatgcagcagaagccctggtccgaggtgcagccccaacaggcgcagcgcgacccctccagctgcccggagagccagggctcgataggaggtgggggcggggtcgacaccacccaaaatagtgccgagcctcttggggggggaggggctgggagtgggggccctgagtgagagcaacgagggtgtgaccagcgccgcccggacccctagtcccctcccccgcacactcttcagctgtcgcagggggcctgagaggacagctgagggtcctggctgggaacgagctggggagggggagctggtggtgcctggggcatgaagaggcctcgctgagaccctcacaaacggtttgcacgtttccacacctcattttctcctcttcggtggcaggcactgtgcacccaattcctaaagcactcctggatttaatgttctgagagccacataggacgaaagatgcaagaaatctgtttgctcttttttcagggggtggggtctttctgcccagatgtgggatcctctcctaaacccaggtcaacccagggcacgaggcagatggctggtgctgacatgttgaccatcactgctctcttccaaggactcacaaagagttaatgtccctggggctcagcctaggaagattccagtccctgcccaggcccaagatagttgctggcctgattcccctggcattcaggactggaaaggaggaggaggggcacactacgccggctcccatcctccccccaccccgcgtgcctgcttgggattcctgactctgtaccagcttcagagaacaggggtgggggtgggtgccattgggtgtggacagaaagctagtgaaacaagacgatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagaggtgagtctccccacagctaggacgggagagtccttactggaacctcctggaaacttctccatccattttcctttcctaccctgcctaaaccattttaggcacatgtgtgtccaaatgtgaagaaaaatgaggaggttgctagtgccttcctcccccatcacctgtttctatttgatagtcctctgtatcccatttattacattttttcatgcactgtcaagtttatcctccgtcccctaacttctctacaggatacccctttctggtttggttcatgacaatctgcagggaaagagctgccttcaaactcctttgcttatctcttccaacaccttggactcttgaccgattttaccatctcaggtttcagagccaggagagagccctgcctcatcctgagctgttcatccccatgggtattttctgcctttctattccctcttctatgattttctgggtttctcagggctacgacagggcgctggcctgggtccaatcaagccctacgaggaaacaatatagggacgcccatttgtcctaagagggtggaagaacagggtgaacaaataaggttgacagagctgtcacagataacactctggtttaaaaatattcaagtgtgagtaaacaggagctgagtgggcaagggctttggaaggacaagcaggaccagcagaacattccagattgggtgggtggaaaactggcaaagagacctgagccagaagaagaggcctttgtctcacagacaaaccacaaagccaggcattggagtcagagaggcagcagatgccaggcttgcacccatccttgcgactggtcccctgggtgatctgtcttcttctctgtccctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggtaggtagcttgtttttttgttttctgctcattcattcagtgcatactgtaatagtccaggtagtgctatcagctttggaggctggctacattccagtcccaagccataacagtcgggatcaggggttacaaatcaatgtctagaagactaagttaggatagacatattgctgttgttactattatggccagagatgtggcctttgatttgatcgccttagatgggatgatgggatgctgatgccccatttaagccagtggttctgaatctgggccacattagaatcaccaggggaactttcaaaaaacctaatgctcgggcatactccagaccaattagcatatgtgctgccgaagcgagcactactccagaccaattaaatcagcatttttaagggtgggacccaggcatcagcaatttttaaggtaattctaatctacagtcaaggttgagaaccactgattaggtatagggctgtcagacacctagttgctttgcataattacattaactacaggtaccctaaaagcacttgagttgtgacttctcttttagctgtgcaagaatccgtgtctcttctttagcccatcttaatgctgaactacttggtttgtctaaatttcagagctgtgctcagtctttaatcccctacagcccatgtggtaatcagttaacgagagcctgtttggctacatgcttgagagtcagcaggcatacgggttaaggtcatctactctttgggggagttctgacaaatggaacagcttgttatgactttataagagggctttaaaattgcttctcaccatttaacgatagctcagaacctgtgcgtcaaccagtacagtttgtcctcagtaatgtcctcaggctgtttcaattttgcttatatgatttaggtttgggtcatagtctccttggatggagtcatttttttttttttttaatttcagcagcagtcctattgttctggaaccttctgggacattcctgaagagtcaggacaatttcagggcttcctcagggactcagattctaaatgagattccaaattctgtaggcccagccaacattgatctaaacctttgggaaatacccctaaacatatctatgcctcagggtttgaaaaacaatgaagtgttggactgtttcagacttctcagattctcactggtaggagtgactacctaggcaatttcatcttagctgcaaccctgaaacgaagctctatttatttttcctatgttgtcatggcatttggtctcacctaaggggaaatcaggatgcctgagttctgggcaggtgataatagttcctgttcttatctctctgcctctttcctcattcttttgggttaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataactgtcttgtgtttgaatattccacacacttttaaataaatatacagataccacagatctatttatgattgcattatgatttagagggctccaaggattttagagtcagaatgactgacttcaccatttactactggtataaatgtaggcaagttgcttaacctttctggtcttcaggttttccatttataacatgggttactgagttgtacagaggaattataggaagtaaattaaggagaagaagcaggaaaagccgctggcagagttcaaggaatattagttactctctctctgccctctttgattttagctctcagtttaaaggactggaacacatctgaatgaactctggataacgctacataaaaggccttactgcatctctaaaattaattacatcaccagggaagacatggtgaccctaatactgtttgacattttcctattgataagcattgccttaagctgatttacaagggcaataaacaggacttgggtgattatcacctaacaagctctgaggtataggctaaatcagtggcccccaacctttttggcaccagggactggttttgtggaagacaatttttccatggccccgggggagcaggagatggtttcaggatgattcaagcattagattctcataaggagtacataacctagatctctcacatgtgcagttcacaataggattcatgctcatatgaaaatctaatgccaccactgatgtgacaggaggtggagttcagcttcactcacctcctactgtgcagcctggttcctaataggccacgggccagtaccagtccatggcctgggggttggggacccctggtctaaattatctagcaaacacctactaacctaaggccagggaatatccaattcaatgtcctaccacgtaatagttaagttttagaattacaactaatagccaatcaataagtggttctattatttagcttaaagacataccactgtacagaaaaatcctccccaaaacaaaaaacaaccctccatttcatttctgtgggtctggacaaaacttctgattcacttgataaacagcactgctgtaggtgatctggtataaatgtttattgacaactcttattttttctttagcaacttctagctaatttctgatttcatgcaaaatcagaagtcagtcagtttggggactgaccagcgttttgaaatattctacgtgaaacaattgcctaaatttttttatgacatagagggaaacaacacacactggagcctatcggaggatggaaggtgagagaagggtgagaatcaggaaaaatacctaatggttactaggcttaatacctgagttatgaaatagtctgtataacaaacccctatgacatgcatttacctatgtaagaaaataaaggaaaaaaaagatcacaatgagaatcactgagcccctattagaatgactaaaatgaaaaattgactataccaactaaaacaaaaaatataaataaataaatttaaaacttaataaaaaaattcatgatgcaggggtgtggagctaggacaatataaattgcaaatctataccggttcaaaaatgctttctcttaaaaaacaacttcctaatagtctgaaatactgtgatctagccagaagtttacagccaatttttgtggctgtgtagcagacactgttggttgcctaaccaacagctatttaccaccttcagccttgccaacagtatcccagattggtttaggtatacaccatgttcttcctagccatgtgcttcagagaagtgaactcaagctccagccataggaggtctatcttgattagtccaaatcaagcagggaaattctcttcttgattttcaagattattcttgaaagggctatgactcaattatggcaaatgagacaggagggaagtctgttggagatgcttctagaaaaagtttctaaactaagaaaagatttcagaaagattcagagagagagagaga

SEQ ID NO: 14288 - DNA, 8569 bp, Human
cccgaaagactccatggaggcttacaaatacagaccaaatgcaataagataacacaatcctgtataataaagggagcacccttgtcttgtgtggagatggcagtagctttggtagcacatcttggaggatctgggctttctacctccagtttgccattaactgtgtgtttcaggcaagtcccttcaccttcctgccctcgttttttctggtgtacccagtgccctggccacgtccaggggctattgtggaaagcaaatgagcagcctcaagtttctttatctgtaaaacgccattagtaggaattaagtgatgcagtgcattccaagagcctggcacgtggtccatcttcaccaaacgctggctctgctgtgatgtttgcacgaatatatatttcttggctccagaagcagaagggagctgaacgggtattgcagcgcctgatctgcagggccatgccattctctccgtctcactcattcgtgcccattttcattggagggtggctggcttttccatgtccaacagcaaacatttgccaaaggctaatgcttgtcatttcttcaatcaacacacatataacagtaaaaatgatgccactcaccgtgtgccaggccctgggatatgctctttgcatgcattatctcacttcccctcaccaccaccctaggagctgggtactgcgcccattttacagatgaggagactgaggcacagagaggtgaagtcattgactgagaccacaccattagcaagtgagagggccagggtgtgaactcaagtgccaagccctgcccctgcttggggaggattcatggatacagtggctcccttcagaagggctcaagctcccctgctgtccgctggccactgaccttggctgttttgtggccattgggcttcagccttttctggaggccaattcaatggactagaactcaacgaggattctacagtacctgtgactacccggcacaggagtcctggggcgaaggaggtcacagcggagtggggaggctgcctgcgaggtgtggaaagcatctgcctcctgcagcaggaggcctgattgtcagtctccacttcccccacactggctgtgtgaccctgggcaaggcccctacctctctgtgccttagacacctgcctcatcagtaaaatgggaaacataaagcttgaggagaaaaaacagtgaggaaagtgcttggtaaaccataaacgcagggggttttccccacgatgaaagtcttgccctgtccttaaggatcctgcatgctccatggtaaactggcaaggacacaatccgagagccaggccaaatggtggtaggaggaagtgccagggcggcagggaaggagaaattagttggggatgactgaagcccttctgaatgaggtgtaacctgcagggtgcacgttgatgggtgaataggatgacagatgaagggcccttctggaggatctactgctggtcagctttggcggtgctccagggatgtggtgggggagcagtgggccaggctcctagggaccactgcaggaaagcctccagtaccacataaggaacaccagctgcagcggcggcatccatggtggctggtgcggtgggccctgcctgggctgggggccactgtgggccactgcccccagaaactcccaagtacagtgtacactgaagagattgtgcaacttccactttcctgttcccaccgccccagctgtagcttccccagctggcagaacagcacgactgctgacccatcccaacccttctctttggaaatttcctttgggaaggtttggaaactcagccagctcctccctgcccctgcctccccacgcacgtcctcaccctgcagaaggagcccctccatccacactgcagcttttcttgtgaccagggtaaatattacctggcactgttaatgtttaatgcccgcacctcgtccccggccaccccgtggaggcagccagacactctccaaaaagcagagacagcaggaagaggggagtggaggcagcccattcacctggggaaatgactgggttgtcgatggacggtggtgagtgtgctggtgtgcgtgcccgggcgtgtgcaatgctgggtggctctgattggcctgcctttgtggggtcagctggaccctactcttccctctcctgccacctcagccttccagagtacccagcccctcttcctgtcggcctcctctctaagaaaatttgcaacttaaaggaggaccctgctttaaccccaaagaaagatagcttgagtggcagaaaggcagcagatagaagctggagagctgagcgttcctcctcggcctcctggcacacacccgccctgagttcaatgcatcttgctagaccgtctgaacttgggcgggaggcagacggcgtccatctggctggggaaggagcaggcccctctggtcagccttcctaggctggatttggggtgagagcccgccaagttcaagtcacactctccaaaggcttcctgtcacaggaactgactcaggcctggaaaccaagaggggcacttgctgacagaggtgggttttgagccagatgcagaaaggggagggtgctgggcagggagggtctcagcaagcggctcagggccaggtggccacggaggaggaggtttcctggggcgtgtggggaagcctcagctggcgtctagctgttgctctgacacttaaatccccatatgaccttaaacaaggcctgaaccaaatctgggaagacagccctgacggccttctgtgtgggacctgggtccttcatggcctccctgagcacccagcacctcaggcccgtcaggatgggcactgactcttcctggcctgtcctttcctggcccagggactggccgctggggacagctgggcttgacagaccctaagtctcactgctgctcaggggcacagtttggcacagcccggaaagtgctaacttgcgcgttccttcctcctcgggctccacttccctcgtgcgagaaggggctccggcagggcaggaaagagtagcggcccttagctgtggcagaagcgtcctggccaggccaccgtctggctgtccggggcaagtgtactcagttgcagggcaccactgtgagacctgcctgctgagcggctccaaatccgggggaggccaccagaggcaggggcaggaccttgcctctaacgggctccttccctcccgccattgagaggtggcagatcaaagggcttatgcacctccattctcagccccctgcttcctgggttcaaacaccagctctacccctgacttgctgtataactgtgggggaatttcttctctgcacttccaccctcttgtggattacaccagaatgacattgacgcctcataaggttgccataatggttagatgagttagggtttgttagtttttgcccggtgcctgaccagcactatatattaatgtttcttaactagatctgcttcccctgaggatggtaacgcaggaaaggaggtctgtctcagctttcattaggactttgaacaagtctacacattgggctcggcttcctccttctgtctgataaactttaaggttctgttttatttattcatgcatttcccaaatagctgctaagcacctgatagccaaatggtcctgtggagagaggccgctgggagtctaatgggagaggcttctcctggccttttctaccatggtaggaatcaaggagcaggagagagccacccttccggagtggtcagaggccccccagacagcacggatccccctcggacactcggtatttggtccccagttgagcgtgtctgaagccgcctggagcagaagcctgctggcaatggttttagcaacacccctgctcccagcctcccctcgcctgcttggaccctcgagggtcctctgggaagggaaggacagggaattccagctgttcctgtggctggctcaccatcggtgactcctctcatcccacctctggctctctcctaggcggcagccccaagggggacgtggacccgttctactatggtaagcctgggcccctgcgcacccttcctgagccctcaggaccccttccaccaagcagcggcctctcccagccccaggtccatgctctgtgccccttatctcccctggttaccacgggctgctgcgggcaggctgcggagagagacagctgctgggagagaccacccatcccgctcctcttgccctctctttccggagactatgagaccgttcgcaatgggggcctgatcttcgctggactggccttcatcgtggggctcctcatcctcctcagtaagtggggtggcctccagggaaggggtgctgaccagggcacctctcttctcaaggccgctgagcaggctggctttcgggagttgccaagggaggggtgagcctccccaccacgccccccactgcaggatgtgggaatgggtgcccggtggggtgccaggctcgctgggagcacagtgtgaggttcctgcttgctcaagtgcaccctccagtgggcccgggaggagccgcagaagtgagagcaaacccacggggtaactgggtaaccggagggccagacagggggactaggccccccgctgctaaccatggtcccaaactcatttgttaaatagggatgatcccacctgcctcacaagattagggctagcatccaaagacatggcagtcaggacagcgctctgagaacggtccagtgcagactcggagtgttctgggggagacaaagagagttatgtatcctcaagccccgaggggcacacagcaggagcttaataactgcacattgacttgttttggtccaacccaaagaaaaatacacagaaaacacaacccatggaaagaagatacagcaagcacacctgtgggctctggacttctaatgcacgtgtgccactgccaccccaccccaaggctcgggccacagtcctgcgggtctccccattttcccgtgttgcccatggcagctctctctacgtgtgccactgccagcccaccccaaggctcgggccacagtcctgcaggtctccccattttcacatgttgcccgtggcagctcccggagggcagtgccgggtggcagctgatcacataggcacaggaggcaggtggcctaagcaaggggctccactttggagttgctgccatccttctccaggtgttcatcgggcagctgtgctgggggcaccatgatggcccagtctctgctgctactctcgatatgccaacagaccaccgtggatctgctccagtaaatatttgctgactgactgactgacttaggttcttaaatgcctatggtccagccttatataaagagagagaaggctgggcgtggtggctcatgcctgtaatgccggcatattaggaggccaaggcaggaggatctcttgagaccaggagtttaagaccagcctggtcaatacagtgagacccgatctatacaaaaaaaaatttttttaattagctgggcatggtgacatgtacctatagtcccagctacttgggaggctgaggcaggaggattacttgagcccaggagtttgaggctgcagtgagctacgatcccaccactgcactccagcctgggtgacagagtaagaccccgtctcaaaaaataaaataaaataaaatataaaataaaatagagacagtcaaacgtggcctccaagcctgaccctgcgatgatactggcaggagggaggtaggagagactggaagaattttgagtcttccagggtctccttggaaaattagtccatggaaacaaatctccttttctcttttcaaggcagaagattccgctgtgggggcaataagaagcgcaggtgagcgctgcctggggtgaccgatgagggggttggggctggagaaggaggggcgggctgaggattttgtctctgacacagtggaggatccccagcctcagagatccctagacccacccctccccctgccctctcacctgttgcttttccttcccccaccaggcaaatcaatgaagatgagccgtaacagcaggtatgctaggagggcctggggaaggtgcggggagggcagggcaggcttgggagcaacagggaagaattctggctcctggactcggtaaataagaattttagggtcgtccacacatcagccaggtggtctgtcacccatcgtgtgtttaaaatgatggccaagggcctggcgtggagtgtgtgccgcaggagatcacagaggagccctggagaaaagtgagatggacaagggggaagtaaaaccccaacctctgctgcctcccacccaaccccatcctgcctttgtcttctcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacctgcctgcctgtctccctcctctgtcaccaccagcctctccaagctcaagtacaaatacagccgggtctcatttgttttttcaattaattgctcaggcacctgtctgcctgtaaaagcaagaagttcagtgttgtcatctgtaggccactcctcacaccccttgaactggcagaagccctggggacagaggcctcagcctggcttttatacacctgggaagtctgaaaggcccagaggtcaaaaccacagcccattggatacccatgaggcctctgccccaggcaccactgttgggttcctggaagcgaccctgcttagcagttgctgtggagaggccccaggctaccaagatgggcctctgtgtggtcacattcctgtgctctgccgttttccatatgtacccccctgggccaaggtgggtgggtccggggagcctggtgctgggcctctgcacatgtcctgaaggagccagccctcttcccagccccctcctggtactaagctcgggccacctctttccactcttggggccacctatttggagggttggttaattccagggcctggggccagggaacagatggtgagagtgagaccactgtcacacttgctccagcccccgtccatgcaggcagggacccacccagggcagcctcagcctgagatgcttccaggtcgctccacctagtgcggactcctaatgtgcccgactcctaatgcccatgccccctttgctgtgagtccaaggccatggccatgcagggaggcctctgggaccttctgcactcaggaaggagcccaactttcctctccctcccttcactcagaggcctcgaaggctggagggattgtgggattctggcaccacctagcgtctggcttcctcatctgggcctgcaagcttttgagggaggagaggggagaactggcaggagaaccaagctacaggaccaggaaatgaacagggtgtgtttgggggccagaggcaggatagacctcactccacttgggaattaagctctttgtcttaatccactgcccccagtccctgataaccaccaactctcctagaaacacagaaggcttgagcagggaagggtccttagagagcaaaacagaccgtcttcaatttacagaaggggaaaccgaggctctaagagaggccgtggcttatccagagtgacatggccagcctgagtcggagccagaggtaaactgcaggtctctggctccccttccagagctcttcccaccacacgaacatccaaaggacgggaagcggttggtggggcagggaggtggactacccactgactgcctgtgggtttggagagtgaaggggaaacagagaaggcctggggttgtggggagaaactccagaggagaccaggagccaggcaggggaaggccaggtgacttacaactcagcaccaagtccttgtgacaccccactccaaatgtggactcattggtgtaggccaaacccttaaatggaattcagttttctttgcaggagatagaggcacacacttgagctctccctcgagggtgggagaaatgaacttgaatggggcaggtctagccaggggggctttcaggaggagggaggctcccaaagcctcttggatgcagcagcaaggcaaacaggaagagggggtattcagacctgtggcccaccccaggagaagtaagagcactggagaagaatcacgtttctagaatgttctagaatgttccatacagaggacaatccagcctgccaccctcagagggaaattccacctgctctggatgagtcacttcccttcgctgaccctgcctcaaggcctccctccttgtgaaatgtgaggctttatcaggtctgaacctgaggggcttttcaaaccaccacgtacccagatttccccagcccggttgaatatgaggtttggggggtggcctctgcaggcggaggcttaacgagccccatggccccaggtggtgttcagaggcctggga

SEQ ID NO: 14289 - DNA, 8569 bp, Human; identical to SEQ ID NO: 14288

SEQ ID NO: 14290 - DNA, 11935 bp, Human
tacaaaaattactgggtgtggtggcggctcctgtaatcccagctgcttgggaggcttagtcagaataatcgattgaacccaggaggcagaggttgcagtgaactgagatcgcgccattgcactccagcctgggcaacaagagcaaaactccatctcaaaaaaaaaaggggcttcttttttggacacacaaagattttgcgtatcatccgagccctctctgaggattttgagcaggagagggagcaacttttaaagggaggggtttggatgggatggctttggtgtcctttctggttggaccatcaatcacaccgggctctgagatagagatgccttccttcacaacactggtggcgggcagggaacagagtgtgtatactggcggtgtgggtgggggggatttggctgagagctccacttttctggaccacttagaatatgtttggaccaggtacctctaagtctcacccagtcccgaggtttgtaaacttctctaaccccagcttggggaatttccactcagccgctctgggctgagtgggcaggtttccacttgggagcatgggacaggcccgcctgccagccgagctgttatccaccccaggacaggtctggccctgcctccagggtggtctggagggaaaggtgcagagagcctggagtcagggctgtgctcaggggccccagcgccgatctcagcccatcctgataacaaatagcacctcttagacctcctggtctctatttcagccctgagagggctccctgggacgtcatgagtcctcccctcaggacagggagtgttgcaaaggagggacagagaggcgggagtcagagtgaccagagcccgggtcagaggctggggccagagccagcccctcctaactctgcttctcagtgtccacgttggggtggccgtgccagggcggctacaggaacctgacggagaccctgtggtcccaagtcagccacacagagactgctcactgtggctttgctgtgggcaaggccttggtggccgaggaacagagactgcctgggcagtgtagtgggctgccctgcatggtaggacaccctgcctagtggcctgccccgcctggtggggctccctgtggctccctgctggcttctggctctgaccatgccctgggcctagcagtgttgtcttctggccattcccctctgataccaaccagcagcccccagaggactcattaggctgctggtgtctccagctgagccctctgaggtgtggcaggcaggcctgacatcacagcctgggtgagtcactgtgggctgggtgagtcactgcgggctgagtgaggggtcccagctgaggaaagggcaggccacaggagcggcccccatcacagctccggctcccagccccgcagctgctccccatctctctgccaactgccagaacgacacaggaagctggggccggtgcctcaggtgccacgacagggtcctggaaaccattcccacccctctgagaggctgcagctgtgcctcccagtctcaggggatgcctagctacagaccggggtcttgggcaggatacctccggccaacggcccagctggactggagggcagaggtgcagcggagtaaagctcaggggacccacacatgcccctaaaggtctccctcacatgccaccagcccaggggcctggggaagagtgggctccttgattcctcccggctcctgtacccttttcgggcaccctgggctggctgcagtgtggagcccctcgagggagagggccagggcgggggctgtggttggctctgctgcatctgacagcttgcccatcctcaagtgccaggtggaggtcagaaaatctcccctggctttcacgtgcatcccttgccccaacccgccccagcaagtgggcacgaggtaagggctcctttgccagcccctcctccctccctgtgtctcttcctgtttgtgggctcacctgaagtgtgaagagggggagtgccactctccatccaggccccaggcaagcagcacctccctgctctcctgcactcctggacacaaccagcagctcctgccatggacaggtggtacctgggtgagtcctctgagccccattcctcctccctgctcaggctctaacacaggtgccagccccgtccctttcaagtgcacccacaagctccccagaagtgcaggaaaagcagaaaggaagagaggcagaatttccaaaaaagagcatctccatacggagtcactggcctgctgtaacgtgtgtgcagagcatatctgagctgcgagggctgggaaggcagctgtccaactgcctcatttacttgtctgtccatccgtcccttagagatgcaggaactcagaagccaggctgctggcttgaaatcttggttcccctaccctctggccatctgacctctggcaagttatttaacttatctgggcctcagtttcttcctctatgaaatggggtgataataatgccttctttaccttctaaaactcattgtgatgactaaagaattaatttctggccaggcatggtggctcacgcctgtaattccagcactttgggaggccaaggcgggcggattatctgaggtcaggagttcgagaccagcctgaccaacatggtgaaaccccgtctctactaaaaatacaaaactagccgggcttggtggcacatgcctttaatcccagctactcaggaggctgagacaggagagtcacttgaacccgggaggcggaggttgcagtgagtcgagatcgcaccattgcactccagcctgggtgacaagagcgaaactccgtcttaaaaaaaagaattaatttctgtaaagtgcttgaaacggtgccttgcacacagagtttaaaaatgtagccatcaactagctttccctattgcttcctattcatctatctattgatcgatctatcatccatatctatctatctatctatctatctatctatctatctatctatctatctctctatttatctatctatccatccatctgttggtgcctccccatgcacctcctcccccccgcagtgggagcccttccatccacactgcagctttgtttgtgaccagggtaaatattacctggcactgttaatgtttaatgcccccacctcatccccagccaccccaccaaggagcaaagacagcaggaagaggcaagtggagacagtccatttgggtggggaaatgactgggttgtcaatggatagatagatagatagacagatagatagatagatagatagatagatagatagatagatagatagacagacagacagacagacagacagatgaatttatttaacttcccacttatttttacatctcttattattcccgaaagactccatggaggcttacaaatacagaccaaatgcaataagataacacaatcctgtataataaagggagcacccttgtcttgtgtggagatggcagtagctttggtagcacatcttggaggatctgggctttctacctccagtttgccattaactgtgtgtttcaggcaagtcccttcaccttcctgccctcgttttttctggtgtacccagtgccctggccacgtccaggggctattgtggaaagcaaatgagcagcctcaagtttctttatctgtaaaacgccattagtaggaattaagtgatgcagtgcattccaagagcctggcacgtggtccatcttcaccaaacgctggctctgctgtgatgtttgcacgaatatatatttcttggctccagaagcagaagggagctgaacgggtattgcagcgcctgatctgcagggccatgccattctctccgtctcactcattcgtgcccattttcattggagggtggctggcttttccatgtccaacagcaaacatttgccaaaggctaatgcttgtcatttcttcaatcaacacacatataacagtaaaaatgatgccactcaccgtgtgccaggccctgggatatgctctttgcatgcattatctcacttcccctcaccaccaccctaggagctgggtactgcgcccattttacagatgaggagactgaggcacagagaggtgaagtcattgactgagaccacaccattagcaagtgagagggccagggtgtgaactcaagtgccaagccctgcccctgcttggggaggattcatggatacagtggctcccttcagaagggctcaagctcccctgctgtccgctggccactgaccttggctgttttgtggccattgggcttcagccttttctggaggccaattcaatggactagaactcaacgaggattctacagtacctgtgactacccggcacaggagtcctggggcgaaggaggtcacagcggagtggggaggctgcctgcgaggtgtggaaagcatctgcctcctgcagcaggaggcctgattgtcagtctccacttcccccacactggctgtgtgaccctgggcaaggcccctacctctctgtgccttagacacctgcctcatcagtaaaatgggaaacataaagcttgaggagaaaaaacagtgaggaaagtgcttggtaaaccataaacgcagggggttttccccacgatgaaagtcttgccctgtccttaaggatcctgcatgctccatggtaaactggcaaggacacaatccgagagccaggccaaatggtggtaggaggaagtgccagggcggcagggaaggagaaattagttggggatgactgaagcccttctgaatgaggtgtaacctgcagggtgcacgttgatgggtgaataggatgacagatgaagggcccttctggaggatctactgctggtcagctttggcggtgctccagggatgtggtgggggagcagtgggccaggctcctagggaccactgcaggaaagcctccagtaccacataaggaacaccagctgcagcggcggcatccatggtggctggtgcggtgggccctgcctgggctgggggccactgtgggccactgcccccagaaactcccaagtacagtgtacactgaagagattgtgcaacttccactttcctgttcccaccgccccagctgtagcttccccagctggcagaacagcacgactgctgacccatcccaacccttctctttggaaatttcctttgggaaggtttggaaactcagccagctcctccctgcccctgcctccccacgcacgtcctcaccctgcagaaggagcccctccatccacactgcagcttttcttgtgaccagggtaaatattacctggcactgttaatgtttaatgcccgcacctcgtccccggccaccccgtggaggcagccagacactctccaaaaagcagagacagcaggaagaggggagtggaggcagcccattcacctggggaaatgactgggttgtcgatggacggtggtgagtgtgctggtgtgcgtgcccgggcgtgtgcaatgctgggtggctctgattggcctgcctttgtggggtcagctggaccctactcttccctctcctgccacctcagccttccagagtacccagcccctcttcctgtcggcctcctctctaagaaaatttgcaacttaaaggaggaccctgctttaaccccaaagaaagatagcttgagtggcagaaaggcagcagatagaagctggagagctgagcgttcctcctcggcctcctggcacacacccgccctgagttcaatgcatcttgctagaccgtctgaacttgggcgggaggcagacggcgtccatctggctggggaaggagcaggcccctctggtcagccttcctaggctggatttggggtgagagcccgccaagttcaagtcacactctccaaaggcttcctgtcacaggaactgactcaggcctggaaaccaagaggggcacttgctgacagaggtgggttttgagccagatgcagaaaggggagggtgctgggcagggagggtctcagcaagcggctcagggccaggtggccacggaggaggaggtttcctggggcgtgtggggaagcctcagctggcgtctagctgttgctctgacacttaaatccccatatgaccttaaacaaggcctgaaccaaatctgggaagacagccctgacggccttctgtgtgggacctgggtccttcatggcctccctgagcacccagcacctcaggcccgtcaggatgggcactgactcttcctggcctgtcctttcctggcccagggactggccgctggggacagctgggcttgacagaccctaagtctcactgctgctcaggggcacagtttggcacagcccggaaagtgctaacttgcgcgttccttcctcctcgggctccacttccctcgtgcgagaaggggctccggcagggcaggaaagagtagcggcccttagctgtggcagaagcgtcctggccaggccaccgtctggctgtccggggcaagtgtactcagttgcagggcaccactgtgagacctgcctgctgagcggctccaaatccgggggaggccaccagaggcaggggcaggaccttgcctctaacgggctccttccctcccgccattgagaggtggcagatcaaagggcttatgcacctccattctcagccccctgcttcctgggttcaaacaccagctctacccctgacttgctgtataactgtgggggaatttcttctctgcacttccaccctcttgtggattacaccagaatgacattgacgcctcataaggttgccataatggttagatgagttagggtttgttagtttttgcccggtgcctgaccagcactatatattaatgtttcttaactagatctgcttcccctgaggatggtaacgcaggaaaggaggtctgtctcagctttcattaggactttgaacaagtctacacattgggctcggcttcctccttctgtctgataaactttaaggttctgttttatttattcatgcatttcccaaatagctgctaagcacctgatagccaaatggtcctgtggagagaggccgctgggagtctaatgggagaggcttctcctggccttttctaccatggtaggaatcaaggagcaggagagagccacccttccggagtggtcagaggccccccagacagcacggatccccctcggacactcggtatttggtccccagttgagcgtgtctgaagccgcctggagcagaagcctgctggcaatggttttagcaacacccctgctcccagcctcccctcgcctgcttggaccctcgagggtcctctgggaagggaaggacagggaattccagctgttcctgtggctggctcaccatcggtgactcctctcatcccacctctggctctctcctaggcggcagccccaagggggacgtggacccgttctactatggtaagcctgggcccctgcgcacccttcctgagccctcaggaccccttccaccaagcagcggcctctcccagccccaggtccatgctctgtgccccttatctcccctggttaccacgggctgctgcgggcaggctgcggagagagacagctgctgggagagaccacccatcccgctcctcttgccctctctttccggagactatgagaccgttcgcaatgggggcctgatcttcgctggactggccttcatcgtggggctcctcatcctcctcagtaagtggggtggcctccagggaaggggtgctgaccagggcacctctcttctcaaggccgctgagcaggctggctttcgggagttgccaagggaggggtgagcctccccaccacgccccccactgcaggatgtgggaatgggtgcccggtggggtgccaggctcgctgggagcacagtgtgaggttcctgcttgctcaagtgcaccctccagtgggcccgggaggagccgcagaagtgagagcaaacccacggggtaactgggtaaccggagggccagacagggggactaggccccccgctgctaaccatggtcccaaactcatttgttaaatagggatgatcccacctgcctcacaagattagggctagcatccaaagacatggcagtcaggacagcgctctgagaacggtccagtgcagactcggagtgttctgggggagacaaagagagttatgtatcctcaagccccgaggggcacacagcaggagcttaataactgcacattgacttgttttggtccaacccaaagaaaaatacacagaaaacacaacccatggaaagaagatacagcaagcacacctgtgggctctggacttctaatgcacgtgtgccactgccaccccaccccaaggctcgggccacagtcctgcgggtctccccattttcccgtgttgcccatggcagctctctctacgtgtgccactgccagcccaccccaaggctcgggccacagtcctgcaggtctccccattttcacatgttgcccgtggcagctcccggagggcagtgccgggtggcagctgatcacataggcacaggaggcaggtggcctaagcaaggggctccactttggagttgctgccatccttctccaggtgttcatcgggcagctgtgctgggggcaccatgatggcccagtctctgctgctactctcgatatgccaacagaccaccgtggatctgctccagtaaatatttgctgactgactgactgacttaggttcttaaatgcctatggtccagccttatataaagagagagaaggctgggcgtggtggctcatgcctgtaatgccggcatattaggaggccaaggcaggaggatctcttgagaccaggagtttaagaccagcctggtcaatacagtgagacccgatctatacaaaaaaaaatttttttaattagctgggcatggtgacatgtacctatagtcccagctacttgggaggctgaggcaggaggattacttgagcccaggagtttgaggctgcagtgagctacgatcccaccactgcactccagcctgggtgacagagtaagaccccgtctcaaaaaataaaataaaataaaatataaaataaaatagagacagtcaaacgtggcctccaagcctgaccctgcgatgatactggcaggagggaggtaggagagactggaagaattttgagtcttccagggtctccttggaaaattagtccatggaaacaaatctccttttctcttttcaaggcagaagattccgctgtgggggcaataagaagcgcaggtgagcgctgcctggggtgaccgatgagggggttggggctggagaaggaggggcgggctgaggattttgtctctgacacagtggaggatccccagcctcagagatccctagacccacccctccccctgccctctcacctgttgcttttccttcccccaccaggcaaatcaatgaagatgagccgtaacagcaggtatgctaggagggcctggggaaggtgcggggagggcagggcaggcttgggagcaacagggaagaattctggctcctggactcggtaaataagaattttagggtcgtccacacatcagccaggtggtctgtcacccatcgtgtgtttaaaatgatggccaagggcctggcgtggagtgtgtgccgcaggagatcacagaggagccctggagaaaagtgagatggacaagggggaagtaaaaccccaacctctgctgcctcccacccaaccccatcctgcctttgtcttctcagcctcggcggtgccacccactgcactggggccagctgggaagccaagcatggccctgcctctggcgcctccccttcttccctgggctttagacctttgtccccgtcactgccagcgcttgggctgaaggaagctccagactcaatgtgacccccaggtggcatcgccaactcctgcctcgtgccacctcatgcttataataaagccggcgtcagagaccgctgcttccctcacctgcctgcctgtctccctcctctgtcaccaccagcctctccaagctcaagtacaaatacagccgggtctcatttgttttttcaattaattgctcaggcacctgtctgcctgtaaaagcaagaagttcagtgttgtcatctgtaggccactcctcacaccccttgaactggcagaagccctggggacagaggcctcagcctggcttttatacacctgggaagtctgaaaggcccagaggtcaaaaccacagcccattggatacccatgaggcctctgccccaggcaccactgttgggttcctggaagcgaccctgcttagcagttgctgtggagaggccccaggctaccaagatgggcctctgtgtggtcacattcctgtgctctgccgttttccatatgtacccccctgggccaaggtgggtgggtccggggagcctggtgctgggcctctgcacatgtcctgaaggagccagccctcttcccagccccctcctggtactaagctcgggccacctctttccactcttggggccacctatttggagggttggttaattccagggcctggggccagggaacagatggtgagagtgagaccactgtcacacttgctccagcccccgtccatgcaggcagggacccacccagggcagcctcagcctgagatgcttccaggtcgctccacctagtgcggactcctaatgtgcccgactcctaatgcccatgccccctttgctgtgagtccaaggccatggccatgcagggaggcctctgggaccttctgcactcaggaaggagcccaactttcctctccctcccttcactcagaggcctcgaaggctggagggattgtgggattctggcaccacctagcgtctggcttcctcatctgggcctgcaagcttttgagggaggagaggggagaactggcaggagaaccaagctacaggaccaggaaatgaacagggtgtgtttgggggccagaggcaggatagacctcactccacttgggaattaagctctttgtcttaatccactgcccccagtccctgataaccaccaactctcctagaaacacagaaggcttgagcagggaagggtccttagagagcaaaacagaccgtcttcaatttacagaaggggaaaccgaggctctaagagaggccgtggcttatccagagtgacatggccagcctgagtcggagccagaggtaaactgcaggtctctggctccccttccagagctcttcccaccacacgaacatccaaaggacgggaagcggttggtggggcagggaggtggactacccactgactgcctgtgggtttggagagtgaaggggaaacagagaaggcctggggttgtggggagaaactccagaggagaccaggagccaggcaggggaaggccaggtgacttacaactcagcaccaagtccttgtgacaccccactccaaatgtggactcattggtgtaggccaaacccttaaatggaattcagttttctttgcaggagatagaggcacacacttgagctctccctcgagggtgggagaaatgaacttgaatggggcaggtctagccaggggggctttcaggaggagggaggctcccaaagcctcttggatgcagcagcaaggcaaacaggaagagggggtattcagacctgtggcccaccccaggagaagtaagagcactggagaagaatcacgtttctagaatgttctagaatgttccatacagaggacaatccagcctgccaccctcagagggaaattccacctgctctggatgagtcacttcccttcgctgaccctgcctcaaggcctccctccttgtgaaatgtgaggctttatcaggtctgaacctgaggggcttttcaaaccaccacgtacccagatttccccagcccggttgaatatgaggtttggggggtggcctctgcaggcggaggcttaacgagccccatggccccaggtggtgttcagaggcctggga

SEQ ID NO: 14291 - DNA, 11935 bp, Human; identical to SEQ ID NO: 14290

SEQ ID NO: 14292 - DNA, 16455 bp, Human
  misc_feature (1)...(16455): n = A,T,C or G
gccacgatcatagctcactgcaggcttgacctcccaggctcaagcagtcctcccacctcggcctcctgagtagctgcatgccaccacgcccagctaattttttaactttttgtagagacagggtcttgctatgctgcccaggttggtctcaaactcctggcctcaagctgtcctcccacctcggcctcgcaaagtgctgagattacaggtgtgagccaccctggcctgattttaggctttttttgtactggggagaagagactgtgagccaaagtgtagggtgccaaaaagagctttgtgggatgagattttagggcaaagctggggcagtgtctgacttggcggtggtcatgtgtactgatttaggggaaagatcttgaggttttctcaaataattcacctatccccgtgttccctcaagaaaggtcatgttgacctggaaccataggggaaattggtggggtgtgatcagggtcagccccagctgttgctgcccctgcagtgttttgtccagagcacttgcctgcaggtcaggataggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtattttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccctgctcactaacaccctgatctccgtccggtatgaaaacacctattccgggtagtctggctccacgttaagcaaacaccactttccgtgttcaccgacagctagagccagaggtctcccggttgctgcttctgaggctgggtctgcagcagctgaggctcccgcctgtcttgccgaatggcctaagtctctgtcttgagactttcgagagttctaatcgtcaaatttcccattttattttgagattttccctgcggcccactatttcggacaacataggagagcctcaaaaacagtttctagcttccaactcggctcaaagttcagacagcagctgggcttccgagagccgccggtgttccaagaaaagctgcccgggactgggaggcgccctctggacgccggaacctttggtttcctgccgtggagcggaacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggtgtggcccctggtcccccgcagccggccgaccgcaaccgtgcgcctcaagctttccttccggggagaaacctaagctgcagccacccgggccgcgggacaaagtgcccgccgcgggcagggcaggggccggggaggagggggtagggaatggactgtgccgcggagcggccaggcagccctcttggcggaggatccagggaaagtgcggccccaccggccagctggcccccaggcggaaacggggcggcctccagcatgtgcccaccggcccgtcccacgcaggctttttggggccagctgccctgtggctgtgctctccagcttcctgacgccggagagacttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccctagggatcacgaacctttgacgcctctgcctgtttccctcatcttgcttctcaccttgttgctcctttcttgtgactcaaagctgagtaccttgtgacactgcagatgcttggagagtttcaagcccctgccgacactttatccaaggaaggatatcaggataggacttctacctctaggcctatcacaacagctctcttgcagatggtggacctgctggttccgggtggagctgaccatcccagaggcatgggtgggccaggaagttcacctttgctgggaaagtgatggagaaggtctggtgtggcgtgatggagaacctgtccaggtgaggaaccctgtcctagggccaggtatggccacatttcagccctgaaatgactacagcccttcttctgtggactctggagaagccacagctgagttgctctgcccacagggtggtatcaggatttcaggactagggaagttgccacttgggcatctgtgcaattggtccttagtttttattgtgtataatacaaacttataggaaaacatttcaaacagttctagataaagtaatggatctctccttatcacccatcccattccccagctataaccactgttaagtgtcttattcatgctccacccttatcaggtttagtccttatactcctatctagtaggtctttatacccatttacaaattaagaaacagatgtgtagttgactcactcaggttcacacagcttctatttcaaattggactgactctcaatctggggttaagactgttcttcctggctacaagaaggcagagaccatcccttcctcccttcactggctcagcaaatatctcctggtgtccattctgggccatacccttaagcactagggtgtagcagggaatgaggcaaacctgcccctgacttcacggagtttctttcccggtatttatttaggggtgcagaggccaccagaatccacactcaggctgcctaaccccttcccagggcccttcccataagaccatgggtttgccactggtaaacaggggctatttgacggtcatggtgctggctgccatgggagttggggcatctactgccaagggtccctgatttgccaatcttggccctgcttgggagagaggacccagagctgggaaccagatggaggggcctgactccccatggcttacactttacctgaactgtccaaaagcctcaagccttgtctctctcactcccctccctactagggtttaaccaaagagggtgagaagaccagctatgtcctgactgacaggctgggggaaagagacccccgaaggtgagtccctgtgccctggttgaccagtgctgtcagggagggagtaccagtgagcaaggaggagctgaggcccagagtgatctcataagcccgcctctgctctagcacaatcatcctcacatctcattgtttgcttttaaaagcatgattttttcctaaccataaaaataatgggctgggtgcagtgacccacactaccctgggaggctgagtgggaggatcacctgagcccaggaggatgaggctgcagtgagccatgatcacaccgctgcactgcagcctgggcaacagagtgagaccttgtctcaaaaataatagcaatgtttgcctgtggtaaatacaggaaagcacaaagaagtaaataactaccgttattccactccctagaatagagatgaacattattaacatctcagcattcatgttcttttttttgagacgaagtctccctctgtcgccgatgctggagtacagtagcacgatcgcagctcactgtaccttctgcctcccaggttcaagcgattctcatgcctcagcttcccgagtagcagggattacaggtgtgtgccaccacgtccagctattttttttttatttttggtagagaaagggtttcaccgtgttggccaggctactctcaaattcttgacctcaggttatccgcccctctcagcttcccaaaatgctggaattacaggcgtgagccaccgcacctggcccagtattcatgttcttggtgtatctttccggcatagttttttttgttttttcgggggggtttttttggatttttttgagacggagtttcgcttttgttacccaggctggagtgcaatggcacgatctcggctcactgcgaccgccgcctcccaggttcaagcaattctcctgcctcagcctccctactagctgagattacaggtgcccaccaccatgcccagctaattttttgtatttttagtagagacggggtttgactctgttggccaggctggtctcaaactgctgacctcaggctatccacttgcctgagtctcccaaagtgctgggattacaggaatgagccaccgtgcccggctcatcccggtatagtttttactagttaagattgtatcctgacttcttacattccatgttataacatggacattttatgacaccattaaaaacacttcttagacattatgaatgtattttatatagattgaacactgtttcagatgctttcagacactgggagtatggtggtgaataaaatagcccttgccaacaaagggagacagattcactcatataattacaaaactgagggctctggaaggaaatcctgggtactccactgaggaatttgctctagacttagcagcgaagtggagtcaggaaggcctccctaaggaagtcgtgtttgctctctgaagcctaagtatggcatcaccacagcccagcctgttctccaatgaatggcccgcccatgttggccgtgttggttttagatcttgggtctaaaagtttgagcctgggagatccgaacatgattttaatatgcaaagagggttccaagaccaaggcagtgctttgcaaagacaactttggaaatataagactaaacagcagcgtactttacatggttccaaactttgctacttattctctctgacagcaagacatgggatccatctggtgtttgtaccacaaccctcccacatgcactcttgtcacactgtgggatcctctgggtagtggatcctggaagcagacaggttgggctcagctggatgcctcctgggtgccctttccccaagtccccggagtactgtgccagtcccttagcctgaggctgtctccccatctttgtagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggtacttgacaccccctgtaccccctgctaccctctagagccctgctccaagaaggttgttctttgggtcagataaatgggactctgggaatccagagtaggacgagggtttccacctgcttgagggttgagagaattttcctatgtgaaggggaggagggagacggtgctgagcagggggaccagcagggaaaaagggttgggggtcaggggagctctgctgagagccctgagatcagtggagcctaggtctggaagctgtgcttgaaaaagggattaaggggcagaaccctgctgcagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacaggtaggacagcagctggttgggctggctggggaagcaggagtgcccttgaagacctggatgtgccctagaagcactgtgtgatgctcagcaagttcttgctcctcttggacctgcgttttccccgtctgtaaaacggggccggggggctggactgtgggctctgcttgctttggattcactttttttttttttgagacggagtctcactcttgtcacccagggtggagtgcaatggtgtgatctcggctcactgcaacctctgcctcccgggttcaggcgattctcttgcctcagcctccttagtagctgggattacaggcacccaccacaatgcctggttaatttttgtatttttagtagagacggggtttcaccacgttggccaggctggtctcaaactcctgacctcaggtgatccgcctgccttggcctcccaaagtgctgggattacaggcatgacccaccgtgcccagcctcatttattctttcaacaaaatctgatgcctcatggggcccatgctagatattgagggtaggattacagagacagattcagcaggcagagttggtgtcacaatggtggggagtctgaggcactggagagcacaggagaggtacttactccagctgggttgggggattccagagaggcttcctggacaagtttgcagtgtctgagttttacgggaaatccacatttttaacaagctcctgaaggtattgattctgatgcagccgaagttttgggatcacagaacaagggctttctctgctgtgccaagatgtagggtaaggtgtgagaggttctgggctggtaagggaggaactgcagcctgggagtcaggagaggctgtagcacctctggtaggacagctggctccatcctgggagccatgcctctgttcccaggtatacatcaagtttgtgcaggggcagggtagtccctgctacttctcgtaggatcctctaggggatgtctaattccccaagaggactgaggctattctggggcctggagcctccatttcctgacctgtataattggcctcatagcactgccgcctcctttccccagcccctcctcccacctcgctggagtgaagtgaagtgaccacttaggagggacaccacagggctttccagggtgaagggcctgggatgggaggggggctaggtgaccctctggagtcccagcccaggcctggtcagccttgctgctccctctgtcctccacctcactccccgtatagcctggctttggcccttcaaagagactgtgaggaaatgtgcccggagctgggtgaccgccctgcagctcatggagcggaaccctgagttcatctttgcctgctcccaggtcagagggacagctgtgagggaggagggaagcacgtggccctccctggagctccacaggccctgaaggcttcccaggcctggggtcagggctgctcctcaccctcagccacacactgagtcccatatgctcagtcctgggtggggcccttgtcactctggtcccagctcccttcaacctgcccacaggcgcagcagctggaatgggtgaagagccgctaccctggcctgtactcccgcatccaggagtttgcgtgccgtgggcagtttgtgcctgtggggggcacctgggtggagatggtaagtgcactgggcactcctcagccttgaactgtatgacaacagccttccctcaggtagccccgccctcccggctttgctggtgagtttccacgggccactcatccccgctgtgtggcagggctggctcattagtccctgggatctcaaggcctgggacttcaagggggaggagagcctccagcgctgtgacaagttgcatggcctagtcctgggcaccccctcaggcagatggacagtcaggcctgaaggacaggggcccttcctgagttctggctgtaactcccatgtttgagcagccctggcttctcctgcagggattgggttggcctgagcgcctgcctgctccccgtccagcgctgacctgggctgcctcccacttccttcactgccaggatgggaacctgcccagtggagaggccatggtgaggcagtttttgcagggccagaacttctttctgcaggagtttgggaagatgtgctctgaggtaggctgagagctgctacaccaggctgtgggcgagtggggctggcgctcgacttggagtgctgaggggctgaggctggggtgagtccgcctggagctctggttcctgcactccaggatcctctttctccacagttctggctgccggacacctttggctactcagcacagctcccccagatcatgcacggctgtggcatcaggcgctttctcacccagaaattgagctggaatttggtgaactccttcccagtaagcaggcccccggggggtcagggtcagagtgggcctcagtcccgcctggcccatttgcctctcccccttattgtggggtcctagacagaccaccaaaccctcactctgcctctgccagggtcacatagcaggcaggggcaggaccaagtctggaaggcctggctctgcctcagccctgactctggcctctctgccctgcttctgtttccctgctggtagcaccatacatttttctgggagggcctggatggctcccgtgtactggtccacttcccacctggcgactcctatgggatgcagggcagcgtggaggaggtgaggggtcacctagggtggtggggtaggggcaggctggagagggctggcttgttccaggctgatccatgctggcctgccctcacctgtctaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccaggtcaggccgggccttggctctcctttagccccaccctgggcccttgccatgagccctgccttccctcagacattgggcccaacccctcctctggaccttgtcctgtcccaatcctagaccacgggttcctccaaacttccaccctgggggtgggtgggggagaagctgaagctggtaagggctccagcccatcagagagagaggctctcctagggcgtccagggctggccatctgtgaacggggagctttctggagtggctcctctctgtaggagctggatcctttgctttggtgtggaagaagggtgagccatgtggtctccaaggctgggagacctaggcttgtggtctcctcagggtgcagctatcttctccaagacagctcttctcagcactggagagtgactcagagcagctgtgcacgtgggttggggagctcttcttggagctgcacaatggcacatacaccacccatgcccaggtcagggggaggttgcagggctgtgcagggagggtgtgcccttgatctgcagagggtcagagaaggcagcaggggacagagcccaggccagatctaggggaagagaagtttggaggagagaagttcaagacctgggttggtcaagaaagcttgaaggaggcagaaacccctgaagaaagaagggtttgggctgcggggagaagagggaaggcatttaaggcaggtcacccgccagaggccttctccacgaggcccttggtgagtcctcagggattctgagcaagggagggctttggaaggtgtcctgggacagctaagcaggctccagactaatcttcccatcctgggctcagatcaagaaggggaaccgggaatgtgagcggatcctgcacgacgtggagctgctcagtagcctggccctggcccgcagtgcccagttcctatacccagcagcccagctgcagcacctctggaggtcagcccagttctgtccctgccatccacctgactgctcactgcagttacctctgtgcctgcccctcccagccttcccatccctgcccttggcccctgcaggctccttcttctgaaccagttccatgatgtggtgactggaagctgcatccagatggtggcagaggaagccatgtgccattatgaaggttaggctcacaatagtcctgcctgctctctccaaccccagggctgagcccagagtgtcccctgtgggatacccatgggcacattccagacctgttgcccacctatgaccagccagtctttcctcagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctaggtacgagctgaggggaagggttgctactgcagcaggaaggatggaggccagacagatcaggcctgggataccccgagggatctgggtgcccctgactggagagtagtagcacatcttccaccaacccatccccacctgcgcaagcttcctgaaaggtcaggaaggctgcactgatgcccaggcctcacccccagccctggtgacagtgcccagcatgggctatgctcctgttcctccccccacctcactgcagcccctgctgccccagcagcctgtgttcgtagtgcaagaggtgagtcctgcatgccctggggggcaggaactgtgctgggatactttcttacaactgagggtcctgagctcccctgtctggagcaagtggtgaggcggggctggggttggggtgggaagacttttggtgtgggaagcccctacagactcagcctcaaggcctcctcccacaaagactgatggctccgtgactctggacaatggcatcatccgagtgaagctggacccaactggtcgcctgacgtccttggtcctggtggcctctggcaggtgccaaatcctcattgccctttcccagtgcctggcaagtagaccccaggccatttcctctctccccttgccacaacactgcccacagcagcccaccagtggctctgggctggaacccacacatggagcagggcaggctgggcagtagtcccctgtccactgggtctactcactccaccctaccccaccaagagcagctggagacagcgaggtcagttggttgtacagcaccaatcccatgtccttccagggaggccattgctgagggcgccgtggggaaccagtttgtgctatttgatgatgtccccttgtactgggatgcatgggacgtcatggactaccacctggagacacggtataggctgggcagcatgtggggatggtggaggtggtgggaacacaggctgctctggatcagtatgtccacccctgtcccataggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtagtcggggggtagggggtggctgttttccccaagtgtgcttggtaaggaggggccagccccaggccttggtgtgtctcttccttccctgactcccaccctccttcccactcccaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtctgacatggcagggtgggagtggccttggactcctccctggctggggagactgcttgtgtggaacaggctggggaggaagaggataatcaacatttgctgcttcctaacgtgtgtgccaggcattgcactaaatgctttacattggcaaggcacagtggctcacgcctgtaattccagcactttgggaggccgaggtgggtggatcacctgaggtcaggagttcaagaccagcctggccaacatggtgaaacgccatctctactaaaaatacaaaaattgggccgggcgtggtgactcacgcctgtaatcccagcagtttgggaggctgaggtgggtggatcacgaggtcaagagatcgagaccannnnnnnnnnnnnnnnnnnnnnnnnnnnnnnnnnnnnnnnnnnnnnntcctggctaacacgatgaaaccctgtctctactaaaaatacaaaaatttagccgggtgtggtggtgggcgcctgtagtcccagctacttgggaggctgaggcaggagaatggcgtgaatctgggaggcagagcttgcagtgagccaagatcgtgccactgcactccagcctgggcgacagagcgagactctgtctcaaaaaaaaaaaaaaaaaaaatccaaaaattggccaggcgcagtgttctcaggcctataatcccagcactttggaaggccgaggtgggcggatcacgaggtcaagagatcgagaccatcatagacaacatggtgaacccccatctctactaaaaatacagaaaaattagccaggcgtggtggcacatgtcctgttatcccagctactcgggaggctgaggcaggagaatcgcttgaaccctttaggcggaggttgcagtgagctgagattgtgccactgcactccagcctggcaacagagtgagactccatctcaaaaaaaaaaaaaaagccgggcgtggtggcacatgtcctgttatcccagctacttgggaggctgaggcaggagaatcacttgaatcctggagggcggaggttgcagtgagccgagatcaagccactgcactccagcctgggtgacagactgagatcctgtgtgaaaaaaacaaagttttacatttaatttgatactcatgatcattcgatggggtgagtactattatttattcccgtttcacagataaggaaactgaggcttaggcaggttgggtggcatgcccagggccccgtacagtgggagctggagttcagttgtgtggttctagagcttgtgctcggcctagtgacaggagctctggagtctgggagcacaaagaggggcacagggccaccaagtgggtcttggatctgccctccaggtgtgggcccatcgctggatggatctgtcagaacacggctttgggctggccctgctcaacgactgcaagtatggcgcgtcagtgcgaggcagcatcctcagcctctcgctgtaagtggggtacccaccaggcctgggagctggcatggagaaatgggtcttcccgaccacaactccaacagcttcagcgtggcccctacgcgccctcctcaccccagcttgcgggcgcctaaagccccggacgctactgctgacacggggcgccacgagttcacctatgcactgatgccgcacaagggtgagtgctggggacggtggggccttcctgcagccctagacacctctctgcccttccctgagcccaaaccccagcaacctggcttcctgccccttctagggacaggggagggtagcccccattctccaccagcattgtttcctggtcgtaccccaggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcaaggggtgggacgtgctggggacggggttccgaactgggcctgccctcggcccctcccaccagacgtgttcctctgcaggcggagagcagcccccagcgccgctcgctggtcctgaggctgtatgaggcccacggcagccacgtggactgctggctgcacttgtcgctgccggttcaggaggccatcctgtgagtggcggtgtgggattggggcgggggtcgagtctcgccctcgcagagccttcatggcccctcctgttctccagctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaaccctgctgctcagtccccttagggcccatcctcacgcttggggtgggggtgggaagtctggggtgggatggctttcccaggtatttggtgggtaggggcaagatcctaaggtacctgtgcgtgcagggtctgggttgcagcccccacaggagagactggggacctcgagccaccaaaagccagtgaagagaccatgagttgagaagcccctcccctgtgccagcaggtaaagggcctgggcctggggctggggaggggccgaagggtgggttttgcctggctcctgccaggatgagggggcagccctggaccctggagaatctggactggaggagctctggctcctgggctgcctggggccagggtctttgtaccacctctgaggggctgtccttgcagaggcaaactgtcctctgatagagtcagagccttgaggactgggatgggggctcagtttgccttgtgaggagctgggccttctgtcaccaggaccggacagcaggcccttcctacctggccatctcagaccaagaggtgccaagaagttcaaatgtatcagtttattaaaaatgcagcatttttcacatgagctttaaagatgtggaagatggggtacaattaaaaccatgagagttgtgcagggaacagccgtagggcctgtttgcaccttcagatattgcctgctcccaaaaattcagacccccagatgcagggcaagacaataagaaagggtgagtgcaagcaaggagagcctcctgctaagaggctgaggtcccctctggttccaaggatgggatgtcagccttgaccttccggggtctgcagtggcctgggggaagaacaggcaagatggtcagctaagactccaggggctgccatggcagcctttctcccacctttgtacacgcgctcctaggccaccatcccatcctctcctgtagagccagtttctgggagtgatgaggaaagcccaccagaggctgcctgtcgccccttcctcctccccttcttgggcactgtgggagcttctgggtcctgctggaggctggtcccctcaggccgctgggttgcagtcctcttaggaaggtctctctttgcccttcgtgtcctggaaggggccttgcttggaggcaaagcgtcctggatggaggagacacgggtccctgaggggctcagaaagcagttcagaggttggttagggcccaccactccccccgccctcttagggtaaggcagctgcctgggaggggcagccagggctgcagagtgcaggggaggaggcgggagcaggcagccatacctccactctgtcctcaggactcagctgtgtggccttggatttctttttgcgggacttgcgccctgcaggacactggtgttggagttggagggtcctatcctgcccaggggtgactcccagggttgcagggggatagggtggagaagggtgctgtagcccttgcaggcgtgaagtcctttctgctctcttagcctattacattaggagtagcttacctttgggtgccaacggtccaggatccccctaaaatgggatggggataattcaggaatcagcctgggttggcacaggggcggtattccttggagaggcaggactcacacacacccatccagatcagtgtagcttctcccttaggaagcctctaggacatcccccatgttagagtccacatcagcaaagctgctctgcccttggctactttcacttgggctacctgccttgggctacttccactagctgcaaccctgggacgcatgggaggggaggggtgtgaccctcaggaacagtgtggtccttggagggtctagacagaccctgagcatcaccaccccagttattgtgaccccacgtttccacccatcagcctcctggggtctctgcctgtgtgaacagtagggcccaacctggaaccagatggtacggccatgccggtcctgcagggagctcatgcctggcatgccatagcagcgcagccagg

SEQ ID NO: 14293 - DNA, 101128 bp, Human
  misc_feature (1)...(101128): n = A,T,C or G
ctccagcctgggcaacaaagtgagaccctgtgttaaaacaacaacaacaacaacaacaactttgggaggccgaggtgggcggatcacgaggtcaggagattgagaccatcctggctaacatggtgaaagcccgtctctactaaaaatacaaaaaaataaaaaaaataaaaataaaaattagccgggcgcggtggcgggtgcctgtagtcccagctacttgggagcctgaggcaggagaatggcgtgaacctgggagggggagcttgcagtgagccgagatcgcgccactgcactccagcctgggtgacagagtgagactccgtctcaaaaaaagaaaaacaaaaaagccaggcgcgcggtggctcacgcctgcctgtaatcccagcactttggaagaccgaggcgggcggatcacaaggtcaggagttcgagaccagcctgaccaacatggtgaaaccccgtctctactaaaaatacaaaaattagccgggcgtggtggctcgcacctgtaatcccagctacccaggaggctgaggcaggagaatcgcttgaccccgggaggtggaggttgcagtgagccgagatcgcgccactgcactccagcctgggcgacacagagactccgtctcaaaaaaaaaaataaaaaaaaaatcataggagcatcacaactcacagcaccttcctgttgtctgaaggcccctcctttgggtccctcaggactggctccagggcttcagccttggaactagttgtggactttgggtccctttggaatatttatctttggcttggaataatgcaacaacgtaccagacccagccttgccttctctatgccccattcctccccaaatgactccaagactgtacccctaatcctgaaccctttgctgcacttgccctagtgaaaatcaaaggtctgcaaaggccgcgtcattcctgaatgatgttcggagtctgatgtcgtttctatgggggattaaaattagcgacactggagatgaattacagggtgcagccagtaaggagggagagagagggaggcaggtgcgattccttccacctaagcatcctggcctggcaggcaacctttccagggtctttcaggctgcaagcgacaaatagttgaggattgtgggtttctcacgcgtaggtggcagcggcaagttaaccccaggagaggtgccagtcagcagataatttgcaaacgaacgtattctcctcctcctccgaggatctgagcctcacgaaatactcttttcttcctttttctccctcccgcagtcgagttgccttccgtccagctagggtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatataaaaaaggatttcctcccggaagagagcggcagttcggagagatttttcttaaggaagcagaagcggcgtttgcggccgctgcaggcgccgggccctgccggccacactatgcgcgagccggccccgggctgctgaggcgcggggacgcggaagcggaggccgagcgcgccgggctcccgcgctcgcgagcgagttttgtccgcccggcggcggtggcggggggatggagcccgcgaccgcgccccggcccgacatggcgccggagctgaccccggaggaggagcaggtaagcgggcccgaggccgccgcgttgggtgtgtccgggcccccgaggcctacgccggcctctgcctcccgagtgccggctctttgcagccacggggccgcagccccccgctcccgtgcccggctcgcgggcctccctcaccggcgaccgcgccccaggccgccaccccctcgtcgggggacccacgggaccctactcccgttcccgccgcttctttcgccgaggcttaccagcctcagacggtgccctccgcaccccaccccctattccaggggcaaagttccttggatccaggggccttcttcccgagatttgcagaaccgctgcttgcccccggcccttccactcccttgtaaatgttttccgtgagggtttgtggcttttgaagggcaggaaaagccccagtttggggggtgcttcctgtggggattatctcccttcccgaggagagggctgagagtattggatgcatagatgccctagattttcagaggagcctcttaggtttctcaggcccacttgggcaggttatggaagatccagcccttctcgtgttcctaaagtccctggccttgacccccctattcagctatcccagacggggcgcatctcctcacccgcgcttccctaccctcgtctcatctgactgtctccatctttctgaagcttacattgagctctattgttccttaaaagcctatgacctttagttttcagaaggaagtggtttgctgtctcattttgggggcccttgtaactttccctcccgcacattccagctgcggagacagggaccactcctgaggaagatgggaaggtctgctagcttagactgggaaccctacgggcttttcgctgtctcttccttggcactgcccataccccgccatagctatgctcgattatagtcatagtctgattccatgttataaataaaaaaaataaaaataaacatgaaaaaagaaaaaggcaaaccatgctggcaacccatttcaagctctacagctcttgtttccaaggaccacatttgctagcacagcctctagtgtgaagacagtccagttttacaaactattattggctaatgggcttgttgacctgattttttaaagtccttgtcttttctccttatttgtggagatgacatttttctatttggcctcaggccacggttttgtcttttgacacctggtgatgaaatctgtatgggaaaaaaatttaaaaagaattctgctttgtacaagcagtggtaatgaatgtcctggtaactgcagttggatgttaataaaatgctagtcagaccctagtgcaagcaggtggccaaggagcccattctgccagaattgggaagtacttcagtactaagataggatgtgttggctgattttaaagggacaaaatctctttctttcatccttttccttgggtcagtcagatttctgtttttaagacttaaagccatcagtattctatgcaaatagcatccgttgcaaatttgaaaactaaaaccaggaaaagtaaatattaaagtattgatagtattgacatggtattggctttactttgtacatagtgcatacacatatatacagatgtgtttaactagtaaaaaccttatcttttaccctgaattgaatgtgatgggcattaacaaggactaggatggaaacggcaaaatgtttattaaagtcaagagattgtgtgtgtgtgtgtttttaaaatcttatctcttttttctacaaaatattatttttttacaagcatttcaaaatattgaaacaaaagcagtatagttctaattatggtaatgcctaatgttaccatattttagtttaatatcacataagagtactctctttttttttgagatggagttttgattttttgtttgtttgtttgtttttttgagacagagcctcgccctgtcatctaggctggagtgcagtggcctgatcttggctcactgcaacctctgcctccagggttcaaacgattctcctgcctcagcctcccgagcagctgggattacaggcgcctgccaccatgcccagctaatttttgtatttttagtagacgcggggtttcaccatgttggccaggctggtcttgaactcctgacctcatgatctgcccgcctcgtcctccaaaagtgctgggattacagtcgtgagttactgcgcctggccggagtttgggttttgttgcccagactggagtacaatggcgtgatctcggctcactgcaacctccatctgccgggttcaagcgattctcctgcctcagcctcctgagtatctgggattacaggtacccaccatgcccagctaatttttgtatttttagtagagatggggtttcaccgtgttggccaggctagtctcatcatactcctggcctcaggtgatccacccgccttggcctcccaaagtgttgggatcacaggtgtgagccactgcacacagccagaagtacccttttgttttttaactgagtcttgctctgttgccaggctgaagtgtagcgttgtgatctcggctcactgcaaactctgcctccctgattcaagcgattctcctgcctcagcctcccaagtagctgtgacttcaggcgtgcgtgccaccatgcccagctaagttttgtatttttactagagacggggtttcaccatgttggaggatggtctcgatttcttgacctcgtgatccacccgccttggcctcccaaaatgctgggattacaggcctgggccgctgtgcccagccaagagtactctttttttttttttttttttttttgagatggagtcttgctctgttgcccaggctggagtgcagtggcgcaatctcggctcactgcaagctccacctcctgggttcatgccattcttctgtctcagcctcccgagtagctgggactacaggcgcccgccaccacgcctggctaatttttcatatttttagtagagacggggtttccccatgttagccaggatggtctcgatctcctgacctcatgatccacccgccttggcctcccaaagtgctgggattacaggcgtgaaccaccgcgcccagccaagggtactcttaagatttatttaaaatattaaaattaaacagcagtacataagtgttagccttatcaaagtggtcctcatgggaactgacacattcactccgtaatgctgccctattgctcaaaccaatttaacatttatttggagttgatttagaagcttgtggcagaatctttgaaatttcttcagtgtaggaaaatccttgtacttttgagagtcagtttgatttctgtaaatagcaaaaaatcttttagagccttatttaaagtaggggatcaaattcggtttacacattttcatgcaaaagtgtagtgcagttaggccctttttggcctgtgtgaacagccttaaagatatttcttttctttctttctttttttttttttttttttgagacagagttttgctcttgttgcccaggctggaatgcaatggcgtgatcttggctcattgcaacctctgcctcccgggttcgagcaattctcttgcttcagccaccctagtagctgggattacaggcgcccgccaccacacccagctaagtttttgtatttttagtagagatggggtttcactacattagctaggctggtctcgaactcctgacctcaggcaattcacccacctcagcctcccaaagtgctgggattacaggcgtgagccaccgcgcctggctccttaaaaatatttctgaagcagaatacctcctgagtggtatctccttctgtacagtcatatgaatcagaaacccagaagtcttggacactgctgtccctctgcccttgtgtacaatacagtgttagattttcctgaatatctcttgaattcattggcttccttccaccatcactgccatcaccctattcgaagctactatcctatcctgacaggacttttgtttcccacctggtccatccatattccagaatccagaagccagagtcctgttgaaaatctgatttcatcttcccctcagcctgcctgccccgcaaagaagcattcataaaactctttagtggcttctggttgccttttttttttttttttgtggagacaggatctcactttgtcacccaggctggagtccagtggtgtaatcacggctcattacagcctcaacctcctgggttcaagccgtcctcctgcctcagcctcccaaagccttaggattacaggccttgtcattgctcttgagatcaaattgcaacttttgaatgtaggctatatatctaggcccttgagcagcctaggccctagctagttctcacacttgtctctgctccatgcacactggccttatagtcctgccttctttccttgtttcctcctgcttacagggtctttgcaggagctgctttcctccatctggaaacacccccctttgttaacctcctcttcatccttcagctctcaggtttcacctccttggaaggccttccttgatttcagttagattagattctaacctaataggttctcagagcaccatttacctgtcattcacatcacttatcacaagttaacacttatttgtgtgattacatgactgcaagcaagctctatgagggttgggattattttcgcttttgctccccatcatatgcacattgcctagcataatgactgacataatgactggcacttacggaaatacttgcagaatgaatgaagagtagttgtactcttgatttgtatacaggcagcatcatcttctttcagagtggcttaaaaataagcacattacatattttgatttttttccccatcaaatggcaatatatactttgatttatatgctgtgtatgcattgatatagtttttgaaagtcatgattacttagtctcattttctgtctaggcatgtgttgaacggatacaaatcctcatttgtaactttggtgtttcttgtttttcagctcctcaataattataaagcctacaattgggctacgaggacaaatatgatgtttttgcttttaaggagcttatatgaataacaatcgtaacagtatcttttctaaactcctgctttcagtcaggctctgtggtgggcatttcacatgcaattaatcgtccctcccaagattggaattactaccctcactttgcaaataagaaaactcagactgagagaaggaaattgcccaaggtcacatagttaacaagtgatgtagccatgatttccacccaggtctaggttttctgccttcactgccagtgtttcctcttttacactacattacttcccatgaagccattagccaatttacttaggtgcctaagtgggtataaaatagctaattttgtgggttttggtattgatatatgtgtttggttttgttaatgcttcttaaaatatagtttgaaaagtacagatgaaaagatacagaaaacctttactcagctgtgtattgccagaggaaacatactgtatactctgtgcaagaaattatgatgaaattactataggaaaaaaatttgttccttaaaacagagttgtcaactctccatttcaaggtgtggtcacaactacaataaaattttattttctttatatcttcttgttcttttgcacaagaaggcttgtgaaagcctttctttttctttctttctttttttctttttttttgagacagagtctcgctctgtcgcccaggctggagcgcagtctcagcccactgcaacctccgccttctgggttcaagcgattctcctgtctcagcctctcgagtagctgggactacaggcatgcaccatcacacccgactaatttttgtattttctttttagtagagatggggtttcaccatgttggctagtctggtctccaactcctgatctcaagtgatcagcctgccttggcctccccaagtgctcggattacaggcatgagccaccatgcctggccgtaaaagcctttcttaatgggctggcagtttggcagtgtgaaggacaatttctacatataagtattaatcttcattgtcattatgttattgtgttttgagacggagtcttgctttgttgcccaggctgtgggcagtggcacgatctcagctcactgcaacctttgcctcctgggttcaagcgattctcatgccttggcctcccgagtagctgggattacaggcacctgccaccacgcctggcttatttttgtatttttagtagagatgggatttcaccatgttgcccatgctggtcttgaactcttgaccttaggtaatccacgtgcctcagcagcccaaagtgctgggattacaggtgtgagccatctcaccctgccaagactcttaactagaactctcactagattaaaattctgtataattatagctgtttagggtattttggttttgcatggatatcccagtgatgattgataggataatagagtagttttcgaaagtacttatgtttctgttaatagttttatttttattttttatttagttttttgagacggagtcttgctctgtcaccaggctggagcacaatggcacaacctccacctcctgtgttcaagcgattctcctacctcagcctcccaagcagctgggactgctggcatgcaccaccatgcctggccaatttttatattttagtagagatggggtttcaccatgttggccatgatggtctctatatcctgacctcgtgatccacctgcctctgcctcccaaagtgctgggattacaagcgtgagccaccaccaatttattttatttcattttttaaataatagagataaggtgtcactatgttgcccaggctggtcttgaactccagggctcaagcagtctacccaccttggcctcccaaaatgctgggagtacaggcgtgagccaccacgcccagcctgaaaattattattatttttgtttctttttttattttaattttatgttttttctttttttgaaaattcttaaagtttatgttatttagaccttacaatgttgtgaggattaataaggagatgcatgtagagcacttagcccaatgcttatataataagtagtcagaaaagttagccattattatgatattcatcattgttttttgtttttttctttttgagacagtcttgttctgtcacctagactagagtgcagtggcatgatctcggctcactgcaaccgccgcctcccgggttcaagcaattctcctgcctcagcctccctagtagctgggattacaggtgcccgccaccatacctggctaatttttgtatttttagtagacacggggtttcgccatgttggccaggctggtctcaaactcctgacctcaggtgatcaacctgccttggtctcccagagtgctgggattacaggcatgagctaccgtgcccgtcctcatcgtttttgaatagcgaaaaattttagaaccatgttagcttaagccaattacaaggggaaaaaatattcatatccaccctggggaccatcacctagtacaggttcttatgaattccagaaaattattatcttgcatttttatagtgtagtttttaaaagcctattctaattgtatggtgtggtttttgcttttttttttggagacaggatcttactctgtcacccaggctggaatgcagtggcatgatcataactcattgcagcctcgacctcccagcctcccaggatcaagtgatccttccacctcgcctcccgggttcctgggactacaggcatgctaccacacatgactaatttgttatattttttgtagaggggggttttaccatgttgcccaggctggtcacgaactcctaagctcaagcaatcctcctgcctcggcctcccaaagtgttgggattacaggcatgagccactgtgcccagtctggtttggatttttgtaatggaatcttttaaagctaaaaatttaactgctttagcgtggacttcagagatctttggcatttttcccaaaggcaagggttttgtcccatttcttgcggccaagaacttcccttttcccacagtcttacatgtcctgtgctaaatgtcatctgtctccctggaagttaccatacgtcaaggaccaaatgatttatgatgttaaattgaggtcttctacagagacaaagaaggaaggaaaggtgaagaactcttattattttcattattgctgatagtttatgatactgtaagtaacaattaggtaaaacctcatttggatgtgagaattttgctgtattaaaaatttctggttgggtgtggtgtggctcatgcctgtaatcccagcactttgggaggccgaggcgggtggatcacaaggtcaagagatcaagaccatcctggccaacatgatgaaatcccgtctctagtaaagatacaaaaattagctgggagtggtggcgctcacctgtagtcccagctactcgggaggctgaggcaggagaattgcttgaaccgggaggcaggggttgctgtgagctgagatcgcgccactgccctccagcctggtgacaaagcgagaatccatctcaaaaaaaaaattctgagcacaagggtcttggactttagttttgtgaatattaagtggcctggaggttttctctaaggaacccaacctagtacttatgaatgaattgaaaagaccctcctttagaaaggagctgaactgtttttttttttttttttttgagatggagtttcactcttgtcactatctccgctcactgcaacctccgcctcctgggttcaagcgattttccagcctcagcctcccaagtagctgggattacaggtgcccgccaccacgcccagctaatttttgtattttttgtagagatggggtttcagcttattggccaggctgctcttgaactcctgacctcaggtgatcagcccgcctcggcctctcaaagtgctgggattacaggcgtgagccaccatgcctggccaggagctaaactgttttaaagaggtaaaagttaagactcattgtgagtatattttagtttcattttctgacttttatgcctttattgtcttggaaaagacatagtaattttggagtacttaaactttattttctaaatattaagccccattttacggcagtgtggctggtccattgcagtgccaagattagaagtcatagaacctaaccctgattatttgttcagatacaacctctagtgtaatatcagccatttcactgcttctgtctaccatcctgccttggtatatcagacaattctcgtactttctttttcctaatcaattattttaacattttccccctaagcacacctccatgcgagatcttggttgctcttcctgaccactaaaataaccactgttttctattcctattcttctagaataagggaagatgttcctagaaaaggtagtttagcctacacttctcagtgctggagggcctggcatcagcccttttatatctgattttgaaaaggccccttaggaacctaaccgagttagcttcttaagcgtttggttcactttttaaaatttttttagtaagagacagggtcttgttctgttgcccaggctgaagtgcagtggcttgatcctagctcgctgcagcctgaaactcctggtcccaagtggtcctccttcctcagactctatagtggctggaactacaagcatgtaccaccatgcctggcacatttttttttttttctaaagagatgggggtattgctttcttgcctaggctggtcccgaactcttgtgttcaagcagtcttccagcctcggcctcccaaagtgctaggattacagacatgagccactgtgtccatccagcattaggttgttttttttttgttttgtttttttttttttttttgagacaaggtctcactctgtcacccagactggagtgcagtggcatgatcatggcttgctgaagccttgacctccctggcccaaggaatcctcctacctcagcctcccaagaagctgggactaaaagcgtgcaccaccacaccaccatgcccagttagattttttattttttatttgttgtagagacagggtctcgttctgttgcccaggctggtcttaaactcctaggctcaagtgatcctccagcctcggcctcccaaagtgctgggattacagccatgagccactgcacctggctggcattaggttgttaaacatggacatggagggtgcgaacaggaggcagagaagctccagaactcatgggaaaccttatttattaaggattgctgatctcttaggtccaaactataaaatggtaagaccgaaacagtagattagagatgatttttctctttaatttatgcttctgagataagcatttcagtttttgttttctttttttttttttttgagacggagtctcgctgtgtcgcccaggctggagtgcagtggcacaatctcggctcactgcaagctccacctcccgggttaatgccattctcttgcctcagtctcctgagtagctgggactacaggcgcctgccaccacgcccggctaattttttgtatttttaatagagacagggtttcaccgtgttagtcaggacggtattgatctcctgaccttgtgatccacccacctcggcctcccaaagtgctgggattacaggcgtgagccaccgcgcctggcagcatttcatttttcctttgggaaaggccgtttctgtagtatgtaccagtttcctctgaaataccaaatccatccacaacataccggcacagtacttgtcacttttttcagtgtaggtagcacaggtaagtttattgaattattctgaagccagaatttatttctacagtaatttctgggcaggttctaaaaaagtcatctgtgactttaggactgaagtgtttggggatgttcatccattagttacttgttcattgcttgaacacctagctaatcctttacctttgcatttgttttgatgtgaatcattattacagatacacgtcattatgataatatgatgatattcattatatacatcattattacaaccaatccttttaaaaaatgggctatttaaggctgggcgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatgggctatttagatgatctacaatgatcatatgtttctgttgccgaggctggaatgtggtggcacagttatggctgactgcagccttgacctcccaggctcaagcgatgctcccacttcagcctcctgagtagctgggaccacaggcccgtgtcatcacatccagctaatttttttttctcattaatagagataggacctcactatgttgcccaggctggtctgaaattcctgagctcaagctatccttccgcttcagcctcccaaaatgctaagattataggcatgaaccactgtgcccagcccatatgtttctttctttttttttttttgagacagagtgagactctgtcgcccaggctggagtgcagtggtgcgatctcagctcactgcaacctccgcctcctggcttcaagcaattctgtctcagcctcccaagtagctgggactacaggtgcctgccaccatgcccagctaatttttaaatttttagtagagatggggttttgccattttggccaagctggtctcaaactcctgacctcaggtcatctgcccacctcggcctcccaaagtgctaggattacaggcatgagccactgtgtcccgccacttacgtttcttttataatgaaaaataacactttctgaaaagtactatgtgttctttacacgtttaagattatgctattaaatgctgagatctcagtttttaatattattgcaaatctggcctttttataaactagaagatttataagtaaaacctaggccttttgggatgtgatggtgatgaccctttggtagatctcaggaatccctcagcttcctttgtggctctcggtgttttatttaacgttcctgaatctgttttgtcttatttccttaagttttttggagatctgcttaattaagtaaaatcccttgtatttacaaaatgctcaataaatagtggtaagtattcttgatctctgtgatacaggaaacttttctttttcagataagaataggaagaaaaatgaagagtctgactttgtagcattgaaataaaagatttcaagatagcctaagaattctaacagttaccatgcatgagtaatatacatagcagagtactgaggctaccttagctcattttttactgttaagactttttgcatcatccattggttcattggttcatttcttctttctaggttacacattacctttaggtgcactggtggtggtggtctgcttctgctgctgcttttcagataaaatattaaaaggtcatctgatgacctaaaaatgattcgcaaatgagtgcaaagaatgatagtttgtattatcttccatatcttatttaaacagcctttatgaagaaaattatcattccattgtttatctctggttccctatcagtatgatcctccccccagaacatttgtcaatatctagaaatttctttagttgtcatgactgtgggaggtggtactggcatctagtggatagaggtcaggaatgctgctaaacatcctctaatgcataggacagctccctacagcagagaattatctggtcaaaatgtcagtagtgccagagttgagaaaccatggtttatctctgaaaaattttgtagttaggaacagtttgaagttttcactttaaagttaaagataggtctttgctcaacacatttagtgtttatgaaaatatgtgtcaccaaatactgatttcagcaattgacttctcatactgaaaagctctagtctaaaaccaattgttttatagcataaccatcataggggtaaaatgagccatttccacaccctttgcaggggttttcagaggtggagggattttatttagcttttaaaaaattattattattattattattattattattattattattatatattttttgagacggagtctttttctgtcgcccaggctggagtgcagtggtagaatctcggctcactgcaacctctgcctcccgggttcaagcagttctcctgccttagtctcctgagtagctgggattacaggcacgtgccaccacgccagctaatttttgtatttttagtagagacggggtttcaccatgttggtcaggctggtctcgaactcctgacctcgtgatctgcccgcctcaggctcccaaagtgccgggattacagtcgtgagccaccgtgcccagccaaaatttatttttatgtatttatttttaatagagagagggtcttgttgtgttgcccaggctgttctcaaattccttgcctcaagggatcctcctaccttgccctcccaaagtgttagaatacaggcatgagccactgcactccagatggagggattttacatgagagaacactactgagctttgccatggcatgataatgtggtgtcatatttttttttttttttttgagacgtagtctcactctgtcggccaggctggagtcagtggcgcgattctggctcactgcaagctccgcctcccgggttcacgccattctcctgcctcagcctcccgagtagctgggactacaggcgcccgctaccacgcctggctaattttttttgtatttttagtagagacggggtttcactgtgttagccaggatggtctcaatcttctgacctcctgatctacccgcctcagcctccagaagtgctgggattacaggcgtgagccaccgcacctggccaatgtggtgtcatttttatttttccccttcaagtgtttctcttttttaaaattattgtttttggccaggcatggtagcttaagcctgtaattccaacactttgggaggctgaggcaggaggatcgattgagcccaggaatttaggtacaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctaggatgattgtctttaagatatagggatgatattcagaggctttcagtagaagcgctgagactcactcttctggttaactgctgtctccagtgcacttcctctgcctttaaccatgtatgttcgtgtatgacacacacaccccagagatagctctccctggacatttgtgggttcaacattcctggtttcagccactcacaagtttccctgtagaggtgtggctacattgttcccagttatttattgttccaagatgtcactgtttaatgtacatttacgtatgacagaaattatatgatttaatgaggttaatgaagttggggagttcatataagcctctggctgtagctctcagaatagaaggtctgctctttgcctttatgaaaatccatcttggccaggcgcagtgggtcatgcctgtaatcccagtactgtgggaagccaaggcgagaggatcatctgaggccaggagtttgagaccaacctgggcaacacagcaagaccccatgtctacacaagtaataataataataataaattagctggggtgcggtggctcacacctgtaatgccagcactttgggctgctgaggtgggtggattacctgaggttgggagttcgagaccagcctgaccaacatggagaaaccccatctcactaaacatacaaaattagcctggcatggtggcacatgcctgtaatcccagctacttgggaggctgaggcaggagaatctcttgaatccaggaggcagagattgtggtgagccgagatcgtgtcattgcactccagcctggacaacaaaagcgaaactctttctcaaataaaagtaataaaaaataaaataaaaaataaattagccgggcatggtggcacatatctgttgttggctgatgtgggaagatcacttgagcccaggagtttaaggttgcaatgaaccatggtcatgccactgcactccagctggagccacagtcttatatatatacagtttaatctctcaagtaccacagtgagtataatgggaaagtatatttcatatacttgcctatcaatatctgggacaacagcttttgaaattgtttttccatgatactttcgttttgcccatttttttttttccttttctgtttttaagctagattttttttcaacttgggtcaaatgtaagaaagttgaggaagaaaattttccaaaaaacggaattcttttttaagtaattttttttttttgagatggagttttgttcttgttgcccaggctggagcacagtggtgtgatctcagcttactgcaacctccatcgcctgggtttaagcgattctcctgcctcagcctcccaagtagctgggattacaggcatgcgccaccgtgccgggctaattttgtatttttaatatagataaggtttcaccatgttggtcaggctggtcttgaactcctgacctcaagtgatccacttgcctcggcctccaaagtgctgagattacaggcatgggccgccatgcctggctttttaaagtaattttttttttttactctcactctgtcacccaggctggagtgcagtggtgtgatctcagctcactgcaacctcagactcctgagttcaagcgattctcctgtctcagcctcctgagtagctgggattacaggcacgagccaccatgcctggctactttttgtatttttagtagagacggcgtttcaccatgttggtcaggctggtcttgaactcctgaccttgtgatccacctgccttggcctcccaaagtgctgggattacaggtgtgagccaccgcgcctggctttaaagtaattaacaacaacagcaacaaaatatagatgggtgtctcactgtgttgcccaggctggtctcgtgctcctgggctcaagcaatcctcctcttttggcctcccagagtgctaggattacaggtgtgagcctctgcacccagccaggaagttatttttactgctcttttatactttctatattttcctgatttttttcttggaatcatgaaggaaaagagttactgagagaaaggcctgaagacttaaatgtaatatatgaggacaattaaacagttttatttgggaatggccatttgcctcactaaggaggctctagctcttccatgccttgaaaaccccaaaaatgaagaaaaaatggtatttctggctaggttagggacttagaagtggtgtagccagcaagattaaaatatacaagattttccacatacttttgttttcaaaaataacctttctagattaatttctaaatgctctagagaaaccattagacatttccggaaactgaatgccagtgtgtgccattttgtttatgggtaaaacaacgttattatggaattaagttatcagataaatttttttttttttttttgagatggagtcttgctctgttgcccaggctggagtgcagtggcactatctcagctcactgcaacctccgcctcccagattcaagcaattctcctgcctcagcctcctgagtagctgggattacaggcacatgccaccatgcccagctaatttctgtatttttagtagagatggggtttcaccatgttggccaggctggtcttgaactcctgacctcaaatgatctgcccaccttggcctcccaaagtgccgggattacaagcatgagccatcgtgcccagtgagaaagtttttaaaaagaaaaaaatattcatttttttcttttcttcagccaccccaaatattttctttcttctttttttttttttttatgttgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggttgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtcttggctcactgcaacctccgcctcccaggttcaagcagttctcgtgcctcagccttccgagtagctgggattacaggcgtgtgccaccacgcccagctaatttttgtatttctattttttcttttttttttgagatggagtctcactctgttgccaggctggagtgcagtggcgcaatctcggctcactgcagcctccgcctcctgggttcaagcagttctcctgcctcaggctcctgagtagctggcactacaggtgcaagcaaccacgcccagctaatttttgtatttttagtagagacagtgttttaccatgttggccaggatggtcttgatttctcgacctcgtgatccgcctgccttggcctgccaaagtgctgggattacaggtgtgagcgactgcgcccggtcaatttttgtatttttagtacagatgaggttttggcatgttggccaggctggtcttgaactcctgacctctggtgatccacccaccttggcctcccaaagtgctaggattacaggtgtgtgccaccgcgcccagcccattttctttcttagtcaacctgaagctaggtaaatgctagccttggaggtgatttttcaagaaaattagaagcaatcgtgaaaacttgtcttttgaatggaactgctaaaccatttgaagctggaaaatagtcagaacctctcatgttgtcatgctatctttacagtgctacaagtattggtaaaagcccatatcaaaacttgtgataataataatagctaagccctacctaccaggatggttagaagtaaaacaaaacaaaatgggaaacaagtgttggcattgctgttaggaatataaaatggtacagccactgtggaaaacactttggcagtttctctaaagattaaaggtagaactaccatattacccagaaatttcactcctaagtatataaaagaattgaaacagagcctcaaagagatacttgtgcacccatgtcatagcagcactattctcttttttgtttttttgtgtttttttttttgagacagagtcccattctgtcgaccaggctggagtgcaatggtgtgatctcagccctctacaacctccgcctcccaggttcaagagattctcttgcctcagactcccaagtagctgggactaaaggcatgcgctaccacacccagctaatttttgtatttttagtagagacggggtttcaccatgttggccaggctggtctcgaactcctgacctcaggtgatctgcccacttcaacctcccaaagtgctgggattacaggcattagccactgcgtctgatcagcagcactattctcaatagccaaaggtggaacaacccaagtgtccatcaacagaagaataaacaaaatggtgtatatacatataatggaatattactcggccttaaaaggaaggcagtcttgatatatgctatataccatgatggaccttggaaacattcggcttcatgaaataagccagacacaggaggacaactgttgtgattccacttgtttgaggtacctacaataggtacattcatagggacagaaagtagaataccagaggctgtggaaagttgggaagggggaattattgtttaatgggtacagagtttttgctgggtatgataaaacaattttgggttatagaaaggtgctagttacacagcaatgtgaatttatttaatgcaactgaattgcatatttaggaatagtaaaaatgataaatattgttaggtatattttaccacaataaagaaaatgcggccaggtgtggtggctcacacctgaatcccagcactttgggagactgaagcaggtggatcacttgagctcaggagtttgagaccagcctgggcaatatggcaaaactctgtctctacaaaaaaatacaaaaactagccaggtgtggtggcacatgcctgtaatcccagctactcagaaggctgaggcagagacttgcttgaacctgggaggcggaggttgcagtgagccgagattgtgccactacgctccagcctgggtgacagagcgagaccctgtctcaaaataataataataaaataataattaaaaaaaaggccggtgcagtggctcacacctgtaatcccaacactttgggaggccgaggcaggggggatcacgaggtcaggagttcgagaccagcctggccaacatggtgaaaccccgtctctactaaaaatacaaaaattagccaagcgtggtggtgggcgcctgtaatcccagctactcgggaggctgaggcagagaattgcttgaacgtgggaggtggaggttgcactgagccgaggttgtgccactgcactccagcctgggcgacagaaaaaaaaaattgttgatctagagtagtgcctctctctctttttttttttttttttttttttgagacgggggtctcgctttgtttgtcatcgaggctggaatgaagtggtgcagtcatagctcactgccacctccatttcctgggctcaagggatcatcctgcctcagcctcccaaagtgctaggattataggtgtaggctactgcacctggctagagcagtggttcttaaagtgtgtttccctgaccaccaccatcagcatcccttgggagcttgttaaaaatgcaaaattttggccgggcgcagtggcttataactgtaatcccactactttgggaagccgaggtgggtggattacttgaggccagtagttcgagaccagcctggccaatatggcgaaaccccatctctacaaaaaatacataaattatctgggcatggtggtgcacgcctgtaatcccagctactcaggaggctgaagcccaagaattgcttgaacctgggaagtggaggttgcagtgaactgagatcacaccactgcactccagcctgggtgacagagcgaggactgtctcaaaaataataataataataataataaaatgaaaagtaaataaaaaacaaaaatgcacattttcaagtcctgccctaggcctgctgaatcagaaactccgaggtgggatccagtaatatgtattttaacgtctctaaatgcatactcaaagtctgacaaccagtgatccagagaatatctagggtgctgttgttgatcaaggaaacatctagaagtgaatttagacattcaggtacagttgaggaagggaagtcttgaatttataaattggctctggaactaggtatagaagcagtctgaactggatgaaagctccaggaatcatttggttctggactagaactgaactgttccctggaagaggaacagcaaggcagacttctcaaagactagcatttatcatgatttttctcatctgaagaaagagcagagtctcttgagatatagaaatggaaccaggatatttgcatggttgcaaagagggcattgagatacctgatgtccactgcagatggcattccctagagagatgcttggcttccaagggagtattgaatgaaacaagacccaggctgttctgattcagccaggaaaacctgccagttttgacaagaccattccatagggggaagctcatgttactccagtgttagttgccctgagagtctggacatgtgagttaacagattttactgtctgggttctgctggggagctgatgcctcactgcagtgaggacatccagattacaggcagctatttaagacttcattctttgtaggtttgcaaatagtctcttaggtacaataagctgatcaacttgtaccattttgtgagaatatatacgtttgttcctgagtttatctgagggcctttttggatttgaaagtattgatctaggccgggcatggtggctcaaacatgtaattccagcactttaggaggctgaggtgggaaaatcacttgagtccaggagtttgagaccagcctgggcaacatggggagaccctgcctctacaaaaaaattttaaaggccaggcgtggtggctcacgcctgtaattctggcacttgggaaggctgaggcgggcggatcacctgaggtcgggagtttgagaccagcctgaccaacatggagaaaccctgtctctactaaaaatacaaaattagccgggcgtggtggtgcatgcctgtaatcccagctacttgggaggctgagacagaagaatcgcttgaacccgggaggcagaagttgtggtgagccaagattgcaccattgcactccagcctgggcaataagagcgaaattctatttcaaaaaaaaaaatttttttttcttttttcagccgggcatggtggcatactcctgtagtcccagctacttgggaggctgaggtgggaggatcatttgagcctgtaaggttgaggctgcagtgacccatgattgtgccactgcaatactccagcctgggtgacagagcaagattctgtcttaaaaaaaatcaaaaaaaaaaaaaaaaaagaaagaaagtattggtctagcaggtttgaaatggctgagatgactgacattgtctaattgtatacttctgaccagcttcatccctttaagggagtaatggagctgtgggtcaaggagacattcaggaagagtcctactttcttgagtatgtgactcagactcaggattaattcagttacccagggtacagggttgggtctcagcctcaggaagaatgcaggggccagttagatttggtgcagattagcatcaagtataatctgcaggtcagggccagattagcagcaagtctcacatgcctcatcctagatttttggactagaagtgaacaagtcactctgtcagatccatttggggctttggaactggggcaaaattgagggacgtgaatatgttgtggggggatatatgagcatgaatgtgttactggggcatagagatagaagcagttgtcaggtagctttggttggatggagtggagggaatatagagccaggaagaagaggcaagttactgtgttttcagagctactaacttttctcatctgtcctggattgattctaatttgccggtgaccctcttaaagtttagcactcaggactaaagacagtatcatgaatgaagtctgataggactccttgttttggacactgtgcttctgtaatggtctccaaattcacaataatttttggcagtcttagcaagctgttgattcacagattcaagtctactaagatctttaattcttttcttatgtactcctgttaagtttcatctggtgcttctaaaattgatttacttgcacatatccttaaatttcattttgttagatttaatgtgcactaccatttgttgagtcttatgtcccaagaattttacaaatattaccttttctcccctcttgcaattttgtgtagtattacccccgttttataaatgtcgaaattaaggttcagagaagttaagtaacttgcctggattctaaacagtgagtgatagaatctggaatacaaacccttggctgtctgactctaaaggccgttgctttttagtaccattctagcccattgcaccatccagttttgatcttttggatttgtgttctatttttaccatatatttgttctcttagctaaaggccctccttctgtatggtcagcatgacccagtgcccttatctaaatcttttatgggaccatatctagtttgccggtgactctcttaaagttcagcactcagaactgaagacggcctaggtgctttttgacttactgtggggttatgtcccaatagacccatcgtaagttgaaaatatcataagttgaaaatgcatttaatacacctaacctactgagcatagcttatcctatgatgttcagctcatatctgagccgcaaacatgctcagagcacttacattagcctagaattaagcaagatcatttaacataaaggtgattttataataaagcattgagtatctcatgtaatttattgaatactgaaagtgaaaaacaaaatggttgtatgggtgttcaaagtacagtttctactgaatgcttatcactgtttttttgttttgttttgttttgtttttttgagacggagtttccctcttgttgcccaggctacagtacaatggtgtgatcttggctcaccgcaacctccgcctcctgggttcaagtgattctactgcctcagcctcccgagtagctgggaatacaggcatgcgccaccatgccccgttaattttctactttttttttttttagtagagatggggtttctctatgttggtcaggctggtctcgaactcccgacctcaggtgatccacccacctcggcctcccaaagtgctggaattacagacgtgagccgccgtgcccggcagtgcttatcacttttgtaccattgttaagtcaaaacaaatttttttttcttttttcttttttcttttttttttttgagatggagtctcactctgtcacccgggctggagtgcaatggtgaaatctcagctcactgtaacctccacctcccaggcagtttccagcaattcttctgcctcagcctcccaagtaactgggactacaggcgtgcaccaccatgcccagctaatttttgtatttttagtggagacggggtttcaccatgttgttcaggctggtctcaaaactcctgacctcaagtgatctgcccacctcagcctgctcaaagtgctgagattacaagtatgagccaccatgcctggctaaagtcaaaaaattgtaagtcagaccatcataaattggggactgtctatattacagatgaggtctagtaagcctccttgtttgggatgctacgcctctgtaatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcacccagccatctttttattttttatgtcctttaaaattgaccccactggttgggcatggtggctcacgcctgtaatcccagcactttgggaggccaaggcaggtggatcacctgaggtcaggagttcgagactagcctggccaacatggtgaaaccccgtctctactgaaagtacaaaaatcagctggatgtagtggcgggtgcctgtaatcccagctactcgggaggctaaggcaggagaatcgcttgaatccgggaggtggaggttgcagtgagccgagatagcgccattgcactccagcctgggtgaagaagcaagactctgtctcaaaaaaaaaaaaaaaacgtttatcaggctgccttggagttctcaggattgtcagattgttagggtctctgctgttttgaaattcatttctctctatttacagggcttattttttcccacttcaaactgaacattgtacttgatagagaaacggaaaaaggagtttatcaagacagttttttttttggtgggggtgggggtagacaagggtcttactcggtcactcaggcaagagtacagggatgcagtcatggctcactgcagccttaacttcccatgcttaagcaatcctcccacctcagcctcccgagtagctgggactataggcatgctttaccacacctggctaattttttaattttagtagagacgagggcttgccatgttgcttaggctggttttgaacccgtggtctcaagcaatccttccgccccagccttccaaggtctagacagttctcacaaaacccttcttgttatccttagctttattaacaagccttgcctcattatgggctgttacttttcttttaggttagagccaccactcttttttttaactatgccttctgttttttgtacgtgtttgtgagtggccttttaacatctgtactcaagaatgcttttcgattgtgctagtctcttcagattgttccctttttaaatttgaaattagccagatgtggtggcttacacctgtaatcccagcattttgggaggctgaggtaggcagatcgcttgaactgaggagttaagagaccagcttgggcaacatggtgaaacctcgtctctacaaaaaatacagaaattagccaagtgtggtggtccacccctgtagtcccaactactcaggaggctgaggcaggaggatcacttgcacctgggaggtcaagactgcagtgagccatgtcctcaccactgtaatccagcctgagttacagagtgagaccttgtctcaaagaaaaaaaaatgaaattggaataatttataattaattgcataattcatattatctcacttttaaggatttctttaaaaaacaccagcatctggctgggtgtggtggctcacacctgttaatcccagcactttgggaggctgagatgggaggattgcttgagcccaggagtttgaaattacagtggactatgattgccccactgcactccagccttggttacagagggagaccctgtttctatttttctttttttgaaatttttggctgggtgtggtggctcatgcctataatcccagtactttgggaggctgaggcgggcggatcacaaggtcaggagatcgagaccattctggctaacacggtgaaaccccgtctctattaaaaatacaaaaaattagccgggcgtggtggcgggcgcctgtagtcccagctactcgggaggctgaggcaggagaatggcgtgaaccctggtggcagagcttgcagtgagccaagatcgcgcccctgcactccagcctgggtgacagagcaagactctgtctcaaaaaaaaaaaaaaaaaaatttccccttgtctctaaaggaaaaaacaaaaacaaaaattaaaacaaaaaagcaataccaccatctgtcttctctttagaagttcatattatgatattagtctgggcgtggtggttcatgcctgtaatcccagcactttgggaggctgaggtgagcagatcacgaaatcaggagttcaagaccaacctggccaacatggcaaaaccctatctctattaaaagtgcaaaaattagctgggcatggtggtgggcgcctgtaatcccagctacttgggaggctgaggcaggagaatagcttgaacctgggaggtggaggttgcagtgagccgagatcgtcccattgcactctagcctgggtgacaagagtgagattccatctcaaaaaaaaaaaaagaagaagtttatattatgatattttaatttagttaaatctgcattttgaaagcactgtaatacagtggttataatgtggattctctagagtcagaaaacctgtgttctgattcaggctctaccacttttcttgttctgggactttggacaagttacctaacagttcgaaatctgttttctcaactgtaatatagggataataatagtatcaatctttaagggctattgagagaatttgataatctatctaaatcttagtctctgacttgtgattagaactctgtacccagtaggggccaggcatggtggcttacacctgtaatcccagcactttgggaggctgaggcaagtggatcacttgagatcaggagttcgacaatagcctggctaatatggtgaaaccccatctctgctaaaaatacaaaaattagccgggtgtggtggcgcatgcctgtaatcccagctactcaggaggctgaggcaggagaattgcttgaacccaggaggccgaggttgcagtgagccaagattgagtcactgcactccagcctgggtgacagagcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataggcgtgaaccattgcacctggccttttttttttttttttgagatagagtctcactcagtcacccaggctggactgcagtggtatgatcttggccctctgcagccttggcatcctaggctcaagcactcctcccacctcagccccccgagtagctgggaccacaggcatgtgccaccatgcatggctaatttttaaatttttttgtagagatggggtctcaccatgttgcccaggctggtctctaactcctgggctcaagcagtcttcccaccttggccttccaaagtgctgggattacagatgtgagccaccactcccagcctgaacacatatttctagtttaaatgtatggttttgtataaaatggattagagagattgcattgatacagactaaagggaagcaacagaggtcatatgattctaagaaattctatctttgttgaaagaagttttagtgtgaaatgaccagagtaaagaaaaaagagaatgaacattcatccattcagagactaccaagtgctaggtatggtagtgggtgctcttccatccgtttctcattcaaggtgaggaaattgtggctcagagaggttaaatgacttgcccaaataacacacagtagtgaataagaagatggattggttctttataatccccaaaaccacactaaactttctcctttgttgctaggtaactgatatttcaggagacagaagttttttgtttatttcaagagcaggtttcttacaggtctggctcttcactctcctaggttgtcttgggatataggatttaaggtactacctgtggaactgagagtgccagcacattattcttgtcctcttgagtggctagttccttgcccaaagctcatctcaaaattatagctgctcttgggagtttgatgtaacatggaggctatgttgttggttttattctctctgataccattatttcaacactaatgaattgtgtccagggtgtaccctgcttaattgacagctttctcagctgttttatagcaggttctctagtatctttatcttcatggccatagtcaagaaacttgtttttatttatttaaacatggttgtgggagaagtagataattatagtatgctttttgactatgcaggaacaaatcttacccttgaggccaggcacggtggctcatgcctgtaattccagcactttgggaggctgaggcaggtggatttcttgagcccaggagttggagatcagcctgggctacatggtgaaaccccatctctactaaaaaatgcaaaaattagccaggcatggtgacgtgtgcatgtagtctcagctacttggaaaggctgaggcaggaggatcaattgagcccaggaggtcgaggctgcagtgagccatgattgctccactccatcctcggtgacaaagcaacaacctgtctcaaaaaagcaaaacaaaacaaatcttacccttacctgaaaaactggttaaggagggttgtaagtggtaatgttagtttctccatatatcaattcagaccttatcccaaaggaagaccagagctgtttgaactccagctcttccttagctgccaggtgttaacaacttgtgtttcataagcatagatagattcaaaccattgtcctggagttaaaatattttctaagctgtgactcatcttttggctcattctttctttcactaggaaataaactgagttttaattttgagaatttcaattatcccttctgaagactgtgttgctgattaaagttgctgggacttgtttttctggtaaccagcagagctacaaattactttgtactcagtggtcatgttaaacctatgtgtaagcagagggagaaatctgattaactgtctaaaggaaggttgttgaagatgaggccattctttctgactccttttagaggttcatctcttccaccagagggatgggtgtgcaggagggtgaatctgaggctgaacagagcaggtgctacgcatgtgtatttgtatctgtaaatatcacatcactgtttatagtacactggactctacatgcaaggcctggtcaggccaaaccaggaggaattgttcctgtgcttaaagccaagaataacatcctgaccagcagggggacagaggtcagctcaaggcaacagctcttgggagctacagaacattaaggaccttggaggaactgagcttaataaaaaggaaggcaagatgtactttgaaggaagtgtgtgaaacctgcatgcctttctcttattaggacatggtttatttatgaaaaatgaaaagttatctttttttttttttgagacagagtctcgcactgtctcctgggctggaatgcagtggcacgatcttggatcactgcaacctctgcctcctgggttcaagcgattctactgcctcagcctcccacgtagctgggattacaggcacctgccaccacaccctgttaattgtttgtattttcagtagagacagggtttcattcactatgttggccaggctggtctcgaacccctgacctcatgatctgcccaccttggcttcccaaagtgctgggtttacaggggcgagccactgtgcccagccaaaaaatgaaaatttatcttaacagatggatatgtgatgagttcatatcacctcttggtcatttacattttccacttctacttatacattgatttatccgttgattattttttattagaaattgtatacccagctaagtagcaggaaaaatatgttctattattctggtgttttattctataagcaacatcagagaggcccactagagaactgtatttaaaggataataggttaattaaaaaacaggtaccatgtactcggccgggggtggtggctcacgcctgtaatcccagcatttgggaggccgaggcaggtggatcacgaggtgaggagatcgagaccatcccagctaacatggtgaaaccctgtctctattaaaaatacaaaaaaattagccgggtgtggtggcgggagcctgaagcaggagaatggcgtgaacccgggaggtggagcttgccaggagccaagattgcgccactgtactccagcctgggcgacagagcgagattctgtctcaaaagaaaaaaaaaaagcagaaaaaacaaaaaacaaaaacaggtaccatgtctcctggggaatttactgactggctagagttttatttctgggatctttctgtgctcacttctttttccttccatctttcctcattttgatgctggccactcactccacagaggcaattcaaactattttctgaaggagcattctaagtttgtcctgttgtcttctctgggactcatttctctggcgtggcttcagctggttccaggccagaatgatcttctgaaagcttttcttcatggcctttatttcttggctcttttcatgcactttgcctgattggttttgctggttctttccttctccaatggtgtaagctatgttgccttaatcgtaaggctctaaagctcaggtgcagcctcaggccgtttagactttcctggggtttataaagtacttttgtcctttcctagaaattgggggatgaatcagatgctctgttatgaggtattgctgactctcctgggattttagtttgccagttgtttaaatagtgtgtagcaatttgaattgtatttgtaaggtaggacttgttgccaagactccgaagtaggtcattgctattatgctttttctctttatttttcttatatatattatatataatataaaatatacattataataataaaaatatatattataatatataatataatatataataatatataatatatcgtaatatataatatatcataatatataatatattataatatatattatattatattatgatatattataatatattctattatatattatattataataattataataatatattatattatatatattatataataatatatattatatatattataatataataatatatataattagtatattatataaataatatatatttatagtatattataaatataataatatatatttatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtttctacctttttgtttgtctttccctgctccctgtagcaaactgggttcagacttgcttggagaagggatgatagttttcacttgtttgttttttgactccataaatatgctctcttcttactaattattctttctttctttgtcaaacaggctaccaagcagtttctcgaagagattaacaagtggacagttcagtacaatgtttccccgctgtcttggaatgtggctgtcaagttcctcatggcaaggaagtttgatgtgctccgtgccatagaattgttccactcctacagagtatgtggctcaggggtagaccagacctgtggcagttgggttaagtgttgctgttgtccctgtcatgctcgacacacacattggttctctaagtgttcctcctcactttcataaaaaatggatccatatccaggagcccttgtgagagctgaagctgggcaaggcagctactggaaggcactacttttgtacctaagttttgatcgtagaccaggatgccacatctaatgattgagacggaggaagtagcctgacagcatcctggtggcaggataggggttcacccttcctagagttttaatcctagctcttttcattggcctctggccacatgaaaatcttggttttcaggttgtctaaggcttttagaaacttgccattcagatgaatgatgagcttagtgggcagttcaggaagggaagttttaacactggaaaagaagagcaactgtgtattagctaggtccattatcttaaagtatctttatgcaaatgtagcggcatcaggattttactttgttttgatttttgttttttgagggggcatagactttggttttgtgcttgtttgctttctcagttagtagtgtctttgataaaacactatacagcatgttactttggggtcagaatccttctaaagaaatacaaaatctccctaaaaaaaaaaattgggataacaagcactaggattagcttaactgaagtttggttacatctgtcttgtggaccagctcattcaatattcattcatttactcaacagatacttattttatacttactgtgttccaggtgcagagattactatttagaaagagagactagggctgggtgcggtggctcatgcctgtaatctcagcactttgggaggccaaggcaggtggatcacttgaggtcaggagtttgagaccagcctgaacaaaatggcaaaaccgcatctctactaaaactacaaaaattagctgggtgtagtggcacctgtattcccagctactcgggaggctgaggagggacaatcacttgaaccaaggaggtggaggttgcagtgagccgagatcacaccattgcattccagtctgggcaacagagtgagactgtttaaaaaaaaaaaaaagaaagagaaaataaacaaagagttgtagaaatgttatgataaggcagcactggattctgtggaagcacttttttttttgagacagagtcttgctgtgtctcccagactgaagtgaagtggcatgatctcagctcactgcagatctctgcctcctgagctcaagtgatcctcccacctcaccttagcctcccgagtagctgggaccacaggcatgcaccaccatacctggctaattttttgtatttttagtaggaggacggggttttgctatgttgcccaggctggtctcgaactcctgagctcaagtgatccacgcacctcggcctcccaaagtactgggattacaggcatgagccaccgtgcccagcctaagaggtttaaaacaagcggttgatgaaataagacaaaccaagataatatttttttgttatcggtatataaaggtagagaatgtctccggaaaaaggaagtgtaggtggtcaaccttgtcatttaagaggagaactgaagaggctgggcgcggtggctcatgcctgtaatcccagcactttgggaggccgaggcgggtggatcgcttcagcccaggagttggagaccagcctgggcaacatggcaaaaccccgtctctactaaaaacacaaaaattagccaggcatggtggcacgtgcctgtaatcccagctactcaggaggctgaggcaagagaatctcttggacgtggaggttgcagtgagccaagatcatgccactgcactccagcctcagcaacagtgtgagacttggtttcaattaaaaaaaaaaaaagaatctggccatcagggtgaggaaaatgaagtcatggtagctgctgttggagacaatatcaggtggagagaaggctcctatttaaacataggagaggcctaaacctagaaaatatgtgagaacgtaggcatccagacatttttgaggtccatattttagtgtcctggtaccatgtcagtgctgctgcgtgtttaagaaccttgatcctgcacctgaatgtaacatactggttactcttcagggttagggttcttactgagtcagagaaaaataccctacctgaggggctgataaagtagctttggacaggaattccgaaaatgcttgactggcttggaggcaggttacaaagaaattcataattcatttagttgacttcattattcatttagctgaattctttttttttttttttttttttttttgaggcagagtctcattttgtcacccaggctggagtgcagtggtgctgtcttggcttactgcaacctccaccttctgggttcaagcgattctcctgcctcagcctcctgagtagctgggattatgggcgcgcaccaccatgccaggctaatttttgtatttttagccgagacaaggtttcaccatgttggccaggctgctctcgaactcctgacctcaggtgacctgcccgccttggcctctcaaagtggtgggattacaggcgtgggccactgcgcccggcccatttaattgaattctaattcaactaaatgaagtagaattggttatgaaattagttacaaaatttatttagttatgaaatttataattcattcattcattgataaccaccttatctctgagatttggtggttacatggtgctgtcctggatatacagtattttcatattaatacattttgctgtgctgcctttttaggaaactcgaaggaaggaaggcattgtaaagctgaaacctcatgaggaacctcttcgttctgagatcctcagtggaaaattcaccatcttagtgagtgtttagggacctatcttgtagggccttattacttccttttttaactggtgtcctgtttggactttgttttttttttttttttttaattttattattattatactttaagttttagggtacatgtgcacaacgtgcaggtttgttacatatgtatacatgtgccttgttggtgtgctgcacccattaactcgtcatttagcattaggtatatctcttaatgctatccctcctccatccccccctgtttggactttgttcctatataccttatcctgaatctagagagtctccacagttaggagcagatgtgaaacagccatgcagtttggtataaaattattttagtaacaattgaattactaatagtttctagtaattagagttactaatgataattgaataattgaattatggaaaatcagttgtacagtagacttagaaaagtttcttcagttggtccattaaggttagtcatggtctttgggagagatatgcaatgtgtcagacacccatgcttccatatttaacgcaagctctccacttagttgagacctcagcctttcaagtaaacatacaatggcacttttaaggcagagggtggaaatcatggtcctgttccctggttctctcctgctgcttgtttcttttgccattctgccagggaagttagctaggaagccagtgcacagccatcctttgatctgtctgtagttgaagagcaaagagaatgtgttttttttttcttaccacagaaatatggtccagggagtcctgggagaatcaggcaaaggatgatattaacactcttccctttggacagcaattggtgaagtcagggaattattgttagcatctgttttctacatgtatcaaacccttatccagtatataagtcttagtaattgctgtgattttctatttgatttttttaatgtttcttgttttatttgctttagaatgttcgggacccaacaggagcctccattgccctctttactgccaggttgcatcatccccacaagtcagtccaacatgtggtacttcaggctctgttttacttgctagacagagctgtggataggtaagcattgagattattttttaggtattctacatgcaggtaggaaagtgacagttttttacttgattaaattcagcagtgccttcgccattctcctaggatgtgccctgggcaatgctatgaatagaaaacaatccatgtcctttagaactcggcatgtttgcaggcactatcaagatggtgggcgttctctttaccaccttggctctatgtcaggaaaacagaagctgagaaagtcaattatcggcaatcttcagtgtatggaaaactacttattggaaaagaatgagggggagatgacctgtgctggttctttttgctcatatcagaacctctaaggcctcagtttctttgtctgcataacaggaataatgccgtttagttcagaggattttgagactcaacattcaggggagggctgggtgcagtggctcacacctgtaatcccagcactttgggaggctgaagcaggtggattgcttgaagccaggagttgagaccagcctggacaacatggtgaaaccctgtctctgataaaaaatacaaaaaattagctgggtgtggtagcgtgcacctttagtcccagcttcttgggggaggtgggggaggttgctgaggtgggaggatcacttgagcccagaatggtgaagctgtagtgagccatgatcacgccactgcattccagcctgggtgacacagcaagacctgtctcaaaaaaaaccccacaaaaaagcccacacaaaacaaacaacaacaataaaaaaacattcagggagaagcccagaagtataaagttaagcaaaaaccatccttaataaaaagaggtgcataagcataaagaaccagctcaggtcatcactctcttcctgctaaggtaattggtattgttacaattcaattgacaattaaactcaagccccaagaagttttttacagtcatcatatgttagtccagctggttctaagatcctggtttcttcactcttgggcagagttatttctgtcctcccatgctgttgttctgctattcctttttccctggtgcttgtaatttacagtttcttactgctctcaacatctttggctggtcctccggattagaagtgctatattgaggccaggcgcattgattcatgcctgtaatcctagcactttggttggctgagatgggcagattgtctgagcccgggagtttgagaccagccctgggcaacatgatgaatccactcgcttcttgagggcaggaaactttctttttaacatccgaatctctgtaggttgagagagaatggtatcgtgaacatccacatatccatcatccgtcttcttcaaagtgatctgtaacagtcttgtttcattggtagcccctcatggatctcctatcctcagtttctttcttttttgttttttgagactagggcttggtttgtcacccaggctggagtgcagtagcatgattgtagctcactgcagtcttgaactcctggacttaagcaatcctcccatctcggcctcccaaaatgctgggattacaagcataagccattgcatctggcttctccgtttttttaaaaccaatgtcagggactgtattttaaacttcttggtgttttctgtaacatgtagctcaagaattaaaaaaatattttttttattttttttttcctttgagacggagtctcggtctgtcccccaggctggagtgcagtggcgctatctcagctcgctgcaagctccgactcccgggttcgtgccattctcctgcctcagcctcccgagtagctgggactacaggcgcctgccaccacgcccgttttttttttttttttttgtatttttagtagagatggggtttcaccttgttagccaggatggtctcgatcacctgagctcgtgatccacccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcagtttggtctgggaataggcttacttttttttttttttttttcccctgaaatggagtctcgctctgttgcccaggctggagtgcagtggtgcaatctcgattcactgcaacctctgcctcttgggctcaggcaattctcctgcctcagcctcccaagtagttgggattacaggcatgtgccaccatacccagctaattttgtatttttagtagaaatggggcttcaccatattggccaggctggtctcaaactgctgacctcaggtgatccacctgcttcagcctcccaaagtgctgggattataggtgtgagccaccacacccagccatggcttactattaatacctgttaatctacttttttttctttcttttccctctttttttttttttttttaaatagagtcagggtcttgccatgttgcccagactggtcttgaactcctgggttcaagcgatccagctgccttggcctcccaaagtgctaggattacaggcgtgagccactgcgcccagtcttactttttcttaagacaagatctcacgctgtctacccaggctggagtgcagtggcatgacctccctgtagcctcgacctcctgggctacaagtgaccctcccacctgagcctcccaagtagctgagactataggtcactacatgatgaggtattgtcatgttgcccagcctggtctcaaattcctgggcttaagctatccaccatccttagcctcccaaagtactgagactacagtcatgaaccactatgtcagccttaatctactttttaggaatgctttccaaaggccatttatgggtttgttctcttcctccatggggtcataagagacaaatttactatcaatgagcttagaggcagttttgttctacacagtttttcacaggtctgaaatattttcttagagatgggcttccagtctactgaattacaattcagtgaccatttatttttaagggctgtgctagggattgttgggcgtaacgagtggaacaacaagttcttgtcctttaggagagaatcagatggctatacagagtttattaaggccacaagaaaaatccacagaaagatttatggggctttaagggaaaaaacaattggtagcatgtttgattacagttatcagggaaactttcatggaagaggaaactttggggttgagtacggaatatgttatatgatttgggtaggtagattcagaggggtgggagaaaacagttcagattttgataacttagttgctgtagagcattctcaacctacgagtttggcatttggtacatctggataaatctgccttaataaacatagcagataccaaagataagagatctttttgtaagaccagtgtgcagtcaggcagttgttttgatcctagatgtgtctcatactctcaggttttgttttggcattaggctttcaacctgcctcatccatctgcttacttacaaatgtttttgttcaatggttgatttacagctttgaaactcagaggaatggactggtgtttatctatgacatgtgtggttctaattatgccaactttgagctggatcttggcaagaaagtcctaaacctgctgaaggtaaggctatggagggccctctcaagtttccttcaatgcttgggatatatatatttttttaattctttgggaaaagatttaggaaagatgcaaacttcagacattatgttcaatgtaaaggtcatctgtaaatgatgactactctctgcttccttagaacaagaaatgatcttaaaagtgaaatgggaggaattcgggtaaaaaatgcacaggaacggccaggcgccatggctcatgcctgtaatcccagcactttgggaggccgaggtgggtggatcatgaggtcaagagatcaagaccatcctggccaacatggtgaaaccctgtctctactaaaaacacaaaaattagctgggtgtggtggcgcgtgcctatagtcccaggtactcgggaggctgaggcaggagaatcgctcgaacctgggaggcagaggttgcagtgagccgggattgtgccactgcactccagcctggcgacagagcgagactgtgtctcaaaaaaaaaaaaaaaaaaaaaagcacaggaacattctgagtcataaaagtgggatgggctgggtgccatgactcacgcctgtaatcccagcactttgggaatctgaggcatacttatgtgtataaggtgtgtatgaaacatacataaatttaggccaggcatggtggcttacaccagtaatctcagcactttgggaggctgaggcggacggatcacgaggtcaggagatcaagaccatcttggctaacatggtgaaaccctgtctctactaaaaatacaaaaaaaaaaaaaaattagccgggcctggtggcagacgcctgtagtcccagctacttgggaggctgaggcaggagaatggtgtgaagccgggaggtggagcttgcagtgagccaagatcgtgccactgcactccagcctgggcgacacagtgagacttcgtctcaaaaaaaaaaaaaaaaaagaagaaacatacataaatttcctgcttagacttgggtcccatccccaagatatctaattatgtatatgcagatattctaaaatctgaaaaaaattcaaaatctgaaacacttctagtcccaagcattttggataaggaatacccaacctgtgttatgaatggtgctgttatgaacattcttaaacatgttttctggtgcatatgtgtaagagggtctctaggggagtgtttctcaaccttttttcattgttgcctcactaaggagcctttttaaatattttttcccctaataattcctcttctaatgaaattttaataccataaacatactgcatatctctatgtactctttaaaatttattttttattttattttgttttattttattttatttttatgttttttgagatggagtcttgctcttgtcgcccaggctggagtgcggtggcgcgatgtcggctcactgcaacctccacctcccggttcaaatgattctcctgcctcagcctcctgaatagctgggattataggcgcctgccaccccgcccggccaatttttgtacttttggtagagacggggtttctccacgttggccaggctggtctcaaactcctgacctggggtgatccacccgcctcggcctcccaaagtgctgggattacaggcgtgagccactgcgcctggccttattttttaaatagagacagagtctcgctatgttgcccaggctggtcttgaattcctgggctcaagcagtaccgcctccttggcctcccaaagtgttgggattataggtgttggccactgtgcctggcctctttatgtactctgtatacataaaaagtgtaagatttctttttttttttttttttttttgagacggagtctcgcactgtcgcccaggctagagtgcagtggcacgatctcggctcactgcaagctccgcctcccgggttcacgccgttctcctgcctcagcctccagagtagttgggactacggcgcccaccaccacgcccggctaatttttttgtattttaagtagagacggggtttcaccatgttagccaagatggtctcgatctcctcaccttgtgaactgcccgcctcagcctcccaaagtgctgggattacaggcgtgagccactgcacctggcccgatttcttttttttattctggctcacctcaccctgctctcctactaattttacccctttggtgaggtgatatctcccccattgagaatgcatgctctagggtatacacttaggagtagattgttgggtcctaaagtctgtgaagatttaactttataagacaatgtcaaactgtgtttcaaagcagtcgtacccccttgccatgtgtgaagatttccattgatctacatcctctccagcacttactaatgtcagacttcttaatttttttcccaatcaaatggatatgagatggtatcttgtggtatagcttgcgtttcttttattagtgaaattaactatatcttcatatattcgttagctatatattttttcttcttctgtgaaatgtctatttatgatttgtccatttagaaattaatagtttttaatatattattctaatccatgaagatacatatatacacacacacatataatgtgtgcgcacagtaaactgtctcttaatttatagcttgttttttcactttttatgaagctctttgactaacagaagttccttttttttaagaccaggtcttgctctgttgccaaggctgagtgcagtggcacgatcttggctcactgcaacctccacctcctgggttcaagcagttctcatgcctcaacctcccaagtagctagaattacaggcatgtgccaccacacccaactgatttttgtatcttttgtagagatggagtttcaccatggtgcctaggctggtctcaagctcctgagctcaagcaatccagccaccttggcctcccaaagtgctgggattacaggcgtgaaccactgtgcccgacccacagcgcttagtttcatgcagtttttcaatattccggcccttttcatgggtgtggttaccatgcaacactggcggtctaactaggaagaaatcattcctgagaaatccaaaagaaaaaaaaaaaaagaggaattgtagctagtatcttctagcctattctttttgccacttttctttctttttttttttttttttgagacagagtgtttcactcttttgcccaggatgcagtgcagtggtgctatctcggctcactgcaacctccgcctcccaggttcaagcgattctcctgccttaatttcccaagtagttgggattacaggtgctcgtcaccacacctagctaatttttgtatttttagtggagatggggttttgccatgttggccaggctagactctaactcctgacctcaggtgatccactagccttggcttcccagagtgctaggattaaagacgtgagccaccgtgcccagccctttttgccactttcaaaagactgattcttttttgttgtttgtttgttttgagatggagtctctctctgtcccccaggctgaagcgcaatggcctgatctcagctcactgcagcctccgcctcccgggttcaagtgattctcctgcctcagcctcccaagcagctgggattacaggtgctcatcaccacactcggctaatttttgtatttttagtagcaatggggtttcaccatgttggccaggctggtctcgaactcctgacctcaagtgatccatccaccttggcctctcaaagtcctgggattacaggtgtgatccaccacgcccagcctcaaaagactgattctcaatctgacatgtcactctgttctcttcagttaccctttagttctactgatttggagaaaccccagcactcctctatggagaatatacagcatctagaacaaacttctccaaaggcctcttcactgaagtgtgataaactactttcatcttttccttcaaagatgcaacaatttatttcaggacctaaatgtccaaggtccttttaccagcaaatcaaaaaccattctaggaaaacacctgttatttccacaaaatgataaataaaaagtagaagctattacgtctcttttttcagagcaaagaactgcagacctgggcctagtctatttacatgactgtctgggggtacctgctgcagtcaccagggatgggtggcagcttggtcagcagcgaatagcctgcagcattctcctgtggttataaaggatttacccctcaatcccaaacctttcctcaagggattaacagaaaagccagtgacagtgaaacttaagtggcgaatggattacaaaggctaactggtatctgtagatgaaccagatctacagatgtatctataagaacatgtagcttgcaaatacagaagaatacatagttggggtattgtctggacatctggatgaagttttactaaagtataataatgtcctttgtctcagaggtgtggaagaggaagaggatggggaaatgagagaatagcgtcttttctgggggattttaaaaatatatatttctagacaataaagatttgtttgtttttcaaataaataaatgactgtatagcaccctcatatactgtcagttcagtaagtcgttaacaccttttggaaggcatctggcattataaatccttaaaaatgcacataccctttgatcagttgtatttctgagattatatgctaaggaaacaatcaggaaaatataaaaagagtatttactgcacatttattttagataattaaaaataataccttaagctggctccagtgacttaaatctataatctcagccctttgggaggctgaggtgggagaattgcctaaggccaggagttcaggaccagtctaggccacgtagcaagaccctgactgtacaaaatttagctgcatgtggtggtgtgtgcctatcatcccagctacccaggaggctgaggcaggaggatcacttgagcccaggatatgaggctgcagtgagctatgatcatatgattgcattccagcccagttgataaaaccctgtcttaaaaaaaaaaaaagaatattcataatctttagccaaataatcccagtcttagaaacagcttcttaaaataatttaaaaggaggccgggtacagtggctcatgcctgtaatcccagcactttgaaaggccaagatgggcggatcacttgaggccaggagttcgagaccagcctggccaacatggtgaaaacccatctctgctaaaaatacaaaaaagttagccaggcgtgatggcacacgcccgtaatcccagctactcgggaggctgaagcaggagaattggttgaacccttgagcagatatcgtgccactacactccagcttgggtgaccaagtgagactaaaaaaaaaaaaatattaaagtgagtctcaaaaaaaaaattaaaaggaaaagataaaatgagcatatcaggattatttaggcctgaaaacaaactgaataatcagaatgatggttacatggttaattaaattacctatgtcatatttattccccaggatattgtgactttgttaaaactgacaaatagaaagtctaagttggggaaagacgggactttttaatatgtaaaggtggaaaacaaaacagctacccatatagaaaaaaatgtcagattcctacatctcataccatgttcaaaaatcaacttcagataggttaaagtcttaaatagcaaaaacaggccaggcatggaggctcacacctggaatcccaacactgggaggccaaggcaggcagattgcttgaacccagtagtttgaaaccagcctgggcaacacgatgaaaccatttgtatttttattctacaaaaatacaaaattagacaggcatggtggcacatgctacttgcgaggctgaggtaggaggatcacttgagcctgggtggtcaaggctacagtgagccatgatggtgccatcgtactccagcctgggcaacagagtgagaacttgtctcaaaaaaaaaggacaaaaacaaaagtttaaatttttaaaagaaaatagctcctcaaatgtggacaagtggaaacaatgtggaaaatagctcctcaaatctggacaagtggaaacaaccaatgtgtacaagtggaaacaacccaaatgtccatcaacggattaatagataagaaaaatgtggtatatttatgaggaaatattattcagccttagaaagcaatgtaattctgagacatgctacaatatggattaaccttgaaaacattatgctaagtaggataaacaagacaaaaaaggacaaatatagtaggattccaataatacgaggacctaaaataggcaaattcatagagacagaaagtagaaccaaggttactagggactagggggagaagggaatagggagatgttgtttaatgggtacagggtttttgtttgtgatgatgaaatagttctgaaaatgaatagtggtgatggctgcattgtgaacatacttaacgccaataattgtacacttaaaatggtttaaaaggtcaattttgttgtgtatattttacaataaaaaaccaaattagaaaaattaatacacattggtggaatcggtggtacagcagtaaaaaaaaaaaaaagtactttttctgacattaaaatagaaaaggatttaagacacacaacacactaaccagaaaagaaaacagtaatacatttaaccatttgaaaattaagaacttcacgccaggagcagtggctcaatgcctataatcccagcactctgggatgccaaggtaggaggatcacttgagatcaggagttcgaaaccagccggccaacatggtgaaaccctgtctctactaaaaatacaaaaattagccaagtgtagtggcgcagtcccagttacttgggagcctgaggtgggaggatcatttgagcctgggaggtacaggactcagtgagtggcgattgtgccactgcactccagcctgggcaacagcaagatcctgtctcaaaaacaatacaaaacaaaaacagagcagccaagcaaacaaaaaaactaagcactgtggattaggaatgaatgattttttcatctttatatcttgtgtggatgaggatatctcctttttttagatctcatttgccatagtgcacattagattattgattggtaaatacatagatgaatgaatagattaaaaaaagattatgcatacatcagactgaatgaaaagttatgaaagagaaatttttaaaatttttaaatttttatttattattgttaaaattttgagatggagtttcgctcttgtcgcccaggctggagtgcagtggtgcgatcttggcttactgcaacctccacttcctgggttcaagcgattctcctgccttagcctcccgagtagcagggattacaggcacatgccaccatgcccggctaatctttgtatttttagtagagacggggtttcaccatgttggccaggctggtctcaaactcctgacatcaagtgatctgcccgcctcagcttccagaagtgctgggattacaggcgtgagccactgtgcccagccatattattttttttgagacagagtttcactcttgttgcccagggtaaagtgcaatggcttgatctcaactcactgcagcctctgcttcctgggttcaagtgattctcctacctcagccttctgagtagttgggattacaggtgtctgccaccgtgcctggctaattttgtatttttagtagtgatgggttttaccatgttggccaggctggtcttgaactcccaacctctggtgatccacccacctcggcctcccataatgctgggattataggcatgagccaccgcacctggtcgagaaatgtttaatgttcagtttattcatgatctcatttttccttcaagttttaataacataacttttttaagaggcatatatgtatgctgatgtgtggtatgtgtaggatatctgttgagatgagaagtcagaatagtttttgatccataaagcttacggtagacaagaacttaacattgttatttttaaaggtaaatcagcttctaatttcttcagtttgtttaaccacttttcctctagctgctgagatcaaacctgaattaggctgtagactccccctgctgggtaagaatggggagaagagcagaaaacctaaacttgggcttgaagagtcacaggttccattacacttaaatcctcatgtgttttctccacagggagcatttccagctcgtttgaagaaggtgctgattgtgggggcacccatatggttccgagtgccctattccatcatcagtctcctcctgaaggacaaagtccgggagagggtaaggcaagcttgcccttttttatctggaggtgaatagatacagtgaattcctgccaattaattttctaccttcaaaaaatcctcctggcgtgtcttctagagcctgttctgcttctgttagtgcattcacttatattctctacctgatgcattagtcagttcaatacagactgcctctcttactgtcctacgagcttcttgaagttcaaaactaaacacagtttatctggttctcactttctatagcaccttgcataagatagtactgaaggaacgtgtcctggaggtaacttagggatagctgctacttccaaaatttatcctagtgctgcataggcctttaatatttaacagcttgtaatataactgcattagttgaactggcattagaatttgttcaactggaaacatcattcaatcccttgaccaccagggttgtggaggaaagtttttcgttatgtctctttctacatttattcctggcatttttttttctcagaataccttgttgcttcccaatttcaaaagcgttcaaaattactttaattctgggccaagtgtaatggctcatgcttataatactaacactttgggagtccgaggccaaggcgggaagatcgcttgaggccaggagtttgagaccagcctaggcaacacagtgagaccccgccgccacaataaaaccagaaactttaattctgttataatctcctgcgtgttccatgattaaaagatttatggtctcagttactgattgcagcaattaaaagacaggacatgaaagtgaaaacatttggttctgtggaagctgcttagagacctaatgacgcagagtaggagagagcttttctttttttttttttttttttttttttgagagtgtctcactctgttgcctaggctggagtgcagtggcacgatcttggctcactgcagccccgcctcctgagttcaagcgattcttctgcctcagcctcctgagtagctgggagtacaggcgcacgctaccacacccagctaatttttgtatttttagtagagacggtgtttcaccatattggccaggctggtctcgaactcctgacctcatgatccgcccacctcagcctcccaaagtgctgggattacaagcgtgagccaccttttttgagacggagtctcgctctgtctcccaggctggagtgcagtgaagcgatctcggctcactgcaagctccgcctcccaggttcaaaccattctcctgcctcagcctccctagtagctgggactacaggcgtgtgctgtcacgcccggctaattttttgtgtttttagtagagacggagtttcactgtgttagccaggatggtcttgatcttctgacctcgtgatccacccacctcagcctcccaaaagtgctgggattacaggcataagccaccgtgcccagccaggagagatcttttctttctttttttttttttttttttgcgacagagttttgctgttgtcgctgaggctagagtgcaatggcatgatcttggctcactgcaacctccgtcccccgggttcaagtgattctcctgcctcagcctcccaagtagctgggattacaggctcctgccaacatgcccagctaattcttgtatttttttagtagagatggggtttcaccatgttggacaggctggtctcaaactcctgacctcaggtgatccacctgcctcagcctcccaaagtgctgggattataggcatgagccaccgtgccagctggagagatcttttctaaggtaactctttgagaggaatccataggcaagttcttgcacttgaattataggaattatacatgcatgtataaactcaaaatatattaagcactttttgtagtcgaagcactggttcctgataattaaaaattaagtgagacagtctaccctcaaggagctcatggtcttgatagggaacacagagatacacataggaggactttggctctgcaggaacgcagaggagcatatggcctcaggcagtcaggaaagacttcacagaagaggtgagctgtgctggtccatgaagaggcagaggaggaaaggaaggcattccaagaagaggcgacagcaaaagagatgagcttttaggaggaagagaatccccattccacagagatcctaaggagaaccagttaagctaattagttccagcatggctatgtccaagcagagagcagaattaagttttatggttactacaaaaaattagctgggcgtggttgtgtgcatctgtattcccagctacttgaggggctgaggtggaaggatcacttgagcccaggaggttgaggctgcagtgagccttcatcacgccactacactccaggctgggtgaaaaagtgagaccctgtctcaaaaaaaaagtgttatctcacatttttcctgggctaccctgcctctgggtgtcttgctttcatagaatcctatctttgtgaacagttataccaagctgagtaaaatacaagctaacaggccttagaattggttgtctgagtatggggttgacaaaaataactactacctatgcattcttagtggccaaaaaaagagtaccagcatgcagcgatgctgggaagccttgttaataatataaagcttttgttcactacatcgtcctttcagaagatgtataacagtgtccctaattccaggagtgaattttatatacattctgggagttcacacttttatctggcaaattcataggacttaaatctcaggcagatgaaatgtagtctactacttttacaagtataccttgtatttcaagaaaatcttatcccatcctccaaacctgatataaatacatttattctttgtcactctatatgcctttccctcctcccacatactcacatggttctttctaaccttccagattcaaatattaaagacatctgaggtcacgcagcatctgcccaggggagtgtcttccagaaaacctgggtgggtacgtcaaaattgatctcgccacttggaatttccagttcctaccccaggtgaacggccacccagatcccttcgatgagatcatcctgttctccctccctcctgccttagactgggactcagtacatgttccaggtccccatgctatgaccatccaagagttggtggactatgttaatgccaggcaaaagcaaggaatctatgaggaatatgaagacattcgtcgtgagaaccctgttggcactttccactgttccatgtaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcagaggagctcctcacatcccagacggggcggcggggccagaggcgctccccacatctcagacgatgggcggccgggcaagagatgctcctcacttcccagatgggatggctgccgggaagaggcgctcctcacttcctagatgggatggcggccgggcagagacgctcctcactttccagactgggcagccaggcagaggggctcctcacgtcccagacgatgggcggccaggcagagacgctcctcacttcccagacggggtggtggccgggcagaggctgcaatctcggcactttgggaggccaaggcaggcggctgggagatggaggttgtagtgagctgagatcacgccactgcactccagcctgggcaccattgggtgcttcttgctaacatcctatgctctgaaatttctgaaggtctttggtaccaacaggataaccctgttggacatatttttggatatttttctgaaatgcaagttttttttaaaaaaagtaggttcaaaataggctactctctattccagtactcagtgtgagtgctggtctgttcatttgggcagtttctccccataacatttatggtataacattacttcttgaggaggggtatgtggtacacttaaaataatccacagtcagagagtacagttgcctcataggactttaaccccttgagattttcattctactcaaatcctatcacaaaaccatctcgctagtttataactctggctcgtaactagttgataactatatatacatacatacatatatatatacacacccacacacaaattagctgggtgtggtggcgcacacctgtaattccttccttcctccctccctctcttttttttttctttctgagatggagtctcgttctgtcacccaggctggagtgcaatggcacgatctcggctcactgcaacctccgcctcccaggttcaagcgattcttcctgcctcaccctcccaagtagctggaattataggcgcgcaccaccatgcctggctaatttttgtatttttagtagagacagggtttcacgatgttggccaggttgatcttgaactcctgacctcaggtgatctgcctgcctcagcctcccgaagtgctgggattacaggtatgatctaccgcacctggcctctttttcttttttctcttctcttcttttcttcttctcttctccttttcttttcttttatccttttcttttcctcaaattcctaggttaaagcgatcctcctacttcagcctcctgagtagctgggactacaggtatgtgccactatgtccagctcattttttattttttgaagagatggggttttggcatgttgcccaggctggtctcaaactccgaggctcaagtgatcctcctgcctcaacctcccaaagtgttgggattacaggtgtgagccaccgcacctggtcagattatttctcttaccatgttgctgtcatttctcttaccatgttttaattggctgccccagaaatctctttctctccagctagtgagctgtgactgttgaaaactacagaaactagggctgggggcagtggctcatgcctataatcccagcactttgggagtaaaggtataggaggatcatttgtgcccaggagtttgagactaacctgagcagcatagcaagaccctacctctacaaaaataaaaaacgaaaaaattagccaggcatggtggcacactcctgttgtcccagctatgcaggaggatcacttgagcccgggaggtcaagaccacagtgagttatgatcacgccactgagctccagcctaagtgacagagtaagactttgtttaaggaaaaaaaaaaaaaaagaaagaaagaaaagaagaggaaaaaaaaaaaagaaagaaaatgagggaagccatcctagtgggtcccagcctcatattccaacttaaccaaaaattccctctgtgagtgacacaagttatttcccttctcagcactttggttttcctctgtataatatgtgactactggactctgatattcacctacctttgtagcttaaatgttttagaaatctaggattctgtgagtacctcttctctcttgtaactcctgtccagtgtagtcagtgtgttctgaataagatgcagggatagagtcttttagcaaagcaaagagggaaaataatgagttggggaaaataatgagatagggaaagtaagagataagaggcacttgagaaagaagtcaatcagatcaagaatgcaaaggaaaataagaggagaaaaaggggacacagaccatatatcaacaagggaaattattcttttctctcatacagctctgtttcttccctaccagctccagacccctatttttatttaatttttatttcattttacttattgtatttattattttattattattattttttttagagacagggtcttgctctgtcccccagactggcgcatagtggcatgatcatggctcactgcagcctccatctcttgatgctcaattgatcctcctgcctcagcctcttgagtagctgagaccacagacatgcaccaccatgcctggctaattttttaaattttttgtagagtctccctatgttgcccaggctggtcttgaacccctgggctcaagtgatcctcctgcctcagccttccaaagtgctggaattatgggtgctacctatacccaactaccagactccctgtttatatccaatctcttttgcaaacagaacagttattcccttaaagtcttttttgttgttgttgagacagtctcactccatcacccaggctggagtgcaatggtatgatttcggcccactgcaacctccgccttgtgggttcaagccattctgtgccttagtctcccaagtagatggaattacaggtgtgtgccaccacacccaactaatttgtgtgtgtatatatatgtgtgtgtgtgtgtgtgtgtgtgtgtatgtatgtttgtttatttatttatttatttattttgagacagagtctcactctcggccaggctagagtgcagtgccacgatctcagcccactgcaacctccatctcccggctcaagcaattctcctgcctcagcctcctgagtagctgggattacaggcgtgtgccaccacacccggttaattttgtatttttagtagagatggggtttcactgtgttggccaggctggtctcaaactcctgacctcgggtgattcgtcctccttggcttcccaaagtgctaggattacaggcgtgagccaccatgcctggcctaatttgtgtatttttagtagagatggggttttgccatgttggccaggctgatctcgaactcctgacctcaagtgttctgcccacctcagccctgcaaagtgctgggattacaggcatgagccactatgcccagcctcccttgcagtcttgaatcaaggaaatatgttggagcagggaggcatgctaggctgatctaagcaggatgcacacttatcctggggattcttcaccttgctctcggtgcttttgcaactaccagctgctgtgaggcccttgagatgtcatttctactatggagtctcccctcctccattaaaaaagtgggtttggctgggcgcggtggctcacgcctgtaatcgcagcactttgggaggttgaggctggcagatcacgaggtcaagagattgagaacatcctggccaacatggtgaaaccccgtctcttctaataatacaaaaattagctgggtgtggtggcacgcacctgtagtcccagctacttgggaggctgaggcaggagaatcacttgagcccaggaggcggaggttgctgtgagccaagatcatgccaccgcactccagcctgggcgatagagcaagactctgtctcaaaaaaaaaaaaaaaaaaaaaaaaagtgggtttagatcgtcttgttgccatcatccaaaccagctaccatttgacaatcagagaacagatctctcatctaatgagaggacttcctagtcttgcctattgaatgactgattccccactttatgatttagaacctagaatcctcatcagctccaagcctctgacttacaccaactcccagtagagctacttacaaagaacaaactgtgtctcccttggaattctggattatgaagtggctatcagtgtatattcactcttgcccaggattcccctggaccaagagactttctttcccttttctctttttactttttcttataattgtagattcacctgcagttgtaagaaataatggagacagattacatgtaccctttctacagttatcccatggtaacatcttccaaaactatagtgtaatatcacagccagaatgttaatatagatacaatccaccaatctgatttagacttccccagttttacttcatttttgtgtatttagttctgtgcagttttgtcacacatgtaggtttgtgtatctgtcaccataatcaagatacagagttctgtcaccacaaggctcccctcgttgcccttcattatttttattttacacttgatgttagccaaaagactgagaagcgatcaatatttttatttttatttacttatttttttaagacagagtcttgctctgtcacccaagctggagtgctgtggtgcaatctcagctccctgtaacctctgcctcccaggttcaagcgattctcctgcctcagcctcccaagtagctgggattacaggcgtgcaccaccatgcctgacgaatttttgtatttttactacagtcagggtttcaccatgttggccaggctgatctcaaactcctgacctcaggtgatccactcacctcggcctcccaaagtgctgggattacaggtgtgagccaccgtgcccagcctcattgccctatagtaaacatatacctccttcccaccacctccccattcctaacccctgcaaccactaatctattctccatttctctaattttgtcctttccaaattgttgttatatcaagtaacattatataaaatgtaaaaaaattacatacatactgtatgtaatcttttaggattggttttattcactaggcatattcgtataggaagggagaaatatatatatatatttctctgagatgtggtctcgctctgtcgcccaggctggagttcagtggcgtgatctcagctcgctgcaacctccgcctcatgggttcaagtgatctcccgcctcagtctcccaagtagctgggattacaggtgcctgctaccacgcccagctaatttttttttttgtatttttagtaaagatggggtttcaccatattgactaggctggtctccaactcctgacctcaggtgatccgccagcctcagcctcccaaagtgctgggattacaggcatgagccactgcgctgggctgaaattttttaagattttacagacaactatgttcctaccacagaatcaacactgactcttgttaatattttgttatatttgcttcatctttttttttttttttttgagacagagttttgctcttgttgcccaggctggagtgcaatggtgtgacttcagctcactgcaacctccgcctcctgggttcaagcgattctcctgccttagcctcccaagtagctgggattacaggtgcccgctaccaagcccagctaattttttgtatttttcatagagacggggtttcgccatgttggtcagagtggtctcgagctcctcacgtcaggtgatccacccaccttggcctcctaaagtgctggaattacaggcatgagcccccacacctggcctttttctttctttttaagagagacatgtgttcttgctctgtcgcataggttggagtgcaggtgcagtggcactgtcatagcttatggcagccttaacctcctgggctcaagtgattttcttgccttagccttcctagtagctgggacaagaagtatggggtgccacaccttgctaatttttttgaagtttttgtagagatggagtcttgctctgttgcccaggctggtctcaaactcctgggctcaagtgattctcccacctcagcctcccaaagcactaggattttaggcatgagccactgtgcccagctgtctttttaattattatatgagagaaagaatttattataaagttgaaattccttctaatccgcatccttagttctccccactcatcataagcagctactagtatgaatatgatatttctttctagttgattttgtttatactgttatatatgcataagcactcatgaacaatatagagtattattttatatgtgtgacctttgtaatttctttgctttcagttaatatatgcaaataatttttttcaaaaccaaacagttctaaagaagacaagcaatgacaaaataaatagcaaattcctattttaccctcagttccattacctataatcatgtattcaactcttgtagctgtttcccctggtatttcatccctaattctaaattaaaatgcttataatatgccaggcacagtggctcatgcctgtaatcccagcactttgggaggctgaggtgggtagatcgtttgagcctaggatttcaagaccagcctgagcaacatgtagagacaggtggaaaccctgtctctacaaaaattacaaaaattagcttggtgtggtggcgtgtgtttgtaatcccagctacttgggaggctgaggtgggaagctcacttgagcctgggacgttgaggctgcagtgagccaaaattgtgccactggactccagcttggaatacagagcgagaccctgtctcaaaaaaaaaaaaaaaaaattaataatacttttagtgacttttattgtaggtgctcatttagctcttatactatgtctccactttcattttgactactcttccaataattatatgtaacattcttaaattgaatcgtcattgtacattattatgactatgtaaattatttttactggagagctacatgggctactatgaaatgatcaaatatattaacaattttttttttttttttaatttttagaacagatgggatttcaccatgttggccaggctggtctcaaaatcctggcctcaagtgattcacctgcctcggcctcccaaagtgctgggattacaggtgtgaaccactacgtccagcctttttttttttttttgagacaggctctcactctctcacccaggttggagtacagtggctctatctcagctcactgcaacctctgcttcccaaactcaagcaattctctcacctcagcctccagagtagctgggaccacaggcatgcttcaccacgtctggctaattttttgtatttttggtagagatggggtttcgccatgttgcccaggctggtcccaaactcctgagctcaggcagtccacctgcctcagcctcccaaaatactgggattacaggaatgagccactacacctggcctaatgatcttatcaattcaattttttgtttcttctggagttaattaccagattttttcatttcctttagttttctgtatatgttcctcattctttttcttttgttttttattgttgttgttgttgttttgttttgttgttgtggttgttgttttgatgttgcccaggctggagtgtagtggcgcgatctcggctcactgcaacctccacaccctgggttcaagcgattctcatatctcagcctcctgagtagctgggattataggcacctgccaccttgcccagctaatgttttttgttatttttagtagagacatggtttcactatgttggctaggctggtttcgaactcctgacctcaagtgatctgcccaccttggcctcccaaagtgctgggattgtaggtgtgagccaccgtgcttggcccttcattatttttctatatgcccaatcagatttattttacagtgttatcattagtttccaagtgattgaatgtatcagataatcaattgcatctattttttttttcctgagacctcactttcagaactttttctttcattctagtctaaactgtggttggttattctctaggcttgttcctcagtttttatcttgcagttttccctctttcctttgttggatcttgtttcctaattgtagaccatcttctttcttttattctattttgctggagtatagaactcctaggttagaaataactttatctcagaatttttaaggcaatgcctttccaattactagtgatgctgtctgtgaattgtcgatcttattctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctttctcatattttgctttttctttctttcttttttttttaatgagacggagtctcgctctgttgcccaggctggcagtacagtggcgcaatttcagctcactgcaacctccatttcccgtgttcaagcaattctcatgcctcagcctcccgagtagctgggactacaaagcgtgtgccaccatgccctgctgatttttgtatttttagtagagacgagtttcaacatgttggccaggctggtcttaaacttctgacctcaagtaatccgtccaccccagcctcccaaagtgctgggataacaggcatgagctactgtgcctggccagtttttctcatattttcatcactttttttgttttgttttgtattctggaaatttcctcaactttctcttttatctcgtctattaaaattcctattttggatattatttttaatttccaagagcttttcttctctgttcctttttcattgcactctcttcttgttttatgtataattgtatcatctattttctctttgaggatattaatgatagccttttagaggttacttttctcttattgactatctttttttttaaacttctgtagcccccatgtgtttgaattatgggtttttttgtttgtttattttttgtttgattttgagacagggtctcactttgtcacccagggtggagtgcagggatgcaatcatagctcactgcagcttctgtctcccaagcttaggtgatcctcctacctcagcttcctgaatagccgggactacaggtttgtacctccatgcccagctaatttttttaatttttagtagagacaaggtcttgctatgttgcccaggctggtcttgaactcctgagctcaagtgatcctcccaccttggccctcccaaagagttaggattacaggcatgagccaccgtgacaagcctgaattgtgttatttgaattgtgtattaaagtctttgtgtaagggctttccttaattacattgagatccttggcttttagttcacatttatggtccttaaaagctgcatggttacaaaagcagacagtgatgaacaaaaacaaaaacaagctgcatggaagctcgttttgcatggatgagcttcagattataatgatcagacaactagctttttgttgggtattctccaaatgacagaattctttcacctgatgctgtttactttatccagtgaagagttctcctgtcctttggatccgctgaggggatccaaacttggatatgagtgtaggtcaggacaatgagaatgggtcagggattttcactacataacattcagattttcattttattcccatttttagctctgttcctcaccttgctttccatggtaagggagttctaagggtgtgccatcttgtctctctataggtacctcccttggtcctagcttctgtgtctggccacgtcagccaaaatcctcctatctgctttttctctgtcaaaatgagttgaacactctttgtgtgctgatgtctccactgtcactttttgggtttgtagtgaatactcctttttcatcattttagtgaagctactggatgaatggagtgcagtcaatatgtgttatcaacctaccatgttaaactggcatttaaggtcaggctcggtgactcacacctataatcccagcactttgggaggctgaggcgggaggattgcttgagcccaggagtttgagaccagcctgggcaatgtggcaaaaccctttctctacaaaaaatttaaaaattagctgggcgtggtggtgtgcatctgggactgagcccagggagattaaggctgcaagtgagctgtgattgtgccactggactccagcctgggcgaccctggagacctttgagaccctgtcccaaaaagaaaatgaaattggaattgaagagatttggtttgaacatcttttgacaaataagtagtagaaatttttatctgcagctggagttttttggtggtataccccatttctctccccttctctccctctctctctttttactaatgtgctcctcatctctgtctgagacctcatcaaaatggattttaccacccatatttctaccagttttctgatcagtatcacttaggtaatctctaagaagactgaggctttctctatagctcttctttttctgagcccatagtagaattgccttttatgcctgtttatggcaacataggctttttctgcatgtacttccaaattctatcagctctgtccattacccaggtccaaagctgcttccacatttttagttatttgttacagaagcaccccacttccttagtaccaatttctgccttggccatttgggactcccatccccactccttctctctgtttttaaatttaattatttttttttttttttgagataaagtcttgctttgtcactcaggctggagtgcagtggtgtgatgttggctcactgcatcctccacctcccaggttcaagcgattctcctggctcagcctcctgagtagctgggattacaggtgtgtgccatcacacctggctaatttttgtatttttagtaaaggcagggttttatcatcttggccagtctggtcttgaacccctgaccccaggtgatccacccgccttggcctcccaaagtgctgggattacaggcatgagccaccacacccagcttctcttttttttaagtcagggtttctctccgtcacccaggctggtgtgcagtggcgctgtcatagcgcactgcagccttgacttcctgggctgaagccgtcctcccaccttagactcctgagcagctaggagtacaggtgtgtgccatgatgcccggctaattttttgacttctctctagagataacctctcattaggcagggcgcagtggctcatgcctgtaatcccaacactttgggaggccgaggcgggcagatcatgaggtcaggagatcgagaccatcctggctaacatggtgaaaccccgtctctactaaaaatacaaaaaaattagctgggcgtggtggcgggagcctgtagtcccagctactcaggaggctgaagcaggagaatggcgtgaacccaggaggtggagcttgcagtgagtcgagatcacgctactgcactccagcctgggcaacagagcgagactccgtctcaaaaaaaaaagagataagctctcattacatttcccagactgctcacgaactcctggcctcaagcaatcctcctgcctcccaaagtgctgggactacaggtgtgagccaccatgcctggtctccctctctcttttgaatggagatatgtttacttttagaagtagtatgtacttaccacaaaaaatgttaaatgatatggaactgtatgggctagaaattgaaaagcttccatgtctccacccctaagagtaattgacacccctttagcatggtcagattttgtacatacatactgtccccactttttctttattcttgcttgtttgtttcgtttccttcaggtctccaggaaacctagagaaaaaccgttatggggatgtaccctgcctggaccaaactagagtgaagctaacaaagcgaagtggccatactcaggtagacagataaatgtaatctttttaggtgcactgggggaaatagagcttcttccaaagtgaagcttactaatacttcggtagaatgaaagtagactccgaggccagagagattaggtttgagtttatattttgctacatactagtctgtgaccataggcaagtcctcaaatgcccatctcacagtattgagtggaaattaaatgaaattctttatgtgaatgctgatagtgcaaggtctgttgtattgtaggtgcttcatagatgttaaattatttatcattttactccttagttgtaaagtcatggtcatatagtgcaattcctttggtgagtatatatgcatcaatacaaagcaactttgattataagtgacctctgatttctccatctgtatctgaggaaattgtggacaacttatgtatacataaatgtctagggatagagatgaaatggtcaaatgactatattatttaatatattaatttgattatatctacatgttaaaagcctcatatgtaatctattaacagagatatttaatgaacattttattcaaacactttacatacacctttaactttagtgtctttgtcacatttgagccacttttttttttctccctcaagacaaggtcttgctttattgcccaggctaggtacagtgatcacagctcactgcaaccttgacctcctgggctcaagtgattcttgtacctcagcctcccaagtagctgagaccacaggtgtgtgccacatacatggctaatttttaaatacttttgtagagacaagttctcactatgttgcctagtctggtcttgaactcttgtgctcaaacaatcctcttgcctcagcctccctaagtgctggaattacaggccaatttttgagtcagtctaacaaggttttccagagtacaacatctttatttacttttaagtgtgtggcattgtgactggaaattttatcctaaaccaggaaaatctgttagggtaacattaggacaaattttttttttttttttttttttttgagacggagtcttgctctgtcccccaggctggagtgcagtggcgcaatattggctcaccgcaagctccacctcccaggttcacgccattctcctgcctcagcctcccgagtagctgggactacaggtgcccaccaccacgcccggctaatattttgtgtttttagtagagacggggtttcaccatgttagccaggatggtctcgatctcctgacctcgtgatccgcccgtctcggcctcccaaagtgctgggattacaggcatgagccactaggcccggccaggacaagttggttttttaattcatcctgcatcttatgcatcccctataatatgattcattcacttattcctttgtaaaatccttaaaaaacagaaaattgagacagggtctcactctgtcacccaggcttgagtgcagtgacttgatcgtagctcactgcacccttgaactcctgggctcaagcgatcctcccacctctgcctcccaagtagctgagactacaggcacacgccattacacatggctgattttttttaattttatttttgtagagctagggtctcgctgtgttgcctaagttcttcctgggctcaagcaatcctctcaccttggcctcccaaagtgctgggattacaggcatgagccggtgtgcctggccataattcctttttaatataacttgtttacagcaacatccaaccttagaattttgagatgaatgactaaattattattatcttcctttttttcccttctgatataccaattttattaggtgatatctccgaaaaacccaattttgttaggtgatctcataaaaaaaaaaaacccagcattgactgaggttgttcaaagtaaagttattttatttttatttatttatttattttgagacagagtttcgctcttgttgtccaggctggagtgcaatggcgcaatctcagctcactgcaacctccacctcctgggttcaagcaattatcctttctcagcctcccgagtagctgggattacaggtgcatgccaccatgcccggctaatttttgtatttttagtagatacggggtttcatcattttggtcaggctggtcttgaactcctgacctggggtgatccgcctgcctcagcctcccaaagtgctgggattacaggcatgagccactgcgccggcaaagtaaagtaatttaaatagtgcctctttaacatgacacacagtaaagtaatttaaatagtacctctttaacatgacacacattataaggacttgttatatcccttctctttctggggaataatttttggaaaacttactgccttgtatttgggcatatatgacatgtgggttgggaccccaggatcatggtttccaactctcttgtccctgttgtttcaagcacataaactgaattcacagtcctatccaggacccttggagaagattttcctgcaggagcatttgagctaagagactggctggctggagggtaaattcatcagtactgctgagatcatcatcgtatatgccctgaaggagtggagtacagtggttgagttggggctctggagtcagagatacctgtatttatccattttgttgacttccctgtctccagtacctagaacagtgcctgccacatatcagacactcaggacatatttgtgaatgagtgaatcttagtgtactgggagattcttctaatcatcctgtggttaatatgaagatcattgtctgatttgtagtccctctccttactgaaacattagcggaggctttatttttatagtaaatggagtatttaggctttttttttattttattttgattttagtttttagtttttttgacattatttactttgcgggccgaaagcaaaaaaaaaaaaattatttacttagctttggggacttaacactctcatggaatttccacctatggggctatttttccattctgttttctgacatttagttgtttttaaattttaattgatagaaattgtatatatttatggtatacaatataatattttaaaatatgtatggattgcagagacactaagtcaagctagttaatatatgcattactttgccgggcacggtggctcacacctgtaatcccagcactttgggaggccgaggcgggcagatcacaaggtcaggagatcgagaccatcctggctaacacggtgaaaccccgtctctactaaaaaatacaaaaaattagccaggtgtggtggtgggcgcctgtagtcccagctactcgggaggccgaggcaggagaatggcatgaacctgggaggcggagcttgcagtaagccgagatcgcaccagtgcactccagcctgggcaacagagcaaagactccgtctcaaaaaaaaaaaaaaaaaaaacaccacatatgcattacttcacatatttaccttgttttgtggtgaaaacacttaaaatatgctgtccgcaattttcaagtatacaataccttgttatttggaggattcaggttttttagtgaattgtttacttgatttgcttctggaattttaaagctattagtcccagtttctgttgaacatggctgccttaatctgtttgggctgctgtaacaaaaataccacatgcaggatggcttataaacaacagaaatttatttctcactattgtggagtctgggaagtccaagatcaacgtgctggcagatttggggtctggtgagggcccctttcttggttcatagaccactgtctactcattgcatcctcacatggcagaaggggaaggggtgagggagcacttcagaactcttctgtcttataagggcactaatcccatttgtgagagctctgtcctcatggtcctaatcacctgtctaaaggccccatctcctaataccattacattgagggtctggggttgggattacacatttgaagttatgggggacacaaatgatcagtctatagcaatggctcacaacatagtgttccgggtttgttcttcctgctattccaattttcccccaagtgtatactttatctctgggtcattttcagttttgtttttttttttttttttgagttggagtctcgctttgtcgcccaggctggagtgcagtggtgcgatctcggctcactgcaacctccacctcccgggttcgtgccattctcctgcctcagcctcccaggtagctgggactacaggcgcccgccaccacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcctgggcaacagagcgagactccgtctcaaaaaaaaaaaaaaaaaaaaaaaaagaagtgacaattcttttcaaagcatgaagttagttcctccttatgttcttactaatgctgactggcatatactaggtaaatcttttgtgcttttccataccttctccccttggtcctcgagtgggtataccatttgcatgtgccaggttgagtagaggatgggctttggctgactgggtgcaccctggattgagaagcctgtttggaagtgagtgaggcttttagcatgctgggtctgctgcaggtggtctattagctcagtgaagttgtctgagtcagggtaggacagtaatcgtatgaggtcaatactagctgctatgggagggaaaactccgagtttatcactccactatttatttagtcaaagaaacagtttctaaggaggaaactcttgactaaataaatagtagagtgataaattggtagactgactggctaatgaacacaaatccaagtaacatgggtttgaccatgaggtggagatatcttaggaggttagctatgggatactgacagttcagactgcccacccagtgataggacccacaggagaacgagtgataggttgaggaaagagtcagtctgacctctctgtaatgcagtgggttatgagttttccctagtttgctattgaaacttttcttttgtccttctgtaacccttcacaccttcccttatccattccactgcttctatccattcaactcccaactagttatactataacataaaactgcagctgattgatgtttctcttttatcagcctggatcaaaggatcttttgagtaggtatttataaaaaatgatgttgaagtaattaagactgaggacattaggaggtgggagaataccctggaagagaggtagtcaggagctgttcattgagatgcctttgaatttgactggaagttgctttgcattaattcaggtaataatggagtccaggtgtttggctcgtctgttgatggtcctaagtatgagatgtagctttatttcttctccattcatattttgccttttgtgtgtggcaggatggaccaggtgttcctacttgcttgccttgcctctcatttggtcctgtgctacagtgttgcaagtcttgatggacccttttcttgtaaataacagtttctattgagttatatagttcactctggcagactgccacaattactgcttgagatgtcactagggcagttactattgttattacttgagaccgtcattaggagactgaatgaagggggataaacatagcaatgaaaacttaagacaaaaataactattctaaaggaagggtaacatggggaagaagagaactccctgcttctagtgagcaaaggcagccctgagcttctacagccctttgtatttattgggtaccaagagcagggaggaggaggtaacgattggtcagctgcttaattgatcacaggtacacattattgctaacaggcttcagatgtgcctaactacaagaaacacttgtgcctgggtcgtgactgccctcagcattccttctgggcggcagatgcagtttgtcagtttgccaacatcctgctttcatgagaacagtttcctttttgctcatgtagcctccagtggtatactgagttgatcatgaccctcattctttcggcctccaacagttcacataccatacaatttacctatttaaagtatataagtcaatggctattagtatattcacagagttgtgccaccatcaccacaaacaactttagaacatttttttcatttcccaaagaaacctcacacccttggcagtcgctacctatttccctctaacccactctgatttatttcctatctccatagatttgcctgttctagggatctcatacaaagagaatcctagactatgtagctttttgtgtctggcttctatcatttagcataatgttttctaggtccatccatgtcatagcatgtatcatcacatcactgctttttactgccaaataatattccattgtatggatataccacttttattcatttatcagttgaaggacatttgagttgtttccatttttggctattacgaataatgctgctatggatatttatgtataagtttttgtatgcacctatgttattttgctaaggagtggaattgctgggtcatatggtaactgtttaatcttttcaggaacaaccagactgttttctaaagtaactgcagcattttacattaccactagccatgtataaggagggtttacacatgtatgagggtttcagtttttccacatccttgccaacagtattatctatctttgatatctgtagccatcctagtgggtataaattagtatctcgtggtatggatttgcatttccatgatggctgatgatgaatgaattttttttttttttgagacagagtctcgctctgtcgctcaggctggagtgcagtggcacgatctcagctcacagcaagctccatctcccgggtttatgccattctcctgcctcagcctcccgtgtagctgggactacaggcgcctgccaccatgcccagctatttttttgtatttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcggggcccgtccgctcctccatccgctgcctcgcgggcggcgctcgccggcgcggcggcaaagactgagacagctccgctgcccgctgaactccatcctcccggctgtggggcggcggtggctgcggtcggtcgcggcagcggctccgcttcatatctgcagctggggcccgcgggcgtcagcgccgcgactgtcccggctccgcactgccccaggccgcagcgcagccgcgccaaccaccacccgcggccaccatggccggacgggctccctaagccaccgaccccagcccgcggcgccttcgagccttctggggcctccggcgccgcgacctcctctgcgctcctcacggaagagaccttttttgtatttttagtagagacagggtttcgccgtgttagccaggatggtctcgatctcctgacctcgtgatccaccctcctcggcctcccaaagtgctgggattacaggcgtgagccaccgcgcctggcataagtttttaattttaatatagtccaatttatctcttttcttttgtcacttacgcctttggtatcatatctgtgaaagctttgcctaacccaaggtcacaaagatttactcttatattttattctgagagttttaatagttttaatcccttacatttggtctgtgatacattttgagtcagttttacagtgtgaggaaggagtcagcttgatttttatgcatgtagatatctacttgtcccagcaccatttattgaagtgagggtttgagctggccatttcactcctcattttctgctcaacaagaagagaatattcacaccttgggttttacttactgagtacatcattttatgacccaaatggtgtattctgtgtagctatagtgatgtctcctttttatcattagacagattacatcaatgccagtttcatggatggctacaagcagaagaatgcttacattggcacacaaggtaagctggtccgtccctcccatgttgattttgtgccatctacttatgattccttgtgccaaatgatagcataatttttaaacgaatggtaacttgagtggaggttttggccactagatcctggccttttataaagatgggtggtggttgagaaaagcaaataagtagtttggggtttctgtaccaggtgtgcctggaaactcaccgcatagagataaactggagatttaaacacataacactactgcctgcaagttttggggctatttcttagtattggcaagggtgtagggcatcagaatgcatcagccagtgagctcttcatgctcttcctgtctagtgagaggccaagaatagcagtggacttcccagagattgagtccaatctaggaatgagtattgctgtcctaataggcctaggctggttcctataccatcacagagcactccagcaaatgttctgacatagatagtatgtgctaataagtctgacagtggaatactgagctctaggaggatttctcatttttttttctcctttgaaatggaggcttgctgtgtcgcccaggctattgtgcagtggtacgacctccactcactgcaacctccacctcccgggttcaagtgattctcctgcctcagcctcctgagtatctgggactacaggtgtgtgccaccacgcccggctaatttttgtatttttagtagagactgggtttcaccatgttggacaggctggtctcgaactcctgacctcgtgatctgcccgcttcggcctcccaaagtgttgggattacaggcgtgagccaccatgcccagcctctaggaggatttcaggtggagtttctataaatgttcctatgatcctagtactcttcctgacctggcctctccatctcaagaatatcatgtcactttcaaagatggtaggaggaaatcataatacagaaagacaacagaccatcagatgggcgtaaggccctttgaccactgcagagcaagatacggtggatacctccttaatcaagtgatcaaacttagtatcaccagtaaaggacaaagggacattatgtacacctcctgatatgatgcattgagaaatgaatatcacctgcattgtgtattgccagttttaaaatctgaatctagtcatgggaaacaatccagattgtgggacatactataagaaaactggctcagactctccaaagttaatgccataaaaaacaaaaaggcagagaactgttctagattaaagggagactaaagagaaccatggccaggcacagtggctcacgcctgtaactccagtactttgggaggctgaggggggagtatcacttgagcccaggaagcagaggttgctctgagccgagatcgtgccactgcactccagcctggctgacacagcaagatcctgtctcaaaaataaataaattaaagggccagtcacaatggctcacacctgtaatcccagcactttgggaggccgaggcaggtggataaactgaggttggaagttcgagaccagcctgaccaacatggagaaaccacgtttctactaaacatacaaaattagccgggcgtggtggcacatgcctgtaatcccagctacttgggaggctgaggcaggagaatcgcttgaacccaggaggcggaggttgcagcgagcagagattgcgctcaaaaagaaaaaaaaaaagaggatcggccaggcgtggtggttcatgcctgtaatcccagcactttgggaggccgaggcaggcggatcacaaggtcaggagttccaaaccagcctggccaatatggtgaaacaccgtctctactaaaaatacaaaaattagctaggtgtggtggtgggtgcctgtagtcccaactattcgggaggctgaggcaggagaattgcttgaacctgggaggcagaggttgcagtggactgcgactgcgccattgcactccagcctgggcgacagaggaaggctctgtctcaaaaaaaaaaaaaaaaaaaaa

SEQ ID NO: 14294 - DNA, 21521 bp, Human
  misc_feature (1)...(21521): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggacaccatcactgatgacctttgggagaagagtgaagctgcagacagggctcagggcagacagtccagcgtgaggtgcagagcctgggtaacgctgttgtcatagaaacaaaaatgtagggtgcacagggcagtgatgagtgatggggaaggaaaagcaggtttggggcagctggcagtgtggggaaggaatccaaggaacgtccgaacacctgtgcagagcctggcatagaaaaggcacttgctgagtactagtctgtaaaatgaatgaataaatgactgagttaattaaaggatgcctgttagggctaaagcctgtggaatgggcagaatttcctgtatatccgaaggatctgagctggcttgggatggggtaggctgtgggatgaaggactctggggcccaatacagccatagggaatcctgggccgcttgcagaatggtgttgctggcacctgaagtgcatcctcacccacagtcctccctctctggtcccgccagttttggcccctgcctgtccacactaaggcaggcagctgtagcccagaggcccccagggagggctgtgcacaagggctggcgctttgccccaagaagcccatccctttctgccaaggcgcctttcctaggaccgtctacgctgtagcggccctcatcagtcagtgttttggggaggacaccaagggctgggggctgtggagagggtcctactagacaatagtgaccagaaaatgtcctctgaagcaatactttcatcaggaaggagaatgggaaaggagcccttatgttaaatgaggaattgattgtatgaagacagaaatgatgtcccctttatataagccactgaacttgttttacaatgatcagctcaagaatgtctctgacattcttggtttctccctattttaaaagggatcagatagcataggaaacttattagaatacaatagtaaaattttacccaatctctgctgatctctggcttgccttttttttaacacggagctgaaaatctaccaaagccttctgtgatgagccccattctgccctacttgactgattcatgggcacccagcgcactgccctgcatgctgagctagtcccagggaggcaggaggaggggcctgaaacaaagtaaaagtctgcccccagccttttagtctttgatgagcttctcatgtaatcgacatagcctggaaaatctcctggaagaagcgcctggtggtacagacagtgcctgccgaggagctaagcagggtcagagatttagcctgcaaaggccatgcagagagcacggcacacagcaggggcctaataaagacaaactgagttaagtcgaaggtgaactgaaggtgggaggggtaaactctgggtagcaggactaggccccatccagcaggttttcattgagaagcttttctttccgtttaaaactgacagcctgcaacctatttcctgaatccttaagcctcataggtgccccaaaggaacaaattaaccagagcacaaaagagtgagtgaacagtgggactgatttttattctaagaagcttctctctttctgggaaccaaatcatctgctgagagcagaggatgtacaggcataggataggggctgaagagtgcgtgggagaccctggggagaacgaggagaggaagtaccagactactagacatggcaggactactcagcagtgtagaggaagccctgaagggagaggaggacggccaaggggctttgaggctcacgatgtgtgagtcattttctctagtgacgtgctgcatggagagagagccaggaagatggcccagggcagattgtgtggttggctgggcacgtagactcatgcaaaccaggtgtgtcctcgggataaatgcattttcctcttttctagctcttcagtggttcatgtgcctggagtgaatgatattcagtcctcttcttccacgggccagaacatgtcccaaatctcccggcagctaaaccagagtcaggtggcatggacagggagtcgtccgccctttccgggacaggtatgggcatctgtgagggcatctcccctgggtgaccagagaggcagagcactctgggaagtgttttctttggattgcggttctgaggatgggtcggctcctagctggaaccaaccaccctaacagcagctggctactcaggagcaccatccaccctcagggctctcggagagccaggtgcccagcctgcaacttcagcagccttttctccttacagccatgccctgaggcagctggcagggaaaggttgggcaggttgagacacctcatcaagaatgagcccctcactactctggacctctggctgcccctgcgccaggagggcatgaaaccaccaacccttgtgacatccccagaccctcatagtcactgtgagggtgggtgttgattgggctgagggagttctaggtgttcataatgccaaggccttggtaaccagactccagagggcccggatcctcgtagccctggggagtaacttcaaccagacgtgccccaaagatcctgcagttcctgggccctcacacaccgggctgatcccaggcctgtgcctagccagacaagagggtcatggggagtcactgtcaacccagagcaggcactgcccctgcgaccagcctggggcatcggttggggtgcaggggtctgctggtgatgctttccatctctttgctttgtcctgattgtagcaaatcccatctcagtccagcaagactcagtcatctccctttgggattggaacgagccacacctacccggcagacccctcttcctacagccccctctccagcccagctacctcctcgccaagtgggaatgcctactccagtcttgccaacaggactccagggttcggtaggtggggaatgagggagtgagattctgggaaagccagcacaaatgctttctgaacagcctgaattcaggaggctgagctccaagctcccagctaccaaaacaaggtctggaggtttccaagcacctcctctctctctggctatgaggaggcctatggtgttcctaagagactggatgcttaggccttggctttgtgatttgactttatcattttcaaggcattgggatgatgttgctgtgctgtgaggtgatctgaataccattttaacccattatggccctggcaaggattttcaggtcccccaagtcaaaaaccttatagtcttgtttcaagaaactagagaatagctatagagacaatcaattgcataaataacactgcaaagttttctgtctcttttaaatattaaaaacacctatcttactttgttaacaaaacctcaggccatagagggttaaggaaccgctgtgtcctgtgcatttctcaggatcctgggccttgcccactctccgtgtgtgtaaggaacctcctcagcatgtctcccagggctagggttccactccacgtcaggacaagctcataagagacccgtggtcctggtaagaagtccaagctggtgcctgctttctcacagtgaggtcactgggtgacacccagcagtgcggctcatagagcttttctctacagaattgattcctcagatgagcgtgaatctgagcccaaacatctgaatttccacgtggcaagttaaaagcttccattagaactgcttgtctgtcagccttatgaacaattctgtgcaggcagggcgcggtgactcacatctgtaatcccagcactttgaaaggtcaaggtggcagatcaccggagcccaggagttcaagactagcctgggcaacattgcaaaaccctgtctctacaaaaaaaaaaaaaaaaaattagccaggtgttgtggtgcatgcctgtaattccagctactcaggaggctaaggtgggaggatcatttgatcccaggaggttgaggctgcagtgagccatgatcacaccactgcactccagcctgggtgacacagtgagaccctgtctgaaaaaacaaaagaaagaaaaatgctgtgcagagcccctagcacacaatggggagttgtcatctgctgcccagccctccccacctcctccactaacagcagcacgtccgtcccactcagcccgaggtcttggggcacagcatttcctgaggccatgcttgtccctccagccttagtcccatttacttgcagtgtgtctcctcttcgtctgttaagtattctcgccacgtggttcactggaacccagtttagaagcacagcaccctgtctgaggaaggagaaaccccatagcagttgctctcaagtcagccaggcactcagcacggttaccaccttgagcccagaatcctgtttctcaggatagcatccaccttcctgcagtcacacgtgagatccttctccacatctggttccccacccgggtgtggagagaccccttcacctcctcctgaaggtgggcctcatagactcaaggcctcctgggtacctagtccttcccggaagcccagggaccatctggcaccgatctactcaaaaaaaccttcagtgccaggccccgaatcagccctggaagacaggagacctggtccccacccagagaaggacacagtccagagactgggtcaggggagacagacagaggtaaagggaggcaggcaggacagtctgcaggtgcggcagccatggtctgcgtgggggcccttgtggctgcaggccaggacagtcgttatgtctgatggggtcaagagaggcttcggagcagagctaacacgcaaccgtggcaaggtcttggagcatcccactgtggccgtgacgagacaggtgggcaggccacttccctgccccaaccatccagtgcctttagctccatgcctctgtctagtctccactaaacaaatgccaggccctgaagtataaatggagacgggacacaggaaggacgaagccctgggttgaggccactgcaccactgtggccaagaacaggctcaacacagatggggctccaggttgggtttttacatttgcctttgagctatctcacactcagatgataataatagtaatgatagcagcctgcccttagtaggtacttattatatgctagcatgtagcattcattcagtgctcacaatagccctaagaaggagataccattattattcccatctcacagataagtaaactaaggcacactgaggtcagataacttacccaggctaacttactatagctgataatagcagaatcatgcctttggagccaagaatcaaagctgggcagtacatctgagactgtgttcccatccactactctgtacttaccatcattttcaaatccattcacaggggacctcagaattaagcaggaattggatgtcccagcagatggcccttgatgtacattcatgagaaaggggctggaacccttccaatgagggcatggaaaaagcatataaaatcgagaaatgaaggactgagaagtttcttatggccttgccatcagtgcatcatgtgttacctttggccacagctatttgagtggaataggatgcagggagagtgtgttgaaagccaggctgtggtggagtgaacaggtgatagagtggagacgaagctgagcaggagagcaggaagggaggcacagtcttgggagggagagggagacctcgaggcgaggggttgctgtcatcgtctgtgatgagtacactgctggaggaaggctcccagtgcaggcagaggggacccagcataaggtgttggggttcacatcagaggtgtagaggggcctggaaaatgggtggacaccagacccccttctgaccacagggtcagcttttactccacagggcttcaaggaagtggagtgctggctgggagaagagggcaggctttggttaaggacagaagaaagagggtgtgtgtatggttaggaagaggacccaaagggttgttcgttagtgaggatggttactcccgagggcacagtgggaaagggtgcagggaacagagcaggtaagaatgggtgagtggagaaggaacagagcaggtaagaatcggtgagtggagaaggaacagagcagtctgccccattaatggtcagtttcattaattattaaacacaaagcaggcttaaaaaacaggccgtgtttacatttgcaatggacacacaccctagcccagcgtgggcacatctgagtggcttcccagtgccctctgtgcagccctggggcctattggtgtggcactgatgggttcccagtcctgacagcaccccacggtacctggcctcagttcattatccatggccagagcccagagagataatgcggttgatcccagcctcctgcttctggctggctggagcaggcaggggatttggaatgcctgctgagcagacttgccggacgtcacccagtggtggaccaggggcagacatcgagttgtgacaagcatagcatgtcacttttgaacagtgcttcaactgtagcagactcctcaggatagctttgtagactgagtttatacattgagtgagaaaaaacgcccctgcctgggtctcagccctttctgtgaaacacatgctggttttgttcaacgagctttcaggagtcaagccaaagcatttcttccatttcagacctttcacgttatcttgagctttactgctgtcataattgtgtttccagtcttagtatcattttcattttgagtccagtcacagcaaaaacctagccatttgaaatgtagcatccactaggaaactacacagtcccattacttaagccctgaaaaatccaagcatttattcccttaacaaagtaagtggggaaagtgttgtgcctgtagggcccagtcaggagacagaaaccatggcagtaatttaaacaggaaaaatttaaagattttgtgactaattaaaggtggttaagaaggaccctgaggaatacaggaataataaatgtgggcagcagcttctacctctaaggctaagggaaagtagacaagacaggaactaagaacttggaagaggagaccccaccccacaaaacctgaggttcagcccttgttggagaatgtgcatctgtcttggtaacacactgtggatgctctggactgcagtgggtctgtaaaagcagcctgcccactgactgagacactcagtagggggtgcagatggaccagaaatggtctacacacccaccccaccaggtggccaagaatttccccagggagtgcccgcaggtaaaactgactcacaggaggcagcctctgggtggtagagaaatgtgctgaagagggagcaccctgacatcctgcacactgcgttagacacactgcaggaggaaagaaacacctgatccaggaagagaagccacttctctgcagtacctcgcttgtctctccagcgtcctctgctgagaaagcctaacgctgcactcgctgacaaaggagaaatgtttgcagggtgtagtttcagtatcatgaaacagggcaaagaaggatggatttagagccaagaggcaataaattgataactggcaagaatgtatatgacctgaatcctcaaattgctcagtttcttttcatctcaactactgccaggcatctgcttgttgatattaccttgtttcttggagaaatgcagggagccaagtgcacaggttgcttaaagagaaatggctcaaaggtgctgtagcagaccaggtttcaattccttgacttgctccaagtgtggcatacacatacgtaggatctaagttacattattttcttagcagcatgatttccagatatattgtcttggcaagcaacagcatgtccatagctccttgttccccacatgcgtctcagtttagggtgaggtctctaaagcaattcatccatgcatgacacaagtcagatcaggtcgatacagattaaatcaggtcacaatagataaacaactctggggatgaatgtcttttacaaagctcgagaaacacatccagaacacattgcctttttgtaaaagagccatgtccatcccagcctgccccacctagcccatactcactttggagaggagaattgaaagaatttgttattccaggctgggtgtggtggctcatacctgtaatcccagccctttgggaggccgaggtgggttgatcccttgaggccaggagtccaagaccagcctggccaacatggtgaaacgttgtctctactaaaaatacaaaaattagccgggcatggtggtgcgcgctgaggcaggagaattgcttgaacctgggaggtggaggttgcagtgagccgagattgcaccactgcactccagcctggatgacagaggaagactccatttcaaaaaaaaaaaaaaaggaatttattatttcaaaaatatctggagtgagaaacgaaaggcataattcaaaataggggaacagggtagactaagcacaggcagggagccagtaggattttgctgatctgaaatgtttgcagacaccatgcaccctcttcctccccagctcctgcccataaagctcagtcccggacatttttaccagtgaattatggggaattatagacctctccatccctaatactagttagtgttgaaaaggtgaggccttagccagaaggctcaggaagactgtgatccttgctgtaaggtgcgtttttcttctgcctagaaggcatttgtaagacaatgagctgccctttggtgcaccttgttactttatccagcagggtttctcagtgtcagcactattgacattttaggctggataattctttgttgtgggggggctatctcttccttatagggggttcagcagcatctccctgcctctacctactaggatttctctgtttatgataatgacaagtgtttccagacattgtcaaatgtcccccttggtttggtgggggggtggggttgcgcaaaatcacccgattgggaaccactgagctaaacccaactacataggacttccaagcaggacttcaagtgagccttaagtcttagggcaatttccaaatcagctgaacctcacaagaaaaaatgttaatgagaggagaatgatagcattgagcttcaaatttttaaaaaaggaggatgtcatccctgcctctgtgacctaggaagccacaagctcctcaagattctgacccgtggtctgaaagcccacacagctggcccaggtgttatcagcccataacacagtctatctgggctgggaggtggcccatgcacagaattatctaggcacagagaaggggaaggatgtacatgacagaaagaacacatgtgcagtagcacagagatgtaactgcatgtggctcatgggggacatgcaagtattgtcatgtgactagggcaagaggggctggaattagacacgaagtgggagatgaggctaaaaataggtccagatcgtgaaggatcttcatgccaacatccagaacatggatgttactacatagaccgcggtcaaccactaagcagtctgtaagcagtggactactgttggagggagatcacgccagtagctgtgtggttatgggggcagtgggtgtggccatgactcacagcactggttggggcagtgagaatggaggaaagcaggtaggagttgagagatggtatttaggggagtgggaactcagccgaccccagcctgtcaataccaccagaagtgcaagtttatcatccctagctcttcccactcacacccctcagcacagtcagtaatcaatcaacaagcctaggcacctccttctccatcacatctcaaatccacccactgctctccagctggcttttgttctgtgttttgagccactgtcgtctcttgcaaggattgctacagcagcctcctcccctctggctccttccctctcctcttgtctaccccattcctttctcggttggtctctttccctctctttttgtccacccacccatggaccatacacatctgtgtgcttcctgcttctgcttaaaaaccttcagtgtttctctgttgtccccaaaattggtcatactgacagtgtggaacctgacccctggcttaccctccagccttatctcttatgacttgcctgatctcactctattcctcttccatcctgagccacctgtagatgcccggatgaaccaagccctttttcaccatcaggcctttgaacagactgacccttttctctagaattattttcaaccttacctccaagccctataccggattaattactaattccccttctggtgtcatctgagatctctgaaaaaccttttctacttgtcatggctagttaggtatccctcgtaagcgtttttattctagttcctctgactcttagagcagctctcacctgtgcagaattgcctgtttgctccctttcccaaccatgctatatgcttgttgagagaggaacgatcttattctccagtgtgtgtacagtaccagcatggagcccacgtcagagcaggagctcaggaaatatttgccaagtgaataaatgaatgagtcagttgatgagattagaagaggttatttccttcttgtttgttgacgagaaggaaggcctgactcagacccctgctttcaacatatgttaagagataaggtcacttacagtaaggaccaggaggcacgtgagaaagagtagtgtaagaagtagcagaaccaaaatcaagttcagtcctagaagtcaacaagatagtttcaaacagaatgatcaagagtgttggatactcaagagagattgagaagaatgggcactcttcaaatgcctattggatggggcctggcagtagagtaattgcacagggttgagaagggagggaaaggagaagatgctgtggggtgggggtggctgtaaatgttgatggcaaagggaaggagaggtaggtatgtactttaaggaggaagggctgagggcattgatttgtgatgggcaagccccaaggaaaccatcattgcagcagcatcctgggtgagcctgtgtggcagtcatcttcctgaatgcataaggacattcccccagtctaccatgcccttccttcagcacaggtggctatgtccctccacccttctgccaagcaacatggacccactgaaggccccatcttgtgctcagcctctgcaggcttccagaatgggacaggtgcctgtcaggtgggaatttcctcgtagctccagctggcgatgctactgttttaactttgccacagttgtggacccagccttccctctgctaagccaattaatgaggccagtcgacacgattctatgaaagagttcctcctggcccttggggtcttgtgtgggatcattaggaaaagacatttcacataggcagatgaattttttatagcagaatcctatgtgcacagtagatttaaatctctcttatgctaaggaggggaatgtaccctgcctcaattttatagaattccttaccaactattgtcatcatgtagagtttgaaaagcaccaatggtaaggcattaaagggaccttatgcattttattaaagccctttatgtctcaggcattatatatgggtggatgggtgggagagagagcgagggagagagagagattcttctccctgaacactttctaacctggcctcacattaacgcagtgcccaggctgggggttgggtggggcctgaggcttccccgtggccagcatgatcgttggaaagagtagtatgggacaagatggggcttctcttgccacccagagcttgacagagagcccattatctccaaaatggtactgaatgatttgaaacaagaaaaaaagcttctaagatttttgatgttccttaaaggtatcttctctgaaggtatttttttaagcctcctctttggttgaatctcaaaaacgtttttagacaaaattccacttactggatcctctttggttgaatctcaaaaatgtttttcgacaaaaaaccacttactggataggcacagtggctcactcatcccagcactttgggaggccagagcagggggactgcatgaggccaggagtttgagaccaacctgggcaacagagccagaccccatctctaaaaaaaaaatgttttttaattagtcaggcaatgtggcatgagcctgtagtcccagctatgagggaggctgaggctggaggattggttgagcccaggatttcaaggctgaagtgagccatgattgcaccactgcattccagccagggcagtggaataagactctttctcgtatgtaaaaaaccaattccacttatgtttcctattttttgttttcttccattggctgtttttttgtataaactgtagacagaagcaaagtggctctcatttataaatgaatttgctgattcccacagaggaaccttatcttgtctgaccagtgcccaaatttcttcccctgcaaacaaactgacgcaaagaaaacactctgccaaagagccaggcaggaaaagactgtggtgcttggccctgtagggggaccttgtataatgcgtgtgtggcttccgaggagttgctcgggggcagaggctgaggttgggaatgccaagatgaggcttttcctctagcagggccagatgcctttcaagagcattcggtggaccgagagggaatcaggagcaggggcaggtgtgtcttcctcctcatgccaacaccatactgctgaggacagaccctctctcagcccacactctgcatgcaacagatatgccccttgccccccagatgcccgcaggaggcctttgtgcacagtcaccaagtgcaaggagcactccaaggcttaaagcacctagtcacctggcaggtgacctcaggaagagccatcctctctggccaagtacctgcaccattgggcaaagggctcctgtgtctcttatccactccatttatgatctgtcagccagtgagaaagacgaggatagcaaacacattccgccagctctggatggaacgtgcctttcagaagcgggaggccctccagccgcagtggttcttaggtctcacagaaccacgggatggcttttaaaggaagtgtcctgtgtgtcgaatctttcagctgaaagtggacaaagtagcgggcagttccaagggcggccctcggaagtctggtcgcagtggcaaagccagcaccatggccagcagagcggtgagcagcactcccaccagcagcccggtcagactgaagtgttccaggtaaatcgagcgagcaccgccttctcgtaggtaccggcgccttctctctgcttcctttccccctcggtctctgccgcaccaccgcctgcccgatagccgtcgtgagttctggcccagcctgggctcgagggagtccaggagtagaaagccccatcctacccagccagaaacgtcaggtgcatgtgggaaggagaaggggctgatgtagccttcgagctaagccacacaatagaggaggctgcagttggagatgcttcccagactccagagctatccagggtagaggcacaaaaccaaggccaaagggggtctctcctaagagctgcaggcacccccaggcttggctgtctgtcactggctgaccctctttcttcccaccgtagcccccaggatgtggaggacatccccacccaggcccttgctcagtgccagccttgccctggctctgctctcctctgtggttaagctcagggagagtccccgattgaggatacctgggcaccttgaaactctccattatttgagacctttctagaccatccctcgtgtctaaggcagactgtgtggctggggatggcactgctgcagccccacagagcaggcccctgccctttgtgggcttccttggctcaactttcagccagaaacattcctactggaaggcttcaaatggaggtacgagcccattaactccccttcagccatccctccaggtccttctaacaggaacccaggcacgtcctgcatgccccaggcctgccctgcaaagcaatgataggggcaggaaccacatcgtgggagggttctgagactcccaggattgcaacccctccttctcaagaatcagtgctccatataccccaccctcatcccaagcccctctcctgccggggtcagctgtgtcttcacagacaaaggcctgggactcagatgtcactcagggcagcattctgtgaatgtacaggggaacggctcacccaggccttcgcctgcctcccctgactgcagccatctcctccttcctccttctgtaaggccttgttccttgcccattctgaggccccacagcaaccctgtaaggcagaatttcctgacatggatcttcatggtcacgatgctaaaaagaattcttggccaaataagcttacgaaaaactggttaaacaaagttattgagtttctttattgcaggacgtatcagagcttttattacaccaataaggactggatttctaggaggtaggcaaagtgtgccttgtttcccaaacttatttgtccacagaattcttttctcacagagtatcacatgggctgagaattcaacagaacacatgttggggaattggctgtaagaaactaaaatagtgctattcccgttttctggatgggtcatctgaggcccagaggactggaaagacatgttgaaactgaaatctaaccattcagggattcgtccctgcgctaagataaacatggaagacaggccagccaggtctccacatacatcttccttccactccactctgcgttgcatttctcttatattttggccatctgctatctgttaggtgcaccttgcttggggccagcctggggtctccccgccagtggggttctcgtctaccctgggtccctgactcaaccttagatagacaaagggcatgtcctaatgccgtttacctgctgtcacaacagctccctggggagaacagtttccccgggtctcagacatttgaggacccttgcagagcatcccgcagaaggctggggaggacctctgggctgcccctttagggatggccatgagggtgagtgcagactgggctcctgggacatgcccagtgcacggacagaggagctgactcccctgtggctctcttttcctctcctctgcaggacatgctgcccatgccaggagatccaacccaggggactggcaactataacatcgaagactttgccgacctgggcatgtttccaccgttttctgagtagctgcggccagagtgaggctcctgctgtacagtgccacccatactgtgatgtcgatgcccatgtgaatgaggcccaccctcgccctgcttgccctgccgcaggccccccaccagaagccatctcccccgctgtgtgtccccaggcgcatcattgctccactctcccctgcagccgcggctgctcggccactgaccaggggccctggcagacattaggggatcagttgtatttattgtattttatctgtgtgtgctcaggaggtgagcctagtgggtccttaagtttggttgtgaataatctcttgatagacaatttatacccatgaaagttcagccaatgcccagagtgaccaagcagcaccagcaggcctgcccaggatgctgaaagcagatttcttcttgatttcacttctgatggatgcatggggctctgggggaatgctgggaaaatgggcaagcagagtgcacagccctcgttctgccagctggagccaagaagcacagagacacagaggcgcctgcccctcagctccgctggtctgtctgtgcatccactgtgccgtgggacatatgtaatttgtgcagtgtgacatggacttgctgtcctaatggatgtgttgtgccttgtgtctgtcatgtgtggccagcgtgattgtatagaatccagagtatgtagagagccaaaatgtgtggccctgtccccaagctcagcaccaccggccatgaccagaggttgctcggcccagggtctgggagctgggctaacaggctgacacttcggcagggtcaccaggaggcacagctaggggcatgctcacatgggtaggtcagttctttggtccaagcctctggtgcagattcaagctcctcctcttagaggaagcagctccttcctcccacaggagccccaagggagcactcaccctcctcccaattggatctgaatagctgtgttcctgatcccacataagcatgtctcatccttgccccactggtgagaggaggaccttgtgcctgcccagagcctgcaggacagcacgccttgaggtcagaggcctggcccttctttacagatgtagatagcagggtaggacgcccaggccttctcacatgggcaccatgaaacactttcttccaggccacctgagccttcgttcttcagcccgactggaggaacagcagctctgggaggcacagagtgcaggtctcaggggcagaagacatgggttccagttctggttctgccacacacccaccggccttgaatttctctggtggtctcaagacaagaacaagagctgactctagaatcttctgcctggctgacctctgagcccatgatccctggcttgctgtgcttctcttggatttgaggagagtttatgaatccatccccctgttttcagggacctctgccttctcccacaccccttacactagtgaggactccttcggcctcttgtgtttccttccttttgtgaccattacgccccctccctgtttcttatcaccagcccatcagcccactgactcccatatggtagaaaaggtaccgtggctgctgcagggcacatggagggacctaccctctgggaaagcccttgtgtccctcccagagtccttcaggtaggccctcgcagatgctgcttgctcagaaacaacccgtgcatccctgcccatggattctgcaggacctagaagagtggcattggttctaggaacctgagagtggagtgaggccagcatgcaggaaggagtttggagagagtgtttgctgtgatccattgaaagctccacattaaaccccagccctgtctggccagggagatccatgtgctcaatgttgctgggggacctacaaaagtcaaacattgctcagtaaaatgcctttggctggtcgccagctgtgcatgactgcagttcctagactctaacttaaccccaactttgcagtttctagagctttttgtctgtaatggtgattgggtctccactgtagatgcatgcagtgttcactccaacctcagaggctttcttgcttctggggaaatggcaggtggttgaaaccctgcacatcctcccagggccagccccagaatgggcctttctctgcctgccctgcccttggggccacctctgcctccagcaggcttgagcttgccccaggccttgggcataattatttccccccaaaaaaggcacaaaaataggttttggatcaaagaagtgtttctcagtgaaatgaaaacagtctttttatagcctttagcttgtgagtttggaagtttggggggtcttatgtttgttttgcctcttctgtttcttggaggagagttgaggcttttcttaggtgcatacacagacccaggtgaacacgctgactgtgaacctgccctgtatccggagctgtgctgggcactgaggggatgcaacaaaattaggagaggatccttgctcccaacgtctacttctcctacctcaacaggggtccagggtgcagtgaactcagttcttggcccttgggtgaggattcatggatgaatgaaagctagacctgatggggaggcattatgactaaataggcccagcctccttcccttccagctctgtcctaggagcataggcgggaaatctgagtagagtctgactgcagtttttgcttatgatttgtaaaagccgtcatggggtcaataagaaaataggggtgatggagggggagaagcccaggactgggagaatcgcacatgccccaggggttttcaccaaggattttcaagacaaactggagtaagaattaaagccccagaggatttaattatcctggtttgcaaaagagcctcccatgccagtaccgcccagccttggaggccggaatgctcatggcccctgtggtctgcttgtccttcagcccatgcccagcagatacctctctgactggagacgggctcaaagctggattagaaaggggagaggcacttgtgactttgtttgactctgtgactcacttcctcgctcacaccttgtttgaactactggactttcaactggctttccttaggtcaggcaagcagacagctccccactgaagaggtctgtacagtgacaacccgggccggcagcaaggacacagatgcagccacagtaaggctccatcaggactgggtcagtgatggcaacaggatggccaaggatggctctagaacactctgtccatgcgtcactccccccagttttatttttagctttggcttcagggagtgacagccatcacaaatagccacattctgctctactctccaacataccagattctacactgttgttatttcatgagacgtgaatgttgcagagagtggggggattctggttgttaaggaacttacactggggagctttactcttccgtgtcaacaatgtgactacatgttctccagattagccacacatgcaaacatcagtgtccttctagctttagccgagaaagaaaccagtcccagggaatgaatggtggtctccccactcccggcagcactttaggcagcccataagctatgcgagaatgtgaacgctcaccttgctccgtcacggttctgacctaccacataaacaggaagaagccagtgaccggaacagctctaggaataacaagtcagaatagaagtgtcctttatattaccagaaaatatgggcttggcctaagtcgctgtctcctaacctgccggggtcattccccaccaaacaccccatactaaggagccatgagccacctggacattcaccttttctttgaccatctggagtctggggcaacttaaggaggcaccacacagtggtgcaggcacatttccaagcgtaggtgtccctggcttttgtggccaaagctagtgttatggtcaacaacaggccagggtctgtggggcactgaccttgaaagtggcaaaatggaggtttcacaggctgtgcgggagcaggacggcttgcttcatctaacaatctcagtttcctttaaaaaaagaaagaaaggaaaagatttcataagcaggtgtcagtggacagtttaagtacttaaccatttctctttcttcttatggatgtgaactgtgctgtggataaatcatttgtatttcttgaatgttctctatgactaacagttattaagtcggttgtgtatatgtgtaactaatgtaactgccttttaaaatttcattacaataaaaatgactttgctctgaacaacaaatggcccaggccaagtttgtaattgaaccatccttgaaacctgccctttgcattacactccctcctatgggctgtattgtgtcataatctgtaaaggatgtggcgtacattatactaaagagtgacccttttggaggtttagcttcttaggatagaaaaggaaactagggctgggcacagtggctcaggcctgtaatcccagcactttgggaggctgaggtgggaagatcactggagcccaggggtttgagaacagcttgagcaacaaagcaagaccctgtctcaaaacaaaacaaacaaaggaagctagcatatcagtcatattgcattagaaccaacagaaaataaataaacaaataataaaaggaaacacaattcttgaccgtctgtgttaggcaaggctctctagaagcttccttacaaatgctatttttgttaatacaaatctgatatgtggttactctccctggtttacagatggagaaactggaactcagagaagttaagaaaatacaggaaggaaatggcagaaccaggatattgaactcaggtctcagtccaaaaccctgtatatattgtcctattcaaacattcttcttattattttttaatccttacaaaattgttagtgttttaatatgctgatgcctctagtaaatacaattgactcttgaacaacatgggtttgaactgtgtaggtccacttacacgtggattttcttccatccacctctgccagccctgagacaggaagacctcctcttcctcctcctcctcagcctactcaacgtgaagatgacaaggatggagacctttgtgaagagccacttccacttaatgaatagtaaatatactgtctcttccttatgattttcttaacattttcttttctctagcttacttaactgtaagaatacagtatataacacatctaaaatatgtgttaattaactgttttatgttatctatattctggtcaacggtagattattagttgttaagttttaggggagtcaaaatttatacatggactttcaactgcatgaagagtaggcgtccctaacccccatgatgttcaagggtcaactgtacttacaaattctattgttcctctgccaaaagagaactttttggattctagcaaaatggcagactaaaattgttttaaaactcttccatcaaacacctagcattgctagtttttacagctttattgatctattattgacataaagtagactgcacgtatttaaagtatacataaaattctgtgaccctgagttaaatatagacttcttagatactacaccaaaagcatgatccatcaaagaataaattgacaaattagactacataaatattaaaggcatttgcttttcaaaagacactgctaagagcatgaaaagataagccactgatgggagaaaacattcacaagtcatgtatctgacaaaggactagtacctagaatatgtgaagaactcttacaatggaataaaacaaatgactcagtacaaaacaggcaaaaaatctgaacaggcacgtcaccacagaaaatatacagatggcaaataagcatgtggaaaaaactgattaccatcattagtcatcaaggaaatggaaaataaaatatacagtgactctaatatttggctaaaatgtaaaaagactgatgatagcaagtgttgcccaggatatggagcaactagaaccctcataaaggcaaaatggtacagccactttgagtaacagtttcttaggaagttaatcatccactcatcttatgacctagctttttcatacctagctatttgcccaggagaaataaaaacatatttccaaacaaagacttgaataggaatattcattgcagtttcatatgtaatagccatgagggaaaaacaacctaaatgtccatcagtaggtgagtggataaacaaattgtggtaccaccacacagtggaatactacccagcaataaaaaggaacaaag

SEQ ID NO: 14295 - DNA, 9261 bp, Human
tcagaattatctcatgcttggctgcgtgattaaaaatttacagagcgtcggccgggagcggtggctcaaacctataatcccagcactttgggaggccaaggtgggtggatcacgaggtcaggagtttgagaccagcctggccaacatggtgaaacccccatctctactaaaaatacaaaataaataaataaataaataaataaataaataaataaataaaaattagctgggcgtggtggtgcacacctgtaatcccagctactcaggagactgaggcaggataatcgcttgaacccgggaaggctgaggttgcagtgagttgagatcacgccactgcactccagcctgggcaataagagtgagactccatctcaaaaaaaaaaatttacagagtatctctcatctttacaaaaattcacggccaggcgggcacggtggctcacacctgtaatctcagcactttgggaggccgaggtgggtggatcacctgaggtcaggagttcgagaccagcctggccaacatggagaaaccccgtctctactaaaaatacgaaaattagccgggcctcgtgccacatgcctgtaatcccagctactcagaaggttgaggcaggagaatcgcttgaactcgggaggcggaggttgcagtgagccaagatcgtgccactgaactccagcctgggcaacagggcaagactctgtctcgaaaaaaaaaaaaattcagcatcacttatacccgtttcacaaagacagaaaggaagcccagagggaccagcattgtaatttgcccaaagacacagcatgagtacgtgtggcctccaggatccacacccacacctgcccaaatcttatcacctaaatctcatcatcacccaaccccattgccacccactgcctagcactgcctgcccaagcagtcagttactccactcactcacagcatcctctcagtcagtggatagaaaaccgtaaaaggctaacaaagaactaagcacaaattaaattataaatatattgtaaaataaatttgtaaagttgaattaacttagtgttgtaattcttaacaagaataacaagaagctttcagtagaggttagatattaatgttttccccaaaacttaaagcacttttcggggctgggcatggtggctcacgcctgtaatcccagcactttgggaggctgagtgaggtggatctcctgaggtcagaagttcgagaccagcctggccaaaatggtgaaaccctgtctctactaaaaatacaaaaattagccaggtgtcctggcgcatgcctgtaatcccagctacccaggaggctgaggcaggagaatttctggaacccgggaggcggaggctgcagtgagccaagatcgcaccactgcactccagcctgggcaatagagtgagactctgtctcaaaacaacaacaacaacagcaacaaaaccccaaaaaacaaaaacaaaaaaacccgcttttctgaaaaagaaatgtctatggattaggaaggtctgcctcccataggaagatgcaggtattgcacgtagcccaaatatttgatgattccaggaccggcagatacacaagttatgaaactgtttgtaccttgaagaataacgagaagaggaggagaccaagaggaatagaagaaaaagaatagaaggaggaggaggaagaagggaaggaggactagaagaaaactacaataataacaacattgttgagaccacaagatcacgccactgggttttgctttatattttggaaaacactgtcacatccattttactaaaagccatgtatcattattgtagtccccagattgtcagggatccaaatattactgccttcttggtttctacaaacagagcacaggctggctgtgttcccattggtgtacactattgtgtcctggtcccatgccaggttgacacattgcctcattcctgggagggactaaggtgcctccctggggaataaatagagcagggctgggtactcacctccacagcaacttccttgatccctgccacgcacgactgaacacagacagcagccgcctcgccatgaagctgctgatggtcctcatgctggcggccctcctcctgcactgctatgcaggtgagttctgggcagagagggctgcttctgggctaggaattgtcacctgggcccctgtagaagaactcccaacctctaatccccagcacagacgagccccagtgtgaagggcctgggtgcgataggccttaggatccccatgagttcctgacaatcaagcatgcagtgtcctcatgggctgtcccctgcattggagctgcacacagtgtatcatggcactcagcgtctcaccatggtcacggtgaccatagaaaccaggatgagtctcaggattaaatattgaaatgaactatttcagtggggcaagggagagatggcatctacacctagaaatcaggaaataatcatgggtctccttgaatgtggaacgaaataggaaacctcccaggacagaaggcccaggctgcagagtgtgacccagtgtctctcaccctgtgtggctcactctgtgttctcagagttgatctgggtccttctgggatgcccttaccctcccagttgcttcaggctcaaggcagacaggtgagaactcacaacccctggagtctccttccagcactaaagattcagtgggaggaaaaagccccggctgctggaatcagcgctaatatttccataggtagcctgccttgtgcagttcacaaaggtggattccaaaccctaccgtattggcatccaaggtaggtgcagatgtgtagaagggtgacaagctcacagtcaactaactggaaaatcacaaagtccagagcacaaccagctcacatgaagccacgtcctgagctcgttcctctcccttacagtggggggtgacctcagatcccctcatgaacaagctctatttcacattcatgtgtgtgtgtgtgtgtgtgtgtgtgtgtgtgtttgagacagggtcttgctctgtcacccaggctgggactgggactggtgtgcaatggcacagtctcagctcactgcaacctcttcctcgaaggctcaagtaatgctcctgcctcagcctcccgagtagctgggactacaggtggacaccactatgcctggctaatttttaaattttttgtagagatgaggtctccctgtgttgtccaggctggtcttgaactcctgagctcaagcaattcgcctgccttggcctccctaagtgctgggattacaggcgtgagccaccatacctggccacacattcccttttattgcagtagagtcaacagaactaatggacaatgtcctagacccattcatctgaaatccttggaaaccctacctgatgctgggcatgataacagggaagcattgcatgactttgaaccaagaaagtccaagcagtgtttgctatgtccccccagtcagaacacctcatttctcgagggtcctcttcaccaagaatacacagggttgggcttctctgggtttggaaggtcagagagaatttgcagagcctgagtttacactcccagaattgagaactctgcatactgcaccaaaatctttctgaacctcggtctgtccctggaggtacgaagatagccagcttcccaattcatctgtagaatgaatcacacctctagtaatggcccatgttcttgtgtctttttttttttttttttttttccagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatggtaatttgggtttcttcttatgtaccctttgaaaatcactgatcagaaccagcgggctctaaatttggcaccaagaatgccaagcaactggtgaacaaactttctttatatatcaattcattaaactttgtctccaggctgctttgccacttcacattgagaatctttagggagtgataaatggaaaaggcaaaaaggagaaaagaaagccttagagatcacccgtctacctctgacctcaccagtcccttctcacacagacacagacacacataagcacacaagtatagacacacacagacacacggggacaggcatcggcattttttttttttttttgagacggagtttcgctctgtcactcaggctggagtgtagtggcgtgaatctcggctcactgcaacctccacctcccgggttcaagagatttgcctgcctccacctcccgagtagttgggattacaggtgtgcgccaccacgccgggctaatttttgtattttaactagagaaggagtttcaccatgttggccaggctggtctcaaactcctaacctcaagtgatctgcctcccttggcctcccagagttctgagattacaggtctgagcccccgcacccagccagaacatgcacatttttatcaagagaaaatatctggttctcaagagatcacacacttgtaggagcaatctactaagaaatttcctactttcacaaaaacaaatattcaaaacattcttatttttttttatctagctcagaaaatacaatttgtgcaaattctgcattttctaaaataaagaaaaaaatttttttgagatggagtttcactctgttgcccaggctggagtgcagtggcatgatcttcgttcactgcaacctctgcctcctgggatcaagcaattcttgtgcctcagactctcaggtagctgggactacaggcatgtaccaccatgcccagctaatttttgtatttttagtagagatgagattttaccatgttggccaggctggtcttgaactcctgacctcaggtgatctgcccgcctcggcctcccaaagtgctgggattacaggtgtgagccactgctcccggcctaaaataaagaatttaaaatgcaagtccaagcaaccaagatttgttagcatacatgactggaagtcatgcaccacttaattaagtgcctcatgaagtgggaagtgcagattatgggtatgaaacagcacgagtgctagaattgtttaaaacaaaagtcagtggttataacaatgagtatttctgtctgtttataaagatgtgttggttacgagttttgttttttgtttttcgtttttttcgagatggagtttagctcttgttgctcaggctggagtgcaatggcacgatctcggctcactacaatctccggctcctgagttcaagtgattctcctgcctcagtcttcggagtagctggaattactggcacacaacaccacagcctgctaatttttgtattttaagtagagatggggtttcaccatgttggccaggctggtctcaaactcctgacctcaggtgatctgcccgcttcagcctcccaaagtgctgggattacattttttttttaagaatttatttaataccctaaaattttatttaaaacattccataataaaaaatgtaaagatatatcaaatgctcaaggataaaaataaatattaactgcaatttgggatggttgaatcatttttttctttaaaaactcagattagccaggtgcatccctcatacctgtaatcccagcactttaggaggccaaggcgggcagatcacttgaggtcaggagttcaagaccagcctggccaacatgctgaaaccctgtctctactaaaaatacaaaaattagctaggcgtggtggcgcacacctgtaattccagctgcttgggtggctgaggcagaagaattacttgaagccaggaggcagagattgcagtgagccaagatagtgccaccgcactccagcctgggcaacagagtaagactccatctcaaaaacaaacaaacaaacaaaaatcctaaacaaaccaaaaaaacccctcagattaatcattcatattgtaaaactccagtgtttcttgtttccgtttttttgtctttgtttttgtttttgagacagagtcttgctcttttgcccaggctggaatgcagtggtacaatcacagctcactgcagcctccatctcctgggctcaagtgatcctcccgcttcagcctcctgagtagctgcgactacaggtgcacactaacacacctggcatatatatacatatatatacacacacacatatatacacacatatgtacacacatatgtacacatatgtacacatatatgtgcacatatacatgcatatatgtacacatatatgcacatatatacatatatacccccatatatacatatatacacatatatacacatatatacatatatacccatatatacacatatatatatataaaaaatttttttttttgtagagatggcattttgtcatattgtccaggctggtttaaactcctggggtcaagcaatctgccctccttggcttcccaaagtgctgggattacaggcatgagccatcccacccagcccagctccaatatttcataggcctcaaaggtaatggtgaagagtctcagactgttacaacatttctaccttttatgcctgtgcagcaactcaaaaccatcacattcttgtatctgagctgagattttttaataattctgtgttgtaaaagtggtatcagaaacagtccaaatgatcaggtcttcaacaaatagtatatgcagcatatttattggataagttatttcaaaggatagaatttttggagaaaaaaagtattacatggatcactggtagggaagagatcctacaaccctggcccctgtttggcattatgaagtgtctcctagataacagaataaatggagaggggatgctggctttgcttccactgcaaatcctcctgagagttagctgtttgtggacaaatgcaagaaaacaagaagacaagttttaatatttgatttaataagtgaaatttgcaaacctaagtgacctgcttttgttttccagcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataaactaactgcaaatcactaaaattctttcttgttcttctataaaaaaagaagctttccaggctgcacagtcaggctgtaggttgcagacagagacaagcctcgaaggagttgagtgagggtccgaggtttctgggaaatactttatttctcatcatctcgagcccaagagttggacttctctctctctgcagaacaaagtattagctcttgttgcttagctaatttttctctgaagagtgtttcactctccagatcccactacctccctaagccactttctctggggacctcacactcttggagtcatgctcagaagccctgattttaccccagtcccatccatgctgagccctgctggttatgccaggctcctctgggttgtctttgggcctccccaacgtgtgcagggcccagaccagagccagccagggaggggaggcctgcaaagcaaggtggatcctgtctggattttaaattttgagttttatttgtcgttcatggatgttggcattaattttgaacttttaaaatattgcatgaaaatattacttaccctgatgactgagtttgctagcatagcgacaccttaaattgtgcaacttttctcagtccagtctctgccagtgggtccatcctcccctgccccacagtgagctgcaaaggcaatgagggttgaggggagtgagtgtgctatgcagggacccagcacagaaggggatgtttaaatggaaccggggtctccatcgtgtcctgtccccagcactcctgtcaccagggttaggttattgcctgtcccttttccttctggggctatcccctcacccaggaagaccctgtctatgtgtctggacaactcagcttcaccagggccgactcttccatcaggcaaggcaagggcagggatccaggcccacaatatacataggggtgtatgaaaatgttataatttaaagaataatttcctgaagtgattgtaatattaatgaacatataccaatgaatctagcctgaattctatacttcgtcttaccaatacagttgtaaagtatgtttaaaatgttcttatgaagaagtggcctatgaaggcaatgtaatacctgtgacctacaaaagccatgcaacagatgataaaatattgctgttttatttggactcagagacctatcctcaaaccctcaatcttctggccaaagtttaggtcaaataaggatgtgatgtgtcaacttgtaattcaatatgtaaatgacaaaaatctagtttctcaagaagagctggactatattcttttttagagacagagacctattctcctttttccctgaaagacaattaggaaaaaactcaatcaaaaaccccaaaataaagagtcagaaaagccagttctcatgcctaaagactccagcacatgggatcccctagaccatcttcccctgctgaatgctcttaacccttcccctcagacagcccttctgtcccagatcctgccccagatccctcccttgctcacattattcctcctccttacaatccagattcctgggaatcatcatcccatgagcctatttcttctcagcccatgtagcctatttcttctcagcccatgtatccttccctaaaaagactccagcattagaaaaaacaatataaaaaggatattcaaaatttcccatttccctccacacctaaggagtcagccccaactctcttccccttaaaagaggtgccacaaggagatggaactactgactttgtaaatactcccttaaccagtttggaggtctaaagtttgaagaagaaacttaagccattgttatatgacacttacagagtgacagatcaggttgatcagtttttgagacctcggttacacacttgggtcgagttaatgtccatcctagacatcctcttttcagggaaggaaaaaaacatgatccctagggctgctatggcaatttaaaaatgtaaatatcctcccggtcaaacattcctaatgcagatcgaaagttttccaccca

SEQ ID NO: 14296 - DNA, 68720 bp, Human
cctcaaggcaatcccaattcaggtgaaaagctgttcacgtacatcatccaatgacctaaaaatagtcttttatgtaagtctctaagtatttaattcaacgtatgatcttaccacattcaacagaggcagaaaaaaaatgaattaggttttctatagcaaggccaataaagatgaaatcatagttttcctctaactcatcactaccccctcaacgtcagccttccaataactccattccacagctctcaaattcctgaacttggatctttaaaaaacaacgaatcgcaaaaagtaacatttaacaggccagaggcaggcgggggaggagggtctctcccggtgctctcagcaatctttaacgtagccaaaggaggaaaaaacgaaatcaagctcccagacggatggtgcatgcgacgagaggggagggggcagacgcggttcagacggcaagtccccatcgaaggaggaaagaaaagttgcaagaacggattggtcaaagggcagaaaagaaaaaaactgagcagccgaaccactcacaacccccaaacgaccccgccagcccacacgttcgcgggctccccagccgcggcgcgaagggagcaggcagggagccacccggctccgtcccgacgctgccggcgaggctgcgccgatgctcccgggtgcgggagcgggctgaccgtgtggacccggcaggagccagagaagcccctcctgccccggcctccccgcgtccagctcctccaggcttcactttcccccgcaacctcccagccgcgcccgggggcgtccctcgcggcaggtcccaactttccttcctctgggggcgtcgcgctccagggccgccgccgagggagggggcagggccggcagggggcgcgcggcaccggcggggcgcgggggtggccggggagctagtagccgcccgggcgggacgaaccgagcgcaagagccccggcgcggcgccacccagaacccgcgccgccacccaagaacccgcgccgccccgcccggattcccccgggtcagcgccctcaacccgcggcaaccctggtcccacagacggcgcgtgagtagaagacaaccgagcggacgcggacagccgggccgctgttacctgaggggcgcacacgccgccgcggcgaccaccatcaccgtccgtcccgtccccttcctggtgaccacggccgccgccgccgagcaactgacactgactaacaacaactaactaactactcgccgcggccgagtccaccgcgcgctcccggccgctcgccgcccgcccagcccaccagcctgcccgcctcctctcggccccgcgctccgcccctcccgcgcgcgccctcgcccgctcgccgcgctcctggagccgtgagcacgcgcgcgctcacgggccccggtcgtctcccaggtctccctcagccccagcgggaggagtcaccgccaggcccctcctctctgccttccaacctccagaggacgagacctaaagggtgcctgattggctgcggagggcggggctaagacaaggggcggggctgccgagaccttgggcccgcgtgagggaaaatttgggttcgattaagccgcagaggaaaagaccaggggagtctgggcccatttgggcgtcggggcccgctaggtcagccgtcatcgaatacagaatatgttttcgaggacgctaatatgtagtcatgaccaatttcagttcttctactttctgcgggccttcgcaataaaaaaaaaaaaactacatctcccagaaacctccacgaaaataaggctcaccttgcgtaaccacgtagtccttcgccgcattggggcaaaataatcccttcatttttgtgaaggtaccgtggaaaatatttcatttttcttctcaccggagcaattgtaaatgctatgcggtaagaggagttacctgtggaaaggtggttaagagattaggtaaagaaaaggaaaggacaccaaaataaagtgctgcggaagaatttttgtccagctgtgagacgacgagtgcgtgaagtgaaggcgattgagaggggctgagggaattgtcctctgtggaagggactttcttttggccctaggccccttcctgcccctgtcgtcagcaggtcagtaagcaaggcgagcttgggggtggccccagtcgagatgcccttcaccccttgaagatcacccctcttttggtggtggtggtactggtttgtctcagttggaggccggctgaatgggggcgcctcaacttccggttgggggaggggaggaaggccgtcctggggaggggggacaccctcacttcctgtgggggggtggtgatggtttgggggtgtccgacccacttccagtgctggtgagggcttgaaaaggtggtgcttggtgccattcgcggagacattatcttgcagcttggggattgtgttttatgtgaaaagttagattattccaagttgtgctgaacaccaacctgcagtcagaatttatgagtttgcttccacgtggaatatggagcatttcctccccagcaaaattgtctgtgttttcttcaaagaattcgaaagcccttgttaaaaatctctatgcacctttgcaagacgacatagcttgtgtgactgatgaattgccaacacctgcacccctactcaagtccagccttggctgggtgaagtgtggtgccctctgccttgacatgcaacaggaaatctagcttctcttttaaggagataactttttatttaggggactgaatattttacataaaatctggggcattttcatcttagcagaatgaaagtatcacactgaagtactcaaatttgaggttaccttaactgataaaattgacatcttaaattattaggactgttgattttgggctacaggttttgccctgtgcctgagaacagcttcttcagccttaaaaattcttatgtgtagcttacacgtaacatttttgaaagttgtattttattacattttcctcctttgtaatttaattcatcactgatttttaaatggtatctgttctttgtggttttaaagtataaagcaagggtcatgagactcagctcagattctaaacaggaaaaagttggctcacaaaggacaaaaggtcaataagaactttctggttttcagtagctcatttttaataaactatatgtgaggcggtaataaacactcaataattttgattccttggttctgttgtcagataacacaatacttagaagggtgtgtgtctgtgtattgaaggaatcaatctatttgaagcttactttgtgaaatctgaatgttagtaattttagtatatatatcagtgaacctagaactgtattgtcttgcaagaatttttgaagtaataaggcctgtgtactttttcttttgggattgtacttaatctagcctcagactctgcgattattttaattctataatagtttttttaaaaagctgtttggtcacgcctgtaatcacagcactttgggaggcctaggcgggcagatcacgaggtcaggagttcgagaccagcctggccagcatggtgaaaccccgtctctactaaaaatacaaaaattagctgggcgtggtggcgtgcgcctgtagtcccagctactcaggaggctgaggcaggagaattgcttgaacccgggaggcggaggttgcagtgagccaagatcgctccactgcactccagcctgggcgacagtgagactccgtctcaaaaatagataaataaataaatagctgtttgggttagggttcattagaaaatatgttttaaaccaaatattacagtaaaaaaaaatacatgttttaatcttctgtggtcacttttaaaaaagaatctaagaccctaaaatcaagtatgatttatattttgaaagaccacacgattgctgcagtagttgactgaaaaagcaagacaaaacattgtctttgtggttattaataggttaggaacatgtagactgcccgaagtaagaattaattgattaaagaagaagtgttcactatcttctatattaatgtaatatagaagaaaatataatatggtcaccctgacaaatgaaactgtagtgttaggaattattgaagtatggaaagattgtagaactaaatgaaaaaaatagagaatatcatgttaaaatactgattgagatagagtaatattgccttttggaaactgtctttattaaattggtctttatggtactccatggaagaaatacagtataatagaaataagaaaaattgttgcagctgaaagacttgagcagcttgaagaactatctgtttagaagaaagcaatatataaaatacctatctgaaagaaggtattttgtgataagtggcagttattcattggttccatcaaagaagaaatattagaaaagcttgtgaaaaatagagagggaaggtccatagaacctgtttttattctttttaaaaatgtttctttagagaggcttgctgtcctccaaaggtttttttttcttaatgccctttgtgcagttttctttgcatgtttaatagaaatatagtatcaaaatttaaagaattaatatttttgtacatgtactgttacttcaagttaatgaatttgagatttcattccattacttgccatatatgtaacaaagaaagtgtcaaatctttttttcaaatacttggattagataaccattttcttttccaaagacagtcattggatacactgctcacagcagtttgaaatattaaaaccgtaggtcacaattctggattccatctgactgaaattagattatccacagagatgttatacataatacagaagtgtcttttcattctttcatctactttactttgtaaaatcaggctaatgttttgcaactgttgctttccttgtttgtcgttttggtggtggtttgtttttgttgttgtttttgccgtagggttgaggattaaagaaagtatcttaagaacctgaatggtttttcaccttactgctttgctgtctctatttcatagccttcacaggtattcaaatgagaataccctttacgtgacttttcattatttaagcaaaagtttagagtgtctactatatgccagtcactgttctcaggactttgaatacagtaaatacggccaaatattcatattctactgtagtttactctctaatttacaaattaaaactagaattttgctcccttggtattcctaaataagatctatgttatgatcgttgttcagactgggtaaagaagcagccctaaacttgatctctcctggtcttaatctctaagccattctaaacccagatttgaatgtttcagcctaatttttctccagaccatagaagcccctgtgttaaatatgcagtccctttcattgatacatgtatcattttcctaccattctagcttcttttgtattgtgaaaacaaatgagagtgaacagtggggaaaatatgggatcagataggcccaaattcagcactggtctctgcattttactggctgagcttactagcttggtaaccatgagcaatttatttgacctccctaagcctcagttttcctaaatccaaatggggttgtttggtggaatcagaatgttgtatgtaaatctcctggtccaatgcctggtgccagaagcttcattaatgcaattatcttacccccaatcttgcttctgctactctggctattgtgatttgcccacatgtctgttttaagctttacattttccccacagtatgggatgcagtggtagactgactgagcttcagccttgtccccctatcagcatgctcacatagttgtcaagatttaattttttttccttgtgggaaggagaaatcactaatttccatgattagaagatatacaaaatagaaaagtttcaagaaaaggaatcttaatcttggcacaaatcactaaggtaatttgaattgttacaggcagactttcaactcattctcctaaacttatttaaatacgaaaaccaaaaatgacctttcacactatgatcatacctcacattattcatctacacatccaaacgggatcgcctctggggggaaaaaaatctgtactgcacccagcattaatatttttttttgctcatgctattttctgcctgaaacactcttttttcctaggaatccccatctatcaaaatgccactttctttgaggtcgtttctcaagtaccacatttaagaaatattttctgatatccatcctcttctacactctcccaaactgtacacgttctgtccattaactctccagagcattatacctttcttacagcacttactgtccagtgctcctcttgtttgtttttattgcgttgttgtaggtagagtttatgccttccctaaaaggctgcagactaggtcttattccactctgtgctgtcatacctggcacaagaccattcacatcataggtattcagtaaatatttgtggacgtgagctggctcttggagtatgacaaaactgatcaataacttttgtccacaattatgcccagcatcagcacaatggctatcatacattagacactcaaatatctataaaatgaaagagtgaatagtaagtcatcattctctcatttgggagcttcttagggtgtcagataagcatatattaagcacctcctatataactggagctgtaagaactgatctctgctcctcaatttaattggaaaaaagtaaattgttactaatatctgcagactttgaagatggtaggtgtttgagtagggatggcatggagagcttaatatagaattgtttgcattgtgagagataccctctgctacctgaactcagaaaccaaatagatttttatatcaaatatttggacacttaacttgtatttccactcctaggtatatatccaagagaacttaaaacatgttcacacaaaaacttgcacacaaatatttgtagcagccttatttgtaaaaggcaaactcaaatgtccattaattattggatgactaaacaaaatgcgatatagccatacaatggaatattattcagcaacaaagagaaacaaagtagcaatacctgctgtaacatggataaaacttgaaaatattaaagtgaaagaagtcacatacaaaaggcaacctattatgtgattccatttatttaagatgtctagattaggcaaaactaatagagacagaaagtacattagtggatgggaatgggagtgactgctagtatggagtttcctttggaagtgatgaaaatgtgccagaattagatagtggtggtggttgcataaccttatatactaaaatatcttgtatactaatatacagttgacacctgaacaatgagggggttcggggtgctaacccctgtgttgtcaaaaatccatgtataacttctgactccccaaaaagttaactacgtaaatagcttactgctgactggaagccttaccaatagcataaatagttgattaacacatgttttatatgttacatgtactatgtactgtattcttacaataagctagagaaagaaaatgttactaagaaaatgataaggaagaaaaaatatgtttactatttattattcgttaagtggaagtggattatcataaaggtattcatccttgtcatcttcacattgagtaggctgagaaggaggaagaggaaaggttggtcttactgtctcaagtggtggaggcagaagaaaatcagcatataagtagactcatgcagttcaacccatgttgttcaagggtcaactgtacaaaaaaaatcctgaaatatacactaaaggggtcagttttatggtatgtgaattatatctaaaagagagagatacttagacttgaagaatagagaattttgaatggagccagaagaaagaagcaagaggtgtgaaagcaaggaaatgatcattctttctcagatcctagagagaaatataagcagctaggtacagggctaaaggtatgttaaggatcaggtgaggatggatatgaggatagcttctgggtttttgtcttaatgtagcagggattttggtaaatacttagactacagaggtattaacaaaggagaaaaacatcttatgaccttgaaggaagcttcagatttcttcttgattaggtcaaggatgtggtatatggtctttttggtttctgtgttacggtcagctgagtttaaagagtgggagtattctaaggtaaggagtctagtagcaatcaaaacaaagttactggggaagatgggagaatagagactagacaaagatgttagaatttgattctaaagctctcctcaggtaataaaaatagataaatcttaatgagaaggaaccaagggcagtgatttggagaagtcagtacaaataaaggtattcatttgaagaaatatttgagtgccttttatgtgccaggcactattaaataaaactatagctattttccttatttgactttttttctgaagataaaatcttatgagtgtgattaatggttctacaagcatgggtagttctagatatgatacctacatttccctaaaagattgtactgatttttaatgataacagcaatgtataaggatgttgttttcaccacgattttaccagcaaaaatatttggctagttgaacacacataaaattattgttctctttgcttataatctgataagtgtttccataccttggaacctggatctgttggaacatgaaggaattcaggacccttatacatgttaccccatatggcttctttaaaggatatggatttttgaggatcctagaaatcaaaattctctaattttattcagctcaaaaaaaaattttattcagtgctgctgtccttattttctgaataatattcagattcagaccacactgagccataattccaattcccacttgactaacatttatgtagtattgtgctaggcactacatgttatcttaattctaataatttggcatttttccatatgagaaaaataagatttagaaagattagattacttgcccaaaatcacttaaccagtaagtggtagagacaggatttgaatgcagatcctctaaggccagtgtttattctcatactgcatgatccctcagtatcactactaaaatttactggaggataatggaaagtggaaaatctgaactggaacttgggacaatcaagcactgacttacctgtgttcataatgaagcatttagcagagatgttgtttgttgttttgttttgtttttactggggaggctatagtacataaacagagcgaaagatcttggtatggttaaacccacattttcaaggccttctgtgttctccctgatgatcaggtacctactaccccaaaatctgtgatggtaacaaagaaggaggaaggcagctgtagaaaagcaacggcctttgggtatacccagtaagatttatgtgattgtagaaagagcaggcaaatggcttggccttcagagaatcccacaaagtaaagtaaccttttaaaatagtaacttaaagtctgacataagattcttaacaggatattcatcacaagataagatattcaaagcatagcgtgtaagacattcaaagcatatcagcaaaaaaggagagattccttcatttttattgaagtatggtatactcacaaaacaaatttaatatcaggaatataaaacaagagatacgatgttccaattctggctttagtcggatattataaaatttaatcccaatttatagataaggcaattcaaggctcgagattacacaccaaataagtggactctaggctgggtgtggtggcttctgtaatcccaacactttgggaagccaaggcagaaggatcgccttagctcaggagtttgggaccggcttgggtaacatagtgagatgctgtctctacaaaaaaataaaaaatagccagacatggtggtatatacacatgtggtcatagctactcaggaggctgaggccagaggatcgcgtaagcccaggagttcaaggctgtgagctgttatcgagccactgcactccaacctgggctacagagcaagactctgtctcaaaaaaaaaaaaaaaggaggggggagcctctagaacataggcctttaatctgtgtggttgttttgcaatttatatgtataatttttaaataatatgttggccgggcacagtggtttgtatctataatctcaacactttgggaggctgagacaggaggattgcttgaggccaggagtttgagactaacacaggcaacatagcaagaccccatctctactaaacaaaataataataatttaatatggtgggtttttttgttttttttgtttttttgagacggagtcttgctctgtctcccaggctggagtgcagtggcgctagtgagctcatgcaattctcctgcctcagcctcccaagtagctgggattactagcgcttgcctgcttcaaaagaaatgatttccagcaccccattttttcttttccagcctcaaaattcatatctcctttttttcccccatgtccacatgtccttcattcctatacttcatagctttaattcctgttctcttgatacaaaccttcatgtttgttgcttgatggcatcataattatcataactttttggcttaataacagtagcagttatatcaacaaataataaaatgttcatacttttgagccaataattccacatatagaacttcattctgagaaaatactttaaataagaaaaatagttaaaggcacaaaatgttaatagcactgatatctatactgtctaaaacttgaaaccttctaaatattcaacaatataataatgcctaagcaaattattgcctatctactcagtgggctgtaagacattcatttttcacaatagcgtctttaagaatacattgaaagatgttgtaagaatgtttttgcaaaaatgaaaaggagaaacatcagaagaaaaagtagaaaaactaatgtgattggtgtctatttctgaagcatttatattttctatataataataatttacatttactgaccacttacttgtgtcaggaacaatactcaagcaacattatagaagcaacaatttgtagttattgaaaactggtgttctagaatcaaatctgagcttcatcacttactaatatgtggtcttgaaaaggaaatggaggataactatgtctacattaaattattaaatctatataaagtatttggcacatacaaaacctacaataagaatgtttttgttatcagacattttataaatatgtctcatttaatcttcacatcctcacagtaacctcattagatagtgttaacgttcattttacatgaaagaaaattgaaacttcaaatgtttaaatactctaggttaaataacttgccgaatcacttaactaataagcagtagagtttttattcagagcccaagctatggtttccacttatgactctgagagatgaggttgctgcagactaatgcttttgctaagaacaggaaagatgagaattaaaaagaaaagtgaaggcatcagagacctgctgaggcatccaggacttaagaaaccacaaccatagaaccaaaggagcttcagagaagtgggctgatgttccatgcttctcttttttcctaggaatttgctaattcttagagcatgacaagatgctgtgaaacttagcagagggtttcttctaaaagcagagaagctgttagttttatggggcggagcagacaaaacttggattttagagatctccaggtagctagttcttgggtcaagatccctagagaaggacagtacccagaaacttttttaaaacttgttttcccctcacagtgtttgctaggcagagtctagaactgtaagaaagttaatttgtattgctttaagccaatagctttggataacttgtgacagcaacaatatgaaactattacagagacatgaggaaatgatgaagaagtctaacatacatatgactggaggagagaaagttagaagcagtaatattttaagagacagtgattgagaattttctaaaaccgatgacaaatatcaagccatggatttgaaaagtgcaagaaacgacaagcagaataaatacaaggagtaccacactttcattcttcatagtaaaaataaaactgttgaaagtaaccagaggaaaaaagacacataatcttcaaaggaacaattagactgacatctgacttgtcaacagaaataatgggggccagaaaacaatacaatgtaacttttttgtttgtttttttgcttttacctacttggtttatttattttttattttattttattttattttgagatggagtctccctctgtcacccaggctggaatgcagtggcgtgatctcagctcactgcaacctttgcctcctgtgttcaagcgattctcctgcctcagccttccaagtagctgggattacaggtgcatgccaccacacccagctaatttttgtatttttagtagagacaaggtttcaccatgttggccaggctggtctcgaagtcctgacctcaggtgatttgcctgccttggccttccaaagtgctagaattacaggcatgagctaccatgcccagctggttttttttgtttttttaattgacaaaaattatatgtatttatcatgtacagcatgatgttttgaaatatgtatacattgtggaatagctaaattgcgctaattaacatatgtattacctcacacaatttatgtggtaaaaacactgagcatctactctcttagcaattttcaagaatataatacattgttattaactatagttaacatgttgtacaatagatatctcaaacttattcctcctatcaaactgaaattttgtgtcctttgaccaacatcttcccagccccaccccacccctggtaactaccattctactctatacttccatgagttcaggttttctagattccacatatgagatcatatggtatttgtcagtgccaggctaatttcacttaacagataatgccctccaggctcattcattttgttgcaaatgacaggatttccttcctttttttaaagctgaatagtattccattgtgcgtatataccacattttctgtgttcatctgttgatggatactgaggctgattccatatcttggctattgtgaataatctggcaataaccctgagagtgcagatatcttttcaacatagtgatttcatttcccttggatatattctcagagaatgcaacctttaagttccttaaagaaaataactgccaatctagaaatcacgatggcaattagaacacatttacaacagcgtgattatgaaaatacatgtgaatcagttaaagatatactcaatgaaaaatttatagccttaaatgcatatattagaatagaaaaaagtaaaaaatcagttatctaaatacccatcaaggtaggaaaagaacagcaaattaaacccaaagtaagtagaagaaaggaaataataaaaaaatagaaatcaatgaaatagaaaacaaattgttggccagtcgcagtggctcacgcctgtaatctcagcaccttgggaggccgaggtgggtggatcacctgaggtcaggagtttgagaccagcttggccaacatggcaaaagcccatctctattaaaaatacaaaaattagctgggcgtagtggcaggtgcctgtaatcccagctactcaggaggctgaggcaggagaatcacttgaaccctggaggcggaggttgcagtaagccgagatcgcgccattgcactccaacctgggcaacaagagcgaaactccgactcaaaaaaaaaaaaaaaaaaagacaacaaattggcattaggaaataacaagaccaaaagttggttccttaaaaagattagtaaaatgcatagacctctagcaatattgataaagaaaaaaaaaagagcataaattaccagtatcaggaatgaaaagggaaaatttctttacagattctacagatgtcaaaaaggtaggaagatactatgaacaaccttacatagacagatttgaaattttagatgaaatggacaaattgttaaatgctttattaaaattggcatataaaaaattgacatgaagaaatagaatatctgaatactgtttttatctgttaagtaaattgaattcagtatttaaaattttggctgggcatggtggctaatgcctgtaacatcagcacttcaggaggccaaagctagagaatcatttaagtccaggagttcaagaccctgtctctacaagaacattttaaaaattaaccgggcatgatagcgtgcacctatagtcctagctactcgggaggtaggaggatcggtttaggctaggagttcgaggttacagtgggctgtgattgtgccactgcactccagcctggatgttagagaccctgtctctaaaaaaaaaaaaaaaaaaaaaaaatttcttcaaagaaaaccaggtctacctgacttcactggtgaattcttacaaatatttaaagaagaaataaccccagtgttactcaaactcttcaatagaatacaagtcgttttatgagatcatctaagccttaatgccaagagctggcagtgatattttgagagaagatatttacagagcaatctctttcgtgaacctaaatgtgttacttgggaatataggaactctaaaagaatctatagacaaactattagaattaataagcaaacttacacgagcaaccaacagttagaaagtgaaatttttaaaatgccatttacaatagaatcaaacaaatcaaatttaagtcttgtaagatctttacacagaaaactataaaacatagagagaaacaagatataataggtagtcatagattggaagacttggtattgtaaagatatcatttctctccaaattgctctatagattaaatggaatcctaataaaatctcaggtgatttgtgtacatgatggaaggagggacttacaagttgattctaaaattcacatagacatgaaaaggactaagtagtcaagacaaacttgaagaacaaagttgtaagactttatcagataacaggatttattataaagctacagtaattacaatgtggtaatggcgcaaggatagacagatctgtggaacataattgagagcccagaaacaatcccatatgtatgtaatcaatttatgacaacagtagcatccaccacagtaggggagggatggatttttcattgaatggtgcctggttttgtgtggaaggggcagggaatgaatcttgaacccttacctcacaacatatacaaaaatcaggtctagttggattatagagctaaatgtgaaagaaaaatttagggagaaactggaaaacacctttatgatcttggagtaggtaatgatccgaaaaggaaggagtttatgaaattaaaaacttcataaactcatgaaattggagtttatgaaattaaaaacttcataaactcatgaaattggagtttatgaaattaaaaacttatcttcaaaagacattatgagagtgaaaacactagtcacagagtgagaatacatatttgtaatacatgtattcaacaagggacttgtagagctcttacagataaataggaaaaaacaaataatcaaattttgaaaaggacaaaatacttcaataggcactccacaaaagaaactatccaaaggccaatatgcacccagctattttatttacattaaataagtgcaaattaaagccacagtgagatacttgggacctctcagtatcttgaggcctctcactacatccccactgaaatggctaaaattaaaaagattgagaatatcaagtattgatgatgtgaagacactgaaactcatatgtttctggtaggtgtgtgtatttttacagccattttggaaaacaatttggccgtatattccaaaggtgatcatacaccctctgacccagctgttcctaggtatacacccaacagaaatttatatgttcaccaaaagacacaaatggacaagaatgttcatagtagcatcattcttaatagcccaaatgtccatcgaaatagaatgggtaaacaaatgtttcttgtatctacatggatgatcaccaagcataatatcgagcaaaagaagccagataagtgcatgtaagtacaaataattacatagtatatgaataaagttcagaaacaagcagaacaaatcttagaagtcatagtaattacttttacagggatagtgaatgggaaggggcataaggtaggggatttctgcttgttgtaatattctgtttattctgataaggctacaggtgatacagtctatgaaaagttgtcaagctgtacacttaaaatttgcataatttttgttttatagtctatttattttggagacagtcttctctgtcacccaggctggagtgctgtggcgcgatcttggctcactgcagcctccgcctactgggctcaagcagttcttctgcctcagcctcccaagttgctgggactacagatgcgtgccaccatgcctggctaaattcttttattgtattttttttaagtagagatggggtttcaccatgttggccaggctgctctcaaacacctgacctcaagtgatccgcccgcctcggcctcccaaaatgctaggattacaggtgtgagccactgcacccagccatttgttttgtactttaagtttacttaaaccctccactccctcaatgacttgaaggactgtattatttttctctacattccctatacacaaaccatgtaggtggtatgcttctaccccaccattccatcaaaagggctctactaggttactaataacttccatgttgtcaaaaaacttgggcatcttttacattctcatttaacctcagtaacatgtaggtgcatcttttttttttttcttgagatagtctgacaccacgcattcctggctctctgcctacctctgttcatgtcctttttgcagttcctcctctactcatcttctaactgttgagttcctcagaacacaattctaactccttttaacctattatctctcctgaggttatatcatacattcatgctttaaaatactatctactatacttgctggaaactcctaaactcctgtctccatctcagacttttgttctgtatacagagtacaacttgatattttatctcaaaggcatcttaaaatgaacatgtctaatcttaatactttttctacttctacatctcgagtattccttatctccataaatgacaactcagtctactaatttcttcgttaaaaatcttgggctcattcttgagacctcttactaatccccttacccgttcaacacacacacttacacacccccctatccagaccactgcaagattctattgattctacctcctaaatatatctcagatccaccctctttgctacatctccactgttgttatccttttctaagccactgtcatgctatggtggactggtggactattgcagtaactacttccctactgatctttatagatccattttcttttttttttttccctcccccaagatggagagtctcactctgttgcccaggctggagtgcagtggcatgttctcggctcattgaatcctctgcctcccaggttcaagcaattctcctgcctcagcctcccaagtagctggggccatgggtgtgcaccaccatgcccagctaatttttgtatttttagtagagactggatctcaccatgttggccaggcttgtctcaaactcccaatctcaagtaatccacctgcctcagcctcccaaagtgctgggattcaggtgtgagccaccacacctggcctctagatccattcttacacatctattctttacacagaagtcagaatgaacttttagaaagcataaatgtcacatcatgcccctccttaaaatttctccttaaaattcctcagaggtttactcttatactttggggaaaacccggatttctgacatggccccagatctgttctggatttggttcctgtctacctgtctttgttgctttcctctctggctcatttttctccagccacaagccgcctttcacttcctccaaagcatcaagttctctctcacctctgggtcctaataagctaattcctcagtatgcaatgtgcctacttaacatttagctctcaggttatgtgttccttcttcaaagaggtcccctgtctaaatgaagtctcccctgttattctatagctttctgttcttttccttcagagcattttaaacaaatttaaagtttatttattggtatatttgctgaacgtctttcatctccaactgtagtttttcatgagggcagagacaatttgttcaccattgtattgctggtatcttaaccatgtacctggtacatattactgaaaatatgtaatgaataagaaaatagatcatgccatcctaggtaaactataggtcgggaagtacttcataggtgtgtgctgtgccctgagagcatgaaggagttgcttgtttcctctggtttttgatgtttttgaagtttttgatgattagtcttctcagtgctaagctaaattggcagtgtgtgcagattttatttaagcccccacagaggaatacacctacccacattttttagattgaaactttttttttgttttttgagacggagtttcactcttgttgcccaggctggagtgcggtggcgtgatctcagctcacagcaacctctgcctcctgggttcaagcgattctcctgcctcagcctcctgagtagctgggattacaggcatgcgccaccacacctgactaatgtttgtatttttctagtagagatggggtttcaccatgttggccaggctggtcttgaactcctgacctcagatgatctccctgcctcggcctcccaaagtgttgggattacatgtgtgagccactgtgcgcagccctaagttgaaactctttaaaagtaaagatagagagttctcaatagcagtcttgactaaataactttgtcttcttttctagaactgcaattttgttcgtttttttgagacaagatctggctctgtggcccaagctggagtgcagtggcatgataactcactgcagccttgaactcctaggcaaaagtgatcctcccgcctcagcctcccaagtagcttggactgcaagctcataccaccacaccaagctaggtttttagttttaattttttttttttttttttttttttagagacaggatctggctatgttgcccaggctggtctcaaactcctgggctcaagcgatcctcccaccttggcctcccaaagagctgggattacaggtgtgagcgactggacccagccaaactgcaattttaaaaaaatacataagggccctacaaagaaaagttagtctaatcgcatttggttactcctgagatttacaatattgtttgtaaatattattaactattttagtcacataaatatgccataatgcaaccacagtaagtatatgacatgtcttttaatcagaataatcagaataaagcaaaaaatgaccatatttcacaatattaatgtattcacgtgttttataggttatacacatctattatgatttgatattacaagatactctgcattttcttatatagcttgggtttgctttctccatcttagatgtagtttttaattattgtttttgaagctggttttaatacaataagatgcttaattgtacgtttggtagaaaattataagcacaacaatttgaaacagctttcaggctactagcatttcccaaaacccttgaaaaaatgcctgtttactaccaattttaaaccagataaatttcatttcaagagaaaatgttttcaagtttcttttttttttgagacggagtctcctctgtcacccaggctggagtgcagtggcgtgatctcggctcactgcaagctccgcctccctggttcacaccattctcctgcctcagcctcccgagtagctgggactgcaggcacctgtcaccacgcccggctaatttttttgtatttttttagtagagacggggtatcaccgtgttagccaggatagtctcgatctccttacctcgtgatccacctgcctcagcctcccaaagtgctgggattacaggcgtgagtcaccacgcccgtccgtaggtttggagttcattataaagaataactttacaattgtcagagctattgagaagtggaagtagacattcccaagagaggctttcaggttgggggctgagccttggttgtatgattggactcagtgatctttgtgggaccttctaatcttggaattctcatcttaaccaatgctgctttttttcttttactttttaaaactgtggtacatacagtaaagtacaaaaatcaatgaatttttacatagatatatatgtgcctgtgaatattttcgtcactctaggaggctcttcagtcattaccttctctctccccacgagagataaccactattctgatttctgtcactatacggttgttttacttgttattgagcttcatataaatatattcatagaatatttattctcgtgggtctggcttcttggctcatcattatatctatgaaattcatccatgttgcatgtagcagtagttcaatctgtatagtattccactgatttcattgtaggactatatcataacatatccatgctactgttgatggacacatgggttggttccactttgaggctattatttaaaaagctgctatgaacattcgcatacatgtcttctgttggttatatacactcatttctctatgatatattactaggaatggagttgctggttcataggataggtgtattttaacagatattgctaaatagttttccaaaatgattgtccccatttagattcccagtagcaccgtcagagaatttcagttcctctccatccttgctaccactgtgtattgtcatttttttttattttagccattctggtgggtatataatactgtctctttttctatagctattgatcatttggatagtctctttatgaagtgcttgctttgtatttagcccccttttttaaaaaaatgggtcatttatttttaatcttagtgatatttaggagttcttcgtatattctaaatatgagtctttagggaatatatgtattacaaatataatttcccagtctgtggcttgcctttttactcctttaacatgatcttctgatgaacagacattcttaactatagtgaactccaatttgtcacttttctctaatgtggttagtgctttgtcctctttaagaaatctttgcctagcctaagatcatgaagacatttagaccaacaattcttaaattgtggtattaaactagataatagtgaacttttgttggtttacacacacaaaaagaagtaaatggatagaaatgtactgttttctcccataatttattttgaaaccttgggtattaactataaataagtagataatgatgttacttaaatctgaaatttattaactgagaaggtgtcagttaggataggctaggttattgctatttatattgctgtggtaataaacaaccacaaaatctcagtggctttcttttctcacttatgctatttgtccaaagtgagtcaacatggggctatgctatttgtggtcacttagacaaccaggcggatgtaaactacattataatatatacttccacagtcactgtattcaggggaaggaaacatggcaaattgcttatagactcagattttctgcccagaagaatcatatgtcactcactttcattgcccatgagttacatggtccttgtgtcttctctgaggcagtgaggaagtttcctcttatgtttctgaaaggagatctaaatatttttgaatagccatagtgactatcacagtaaacatttgtaagttacttaacccctctgtggatcagtttgttcactataaaataggtgctaatgataatatctacttgatacggcagatgtgtggattaagtggtatcatacacgtatagctcttaaaatagtgcctggtacttagtaagcaataaattcttgctgcaattattgctatcattattgttattaggctcttactatatgatgacaccatactacctgctttatttacacagattacttcttgagataacttctatatagtatgtactattactcttctcatttataggataagaaaaccttggtttggagcttttgactagcttgcccaagttccacagctaatacgtaaaagatgagattggaatctaggcagtctgactccagagccctcagtataaactgagactccctcccagatagcaaataaatatgaacagaattcagaagtgcataccatgcttagagaactctgtgtttgtttgtgtacatatatgtttatggttgtgattttatattgaatttttaatatattcctattttctgctagtttgttagtgtttctagttcatataattaaatatactgtttctcagtattctatgtagtctgacagctaaacaaatttgaagttgattttgttcttcatgaacaggtgaaaaaacttgagccagagtcatttagtgatcccagaaaccagttagttggtagtatatcctgaactcaaagtcagatttcctgacttcgattcagagctcttcctactgcctcaggttgtctccttgtagtttatgcagcatatcatcctttatcaaatatttgagatgctttttgtctccaaattttgagtgaatttgttgtagaaatcacagttaagctttttttccctcatagctcacattactacatcttgattgtaatttatcaactttgtcttttaaatattctaatgttactaaacacccagggccaaattaaatatttggacagagtttctagtaagaataaatgcctccagagaagcttctgtggaaaaatattgtaatgatgagcttgagagtaccaataacttttctttttcgtgtaaggcaatttagagtccaatttctgaaggcacagagatgccagtggaattagagatgaatcaaacacattacattttaggtttatcttaaggtatattggcaagaagtaaaacaacaacttaccaaaagcttgttacttttcctgccagtgacataagaatgtacatataacaacctcagatatattgtaattttcagagttaaacctcttaaggaaatgctgagctcattttcctggtctgttttcccataattaaatggtattcttgtttgataatttcagtgtattttcatgtaacttatctggaaagttaataggacataaattgagttagaacttctcaatatattgctatatagtggagatattcaataaggaagtcacaacacttttttcccctcagtatcaaaatatgtcagttatctgtcaagaaaatgaactgaatctgtgctgtgtgttattgcactcatggggaaatactgttttgaggctacatgatccttgtcctggcctcgtgcaatttaaaacattaattcttgtgttaaaataaatactgctttataaaactgactgcagaatttaagggaatttttaatataaagcatgaggtttataaattgtgcccttactctccctgctagacatgcgtactcttctctgccctatagtcctaattctgatgagagagagaaagaatatatcattagcaactatctttaaggcatctttcagcaataagctagaaactccttgtttgtttgtttttgagatggagtcttgctctgtcactcaggctggacttagaaatccttctaatggtgtttttctggaaaggggagtatggagagtctggcaaaaagggaattttagctctacgtgtagccatattttttttacaaaaaagaaactaagtattgcatgtgaaattaaaatttaattttaaaacatctgtgatccttgatggcacttttcctctttctttaaagtaacaaaaccatactgctgaaggttgagtttaaaacaaagattggaaagtaattattcataatttcaccaccctgacataactactttgaactttttttttttttttttttttttgagacagaatctcgctctgtaacccaggctggagtgcagtggtgtgatccctcatcactgcaacctccacctcccaggtttaagcgattctccttcctcagcctccagagtagctgggattataggctcctgccaccataccgggctaatttttgtatttttagtagagacagggtttcaccatgttgtccaggctggttttgaactcctgactttaagtgatctgcccacctcggcctcccaacactttgaacattttgatgtgtttccttccaatctttgttcttatatatctattttttatgatgatgatgatgatgattattattattattattattattattattattattattaagttagggtctcactctgtcacccagactggagtgcagtggcacgatctcacctcactgcaacatccacctcctgggttcaagctattctcctgcctcagcctctggagtagctgggattacaggcgcccaccaccatgcctggctaatttttgtattttcagtagagacagggtttcaccatgttggccaggctcgtcttgaactcctgacctcaagtgatccacccatctctgcttcccaatactttgaatattttgatgtatttccttccaatcttttttcttatgtatttatttattattattattattacgacagggtctcactgtgtcacctaggctggagtgcagtggcacgataatggctcactgcagcctcaacttcctgggctccagcaatcttcccacctcagcccagcctccctactagctgggatcacaggcgcgtgcccccatgcccagataatttttgtatttttggtagagatggggtttcgccatgttgccccggctggtctcaaattcctaagatcaagcaattcacctgcctcagcctcccaaagtgttgggattacaagtgtgagccaacatgcccgacctgtatctattcttttaatatacttataatccatatactttctcataaatgtttcattgataactttgtaatataatttttaaaatagctttcacattcttttattgtatgcagagcttgtaaagaaatatttgatcctcacggtagccctttgaggtaaatagaataagttttagccccattttacatataagggtattgaagcagatgctcatataacgcctctacttggtactgtggtagacttctgttcatgacagaagtacttgctaacacaggcaaatgagtgcatttaatgttgaaagaacaaaacaaatcgttctgtagattcttattccctggacttagtccttccttcctgggctaagtgaacccttgaacagcactaggcaatgctgaaaatacagattttgtcagattttagtaagtgctctaaacaccaagaatcttgaagtgatataatgaaagttacagctaatgtagttttaaacttgttttttctttgttatttcaccttgaaaaaaagaaacaatcagtagcttttaaacaaaaaagattaaatctaaccacttgttctgaattactatggtagggtgagaactgaggctctgtgtatggaagttgaagttttatcatgttgagtaggttatcaaaggagaaatgttcctaggaaactggtcttgtagagcttaaatgtgtcaaatttgaattctatggctatgtgtaactttctgaagtcctgagcattgttattaggtttcaaaggcaaaatatagcaaaataattctgagtttttcaatttatttctgtttaaactgtaaagcatgttacagttgtgcctattcatcttgtgaagaaaactctaaatttcatcttactgttcagagtagtaaagaccactaactgctttgcctccctgtaactaaagttttctgtcttcagcttttggctgaggaaattcctctgctatcgagcatcctctgtttttcttttaggaaatcttcctaggaagaaaatttaatttgtaagtcagttgattaaaatgaaaaacactttgatgggattagtttccatttattacactatagtttttataaatgttcttcaattttccttctgaaacatgtcatcctttacttgcagtcttcattggcttttgagagggtaaacgatttaggatttattgcctgtaaaaggaagaaacattctttctacctcctctcttcagcgttgtctcacagctgcaggtttgagctgaagagctgtgtaaaatgtaagaaaatagaggaacagtgttccttgaaccaataaggaccctttccctggaattgttaactatgaattttatgtttgggttcagatactagggacctttgttacttctgctttctcatacagtagttcccctttatccatgggggtacatcccaagacccccggtaggatgcccgaaaccatggatagtaacaaatcctatacatatggtacacatgaatttctccttcttcacaatttcacagatttatctttactgtaggtcttagcaacctcagcatttgtgatttttttttccttttgttaagttgggaacttttaccttttcacttaaagaagcactttacagcttctctttggcatatccatactggcagcctcacttctcttctgctttggggccgttgtgaagtaaaataacaccagccctgcgatactgcgacagtcgatccaataacctagaaggctgctaagtgactgatgggcaggcagtgtatacagcatggatatgctggacaaggggaggattcacatcctgggtgggatggagcaggacagcatgggatttcatcacactactcagaacagtgtataacttaaaacttatgaattatttctgaaacttcccatttaatatttttggactgcagttgaccatgagttaacacactggcaaagcagaaccacagataaggggggactaccgtctatgctgattgagttgcttttcgcagactccagccttgaattatattgttttagagctacctaccttagtatgaatctggattttcaaacgtgtaaggacccagagctgtgtggtccttctcaggtgttttctcagctggtgttttctgtttccttcagctctccagtgcatctgtgaatgtattaggataattaacaattaccttagctggttacctaacccattcaattcttctttctctgtttttctcatatatttgaataaataccgttatacacatcagccattaccctttttccacgtcccctactagattatgaactgtaaaataataagtgttgttgggatttttaaatcttatttacctctgtatctttgatgcctaacatagtgacatatgataaactgaaaaacattgtttttcaactttaaaaaaaaaactcgtgtctcctcttgataaatacataaattcccttttctgatataccctgcatgtgaatcaccaagatgtgagtaaaaagtatacatatgtggctgggtgcggtggctcacgcctgtaatcccagcactttgggaggccgaggcgggtggatcacaaggtcaggagatcgagaccatcctggctaatacagtgaaaccccatctctactaaaaatacaaaaaattagccgggcatggtggtgggcacctgtagtcccagctactcaggaggctgaggcaggagaatggcgtgaaccctggaggcagagcttgcagtgagccaagatcacgccactgcactccagcctgggtgacagagcgagactccgtctcaaaaaaaaaaaaaaaagagtatacatatgtgtctttaccaaacaagaacattaactttttgtgctttgtgtacttaaaacaagcttggttttgttttttgtttttttcctccaaatagaaaattgactgtcactgaaaacaccttttcatatatcacaggccttctagagggagtaaggctttaccagcattccccatcccagcttatatggacccacctttttaccgtttcatagtacacccatgtcccaggaaataggggaagtactctacactaaggaaataattccaggttttattggattactttaactcttagttcaggcactggtccagaagttgtcttacttgggcaatcacctccttgtttactaataataaaagcagtgcttagattgcctctgtaggaagggcaacttgggaccaacaggcaccatgaaaaagccaacgaggtggactgtgacctcaaaaggcaacactctgcttgtaaaatgacaaattttgctttggaagaggaagtgttttttattttccctgcgttatcaccgtgctttacaaaaactgatacaaaatactattcttagatgttttggttttgtggagtttttttcttcacaacacattttccgtcctaatattgacagttctccatcaaggttccattgagggggcaaaaggcatatacagtgatccaattgtctagcaagaaatctgaactgtgccagtctcttttgatgatctagtacttctgtggtttttaagaagatatctgatttaagtttctaaatttttacttcaaaaaaacatgtaccatcacataaggaatttggagaaaaaaatcataaagatagaagtttaatttttgtttctaactctggcctctttttctccctttttatttttcgaaaacagagtctctacaaggaagataacggactgtaaaattctataaagcaaagctacacatcacttgacaccatacaccatcttggttacataatgaaggtgatcaacaaatgtttgttgaaatataaactctctaggcatttgcattagatggagcctggattatttcttttgtggccaaaaaaccccgctatatttagcttcaaaaaatttgcaaatagtatattgttagtacaagtcacccttttttactaaactgattacaagactacagttaaagtatatgcaggccacagtttatagattctagtcctgatgttttttccagttattttgaacttagaaactagctttaccttcaaaatatattaagaatctgaccacttctcaccatctctactactgctattctgatctaattcttccagctgttttgttgcagtcgcttcccaaatgatttccttactttcccttttccctctccaccttcattcagtctgttcttaaaatagcagccagaatgatcctataaacttgttaaattttatgccttatctgctgaaaaccttccagtagccccggttagctttcagacctcatctccttttcccactagttcagtccagccacatttgccacctcctcagtcacaccagggggacttctttgcactagttgtttcctctgctagggccactctttcccccacatacatgcatagttctttcatctccttctggtcttttcctaaagattacctcagtgaagcctttcatggcctctgtatataaaattgcagacaccccatttccttgaactgttcctaacctctttccctgccctgttttttcttggtacttcaaactatgtatcattattcattttacttattttatcttgttttttgtctgttccagtacactgtgagctctataagggcaaggatctttgcctgttttggtcattgctgtattcccaatgcatagaaaatgcccaggatagtagataatatttgttgaatgaatggatcagtttctctatagtttggttcctagggtagcctaccaacattttaaaaatcaataataaggccgggcgcggtggctcacgcctgtaatcccagcactttgggaggccgaggtgggtggatcacaaggtcaggagttcaagaccagctggaaaaaaaaaattagctggacatggtggcaggcacctgtaatctcagccactcgggaggctgaggccgagaattgcttgaaccaggaggtaggggttgcagtaagcagagatcaagccactgcacttcagcctgggcaacagagtgaggctcgtctcaaaaataaataaataaataataaaataaagatcaataatagtcataggagcctggactatcaattttaggtctagagagccatattttctgtccacccccaccccagtgcccagccaaacacacccctccttatacccttctcttgaagcagcaagccttatgtttagaccctaattgcctctccctacctcaaccctcccctaaaacctaagtacttaattactcctaaattgcctcttctctctcctcatctttttccctctcatctcacatataaaaacctatggtgaaagagtttttaactgaatttcacttaactgaaccccagttaactgcctggcaggattagccagtgttctcattcacactgtaaaacatattgattaatgtccacagcccactgattgcttttagctaaacgttcacagctggtagactactctctagtaagcctcttttccttcctccagttaaattgtatgcatatcaaagtcagttgtgtttattcccaaacctctttataccagttctctggcataataaaatacataattataatattctaaatatataatatggcaattttaaaatgaatgaatgttatattttagagcgcttttagattcacaacaaaaatgagcagaaaatacagagacttcctatatattccctgtccccccacacacacagcctccccaactatcaatatccctggcaccagaatgctacatctgttacaatcaatgaacctatattgacacataatcaccatagtttacatagtgtccatcactcttggtgttggacagtctgtgagttttgacagatttataatgacatgtatccaccattgtatcacgtagaaagtttcactgccctaaaaatgccgtgttccacctattcatcctactcccctggcaaccactaatctttttactgtctccatacttttgcttatccaggatgtcagataggtggatggattcacaacatatgggttgagtttcccttatccaaaatgcctgggaccagaagtgtttcaggtttcagatcttttcagatttattttttatttatttatttttttatttgtttttttgagacagagtcttgctttgtcgcccaggctggagtgcagtggcacgatctcggctcactgcaagctctgcctccagggttcgcgccattctcctgcctcagcctccccgagtagctaggactacaggcgcccaccaccacacccggctaattttttgtatttgagtatttgcatacacataatgagatatgttggggataagacccaagtctaaacaggaaatccatttatggtgtatccatttaccttacacatggcttgaaggtaattttatagcaatgattttatttattttgtgtatgaaacaaagtttgtatacattgaaccatgagaaagcaaagatgtcactcagccacccacatgtacagtctgtgattgtttggcatcaccattattcctgattcagaattcatgtgctaccaataagaatcattctcttacacttatttgcacataagtacttaacagtaaaaaatgtgacataccattaatacaatgaaaaaataatgtgttcggggtaagcagtacagtagcatcaccagtgcacctgtgccagctgttaacaacaaacaatggcaagttgaataaactaattatcgtgtgccagtgtttttattgtgacccattacgtgaagtcccatgtggaatttttgtattttgtattttcatacaatgaaggagagttcttgttccacatccttgccagcatttggtggtatcagtgtttgggatttagggcattctaataggtgtgtagtggtagctcactattgtatgaatttcctcttgggtcatcaagtgggcactcaggaaatttcagattttggagcattttgaatttctgattttcagattagggatgctcaatttatatagccttttcagattgacttctttcacttagtaatatgcactaagtttcctccatgtctttccatggcttcataactcatatctttttagcagtgaataatattctattatctgaatgtatcacagttcagccactcacctactgaaggacatcttggttatgcccaagttttggcaattatgaataaagctactataaacatctgtgtgcaggtttttgtgtggacgtaagttttccattcatttgggtaaatattaaggtaagaagtgcgattgctggattgtatggcaagagtatgtttaattttgtaaaaaacttcctgtcttttgaaatgtctgtactgttttgtatccccacataatgaaggagagttcctgttgctccgcatcattgtcagcacttagtggtgtcagtgtttgggattttggccattctaataggtttgtagtggtagatcattattgttttaatttgcagttatagttggccctgtgtatccttgggttctgcatccacaaattcaatcagtttggggtggaaaatacagtattcaagagacacagaacctatggatacagggccgactttttgtaatcatgggttctgcagggccaattgtgggcatctacaaattttgagctcgcagtgtactggaacagacaaaaaacaagataaaataagtaaaatgaaaaaagatacatagtttgaagtaccaagaaaaaaacagagcagggaaggaggttaggaacagttcaaggaaagggggtgtctgcaattttatatacagaggccatgaaaggcttcactgagcaaaattgatgttaaagattcaatacttagacatgaatatctaacgtgaatggaaagttgaaaattccaatacagaatatacatcaatcggccatgttcactaaagtagacatgaacactgactctattgtttgaagatagtctcactccttacaaataataaaggagaatgcatatatgaggaaacatttagagaatatattgagtgtcccccagtttcagagttaatccatttaaaagacacataatctgcaaaagtgccttgcttgagcaataaataaatactaattgaatgaggagcctccttcagttgaggggtatggtgtggctttaggcaaagtctggccacaatattatgatgaagctgtgaaatacataattgtatttgctcatcaaatgcatatttaacaaatgcccatgatatgctcaaaaccaggctgggggaaatttaaaggtaaacaaggcactgtttataacctaacaaaacatataactaagggttagaaaagacaagtgtagtacagtgagtcaagtattatgatgggtgtttagtacagaatgctctggtagtacataaaaggggcatctgatacattcttgattgatccaagaacacatgctgaaagaagacacatctaagatgagatgtgaaggataagaaagtataattggccaaacaagagagactggggtactaggaagtattccaaccaaagacaacaaatggcagttgcagagatgtagaggtcagagaatatggtgcattttctcagaatgaatcaaaggcataaatgttaagagctaaaattataaagctcttagaagaacacataagggtaaatcttcacaactttgattaggcggtagtttcttaaatatgacacctaaagcacaagcaaccaaagaaaaaaaaaagataatttgtactttaaagttaaaaacgtttgtatttcaaagaccactatcaaagtgaaaagacaacccagagaatgggagaaaaacatttgaaaatagtatatctgataagtgtctagtatctacaatataaaaagaactcttgcaattttgcaataacaatacagttttaacccaattttaaaaatgagcaaaggaggctgagtgtggtggctcacgcctataatctcaacactttgggagactgaggtgggtggcacctcttgaggccaggagtttgagaccagcatggccaacatggcgaaaccctgtctctactaaaaatacaaaaattagctgggcatggtggtgcatacctgtaatcccagctactacttgggaggctgaagcacaagaatcgcttgaacccaggaggtagaggttgcagtgagccaggatcacaccagtgcactccagcatggacaacagaatgatactctatctaaaaaataataataataatacaaaacacaatttgaaataggatttgagtagacagttctccaaaacagataaacaaatgcacaatatgcataagaaaaaatgcttaacatcattactcattaggaaaatatgaaccaaaatcacaatgagataccacttcacatctactaggatggctctaataaaaaagataataccaagtgtgctgaggatatggagaaattggaaccctaataggttactggtatgaatgtaaaatggtagaggtgctttgaaaaacagtttgattttctcaaaatattaaacatggtggtaccagatgttccagcagctccactcctaggtatatgcccaagagaactgaaaacatgtccacacaaaaatttatacacaaatgttcataagcagcagcattcataataaccaaaaagtagaaacaacccaagtctatcaactgatatgtggatcaacaaaatgtgcaatagccatccagtataatattattcagccataaagcagaatgaaattctgatacacgctacaatgtgaaccttgaaaactttatgctaagtgagagtagccagacacaaaaggccacatattgtatgattctatttatatgaaatatcagaataggtacagttataaagacagaaagtaggcaggcatgatggctcacgcctattatcccaacagttcgggagactgaggcaggaggattgcttgaggctaggaattcaagacagcctgggcaacatagcgaaaccctatctctacaaaaaaaaaaaaaaattaaaaattagccaggcgtggtcctagctactcaggaggctgaggcagagagatcacttgagacaagcagtttgaggcatcagtgagctatgattatgccactgcactccagcctgggtgacggagcaggaccctgtctcttaaaaaaaaaaaaaaaaacaaagtagattagtggttgcccaggcctaggaggactagcaggaagggagaatggggattgtttgctaaaggatattgtgtttctttttggggtgatgaaaatgttctaaaattggttagggtgttggttgcacaaccttgtaaatatattaaaaaccactgagttgtatgtagtaaaggggtgaactttatggtatatcaattatatcttccaaaaaaagcaatttagtatgctttttgtcgtgagttggggttgaggaatgtgaaaagataatgctgactgagttggaggatttgggtgagtttggttgaaaaactttgacagagataacatggcagttgggaaatatcctaagaacatacaaagtgattactaagagcatagagggcccagttgtgattggataccatacatttatagtaatactctttattttgtcatttttttcctccaccatctaaagccaaaactcagagttgatctacttctagtgtatagaaagatgtagtgcaagggaattgagtattggcaaaagaacatttgcaatgtagccattgaatctaagctggacagagaagggaaaatcaagggccaatgaatagaggtttgtatggttcaaggtgagttgtaataggagaattaagagagctgaaatgataggagatggtggtaagagatttttgggtatgaggttgatataaccaaggaacctgatgttttaaaggaaccaagggttttgcataaaggctgtagtatggaaaatgaggttgagatgggcagaatcccacctctcaattatgaggtgtatggttggagagggagtggtgcagaaggaatatgctgcatctctatgaaaagacttagggaagtggggttagcatgtgtaaagtaagaaaagggcacttgaaaagagccaaccccagaaaccagaagtacaaatatgcttccagcactgtccaacacatttggaataacatagtcacattggtgtgatcatccctattattgggaaagattactagagcaatcttagttgaggaacatttcttaagttccacctaatttcctttgttctggccatatattgaccatagcaatgttctgattatgatctggcctactagatgactacagagagaaaatgtgttcactagtcattaaatatctagtacgcttaatataattctcattacaatctttataatcatcattaaaatattttaaattggcactcttttatatgtcaggtttttttcagtgagtggttagtgttagagggaattttgggatttccaaagctcaggtccagaccctggttcaaagtgttctaagtggcaaagtaataccatttttgtgaggcttcctggtagaagccttcactggataagtcccctctactaggtaacatctgcatgatagacctgtttgtataaagtgcagtgaagagccaaacttgtatattgctttgcctttgaacaaatttctcttctttcctcatttagagcagcattcattacatttcttaagtgctttgcataaaatttcaaagttcagtgtgacctctgtactgggacatcatcaggcacagatgctacatgtgaagggcttttggcaatcagtggcttggtagccgtgattccttttgaatcactccctcatggaccatatgaaatgcattctcccaggatcccagacatattcttgggaatcattgtattttccgacttactggactagtttagaggcctttgggtttcactgcacttttcttcatttccttcttttgttgatcttggccccttaaccttccacccactttattactcatttcttagggacctgactactcagtaacactgagaaaatatatctgaaaccatatgggtttgaatacaacaaacttaagagagggaaaataaaaaaggaaaaaatgtgtgttctctgaacttcctttgtttatatgatctgtttatatgttgttaaggttatgttatccagctgcctccccacgtttcagaaatgactaaagatatctggaaaacactctaacagggtcatgttggcatagtggatgaaaagacacttcatttgtccctcaccagataatatatcttcttttgaggcatgggagcaatgccaggagctttaaatgctgaatctcaaggttcttgaaaggccattgacttctagggatacttttagaaagaagccagtcaatcccaggcgtagtggctcacacctgtaatcctaacactttgggaggccgaagtgggcggatcacttgaggctaggagttcaagaccaacctggccaacatggtgataccccgtctgtactaaaaatacaaaaattagctggtgtggtggcacgtacctgtaatcccagcaacttgggaggctgaagcacaagaatcacctgaacctgggaggcgtgggcaacagagcgagactgtcaaaaaaaaaaaaaaaaaaaaagccagtcaagtgagttccctaaggtatatacctggccatttgaatgtttgctcactatggttagtctgtatggtatctaacagatattacagttttcttttggtaaaatgaacattgacattggtgtgaggtgatgttagcagcccaggctttaatctcgcctttgtattgtataatgtgaattaaaacttaagtacacttgagtcagggttattcagtaaaacatgtggaatggaattttgtggtatttattagagctattccacttgtaaacaccttatcttgaaggaactgaaaagaggttgcaagcattcctgcagtagaataaagtgcttatgatggttgagtgagaagttcctctctaccttccatgctctacctactgtaatgggtaatatttgtacagagatgtgtttttcccatcaagctgtttatggaacttggcctgctaaataataaacttagaagtgagaataagtaagaataaggaataaaacatcagtgttatcttttggaaataaatcactccattgaacatggagaatgtggtcctcgtgtcatcggcattttcttcatatttccacctcagtggagtgatcctggctctgctttgccgctgtgctttccttttaattgctgtttcaccaggtctccttagcagcagcagcgcctgaaataactcctgaggaagctcctaagtgaattctcataatttgcttctcaattctcccaattgattgaggcactctttcttgagtgctttgcagttctgtgtaagtggctgatgtttggggtcactgctgaatgttttgtttgaatatccctttcatgatgaagggaagactgctgcttttaactacatggggtgatgccctttgtggtaagccttgaaaggcaaaaatcgtttttcatagtgatatgccaaatgaaattattctctttgtcactttgtccttttatcctttcagtctgataacctcagttcttgtgatttgtttgttttcttcaattaagcttagttgtttcctgtacccaggtgcatgctatttctgctcttggttatgatggtgtgtggagcatatttctgacctggaagtgtggtttctttgactgagagccacatcagcatgccttccatcctctacttcctttgcattatttccttttggagggctcagtttgccatcatttaatctatagatgattcatctgggactgagaactggtaatgctgtaataacaatatctttctttatataatactcaatgcacttactaccttagattttctctgtttatggagcactttcattttaatctctcacaataaccctttgggttaagtcagcaattttgtcttagtctaagatggtgaaattgtagctcaaagagcttaaatagcttgctcagagtggcagtgcttctgagttaccctgcttaacaatttctacaggaaatgaatacttttgaagatactctggataaataaaaaggaattttccaaaccacatcccatttgttaaaacctaacttgttttcagtctggtcagttgataagaccaaggttaaaaggcccatttaccatacagtttaaattgatgtgtccaagtcaagaaaataaatatttaggtcagtttttattctgttgcttatatgataaagttcaagaaggctggctcttaaattagtggaacttgaaatggaagtaattaagccattaatttttttttattctcttttcctttcagagagatggaaaacttgatgactagctccaccctaccgcccctttttgcagatgaagacggttccaaggagagtaatgatctggctaccactgggtaagcagctgctttaggacactggacttctccataggcctcaaaacaaagcttctagcaaagtaagaggtcctaaagaggcagttttatatcataagaatagacggtgcacttgtttcactttgcaaagagagtgacagccatcataaaccactttgtaatctgcattcaattatcttttgcagtgctctggtttttgtgaactggtacaacaatatgtggaatctagcaaacactggtgactccagttaagaaaattatatagtcaccattaaggaaatacctgccacagagctagctctaaaaaacaaatgcattttttctgttcaaattaccacagatattaaaatagttttttcccaaagatcagattttttaatgtggttctttattcaagatgcttagtaactttagctgacttctgttcctttccccatcccacccccttctcctttctgtgggatcttttgacaaatatttaaagagatatagaaaagggttaataacagtagtccacctcttcccttgaaaatctctgttccacttgaatttttatcttttctagatgtttagaagttatttggcaaagagaaagtgtgttcactaatagactgaagtgctagctaatccctaagatgaattattttaatattctttagagctgtttaaaaaataggctatactttgtaattctgtttccttccctcacatttatgtctcacctcgttgatatccgcctttgacctcactactcagatgaaagtgttctccaagacttttctaaaggctgcttagttactatattcattcagtaaaaactttctgagtatctgctatgtgtcattgttccaggcattagatagaaagcattgatcaaaatagataaaaatcataggccttttaaagttcaaattctacttgttgagtcagacaataaacaggataaataagcaaaacatatactatgttgataagaactatagtttaaaaaaagaaaaaagtggagaaaagggataggaagggtttggggatgcagttttagacaggatgggccagaaagtgtttaatgagaaagtgacttcaataaagacctgaaggaaataaggcaactggcatgcagttttctggggaagattatcctagacagagggagcagtaggtgcaaaagccctgaggcaggagagtttccatcttatcgaaatagccaggaggacagtgtgactagagcagcacatagcagcaggagaggcagtagaggactacatcagtccttctcaaacatatgaattgccaagagagctgatgaaaatgcagattctgatttagaaaatcttaggaccagagattctacatttctaacaagctcccagagaatgccagttctgctggtatgaggcccatactttgggtaagaagagactagatcatagggatcaaaatatttagagatcaaaataaaccctttaacttttactctgaagtgggataacattggagggtttcacacagaattatatgatctgacttacggttttataagatccctctgactgttgtattgagaatagagtgaagggagcaggggctggaacaaggagaccagttagggaggctcttaaaataattcaggagacagatgatagcctgaagaaccatcatctggtgactttcacaagagtgtttttggtggaatagtgggggtaaaaacctcattggagtgtgtttcaaagataatgggaatgaggggtagtgagaagtatagaattctagatatatttgaaggtataccaaacagaatttgcctgaaagaaaggatgagcacaatgtaagaagggagaaaaaaagcagtcaaaggcaactcaaaagttttggccaaagcaactggagggatggagttgccattagcttagatggggaaaactgaacaagtgtgggagggaattgtaggagctcagttttggaaattttacattaaagatgcttattagatatctaagtggagatgtcaaataggcactttgatatcaggttctgctattaggggaagtttaggcgagacagagaaagttgggacttatcagcatataacattcaaagccgtgagactgaatgagatcaccaaagaaatgagcactctgtagatggaagaaagaagagctctaaagcctgacctctgggatactccatcatttaaaagtcagacagaggccgggtgcagtggctcacaacctgtaatcccagcactttggtagactgaggtgggtggatcacttgaggtcaggagttcaagaccagcctggccaacatggtgaaaccctgtctctactaaaaatacaaaaatcagtcaggtgtggtggcacgtgcctgtaatctcaactactcgggaggttgaggcaggaaaattgcttgaacccaggtggcggaagttgcagtgagctgtgatcgtgccactgcactccagcctgggtgacagagcaagctccatctcaaaaaaagaaaaagaaaaaaaagtcagaaagaataggaagaatcaacagagtctaaagtgagttgctagaaaggtcgcagaaaagccagaagagtgaagggtcctagaacccaagtgaaaaaaaaaaagtatttcaagggaggggaaaagatcaactgtgtcagatgcttctggtacatcaggtaagatgggggctgagaaatgacactggatttagcatgggtgtcattggtggctttgacaagagttataagcacatatctcctttgaagtggacttaagggaggagaagtcaataagtataaacaagttatttccaggggttgtgctataaaggaaaggagaaaaattgggaccttaactggaagtgggatggagtttttttcttttcattttgttttgtgttaagagaattaatatcatacgtatatgctgattggactgatcctgtagagagaaaagaattggtattgccagaaaggacagaattgctgaaaatctgcccctgagtaggcaagagggtgtgagatcaagggtgcaaatagaagggttgtgggctttagctaggaacatggataatttattcatggtaacaaaagatcccccttttttccagtcttcatccaacttgtcatcaagaaggcatgtgatgcctttggccattcctgtccacttaagtcagggattcatgggattgtgaattcccatgtgaattcccaagtgattcctgtccactgaagtcagggattcataggattgctactctttcccaaacctagttctcatattttaccaaaataagaatttacaagaattagtaacttaaaaattgatggcacagttgaaatgaaaatgacagtgaaagaacaagttgcctaacacatctaaaatgattgaaatatttggaaaacagcactgcagagatcaaactggatctcgatggtacctcttttcagagaaaatgattggcattgatttcatagcttcttttacttactcttttttaaaggacctcaaaaatgtaggaacctcctgctaaaatcatctattatgtttcctagaaagggtcagaaaagtttaatttctttcagtcccaggacagtctgcttcctgttttcatccatttctcggtccactgtaatctggaatttattctcataattccactaaaactatacttaactaaaattgccagtgaccttcaggtcttcaaatttagcagacactttttggcctatcttatttaacatctgcaactttttacttgattagccactacccttctcaaaagtcttcctgccttggcctctgcaatcgtcttctctccagttatcttaatgcccttctcagtctcctttcctagtttttctaccttgctcatacaatgatattgcttcagctgagttctatcctgacttttccttcttctcactgtctttctggagaatatctagcactgcccattatttccatgggctaatgcttctcgagtctatctttatgcccttttgttccacttctgttctcctggggcatgtttccagttgtctgtggtacatttctacttaattatgctacaggtgtttcaaatttatcattttcttgtgtgtctgtccacacacacacacacacacacacaccctgtttttactttgattaatattaagtacataatcatcaattggaaacctcagaattatctttgactcttcctttctttcactattaaagtcaatcagtcattaagttctctccattctacctcttttttctttttctttttctttttcttttttttttttttttttgagactgagtcttactctgtcacccaggttggagtgcagtggcatgatcttagttcactgcaacctccccttcccaggttcaagcggttctcctgcctcagccttctgagtagctaggattacaggcactgccatcatggccagctaatttttttatttttagtagagacggggtttcaccatgttggccaggctggctttgaactcctgacctcaagtgatccacctgccttggcctcccaaagtgctgggattacaggcgtgaggcaccacacctagccattctgcctcttaagtatctcttaactgtccttctgctcagaatcctgcctgcctttgtgtctcacttaatctattacagtaacctcttgatagtctccctttctccttttataccaagttctttctatctggaatcgtgttgtttaccttgatgaatacgtactcatcttttaggacctcctctataaattctttcttaacatccctccatacatataaaattcatcataccctctaccatacctctatggtacttttaacaagccattattttagtacttacgttgcattgtaattattccctataatactatgggttgtgcattctttcagaataatgactgaatattactctattatccatctttctaccgctcttgacttcccaactcctccctcgatcaaaaacaaaaacaaaaatactcactagcacatggtgttacctttccttctattccttcgtccacatgtaataagataagtccatctaagaccctaccattatctgtaccttcttgtgttcactcttcagaagggtgaaatctggtttgctaactcatctggaatagtatagtgggagcaggaagtaagtacatctgtctgatttattaacatgtatacctgaacttacttaacttgatagtattgttcttagatgatctgattgtcactaaacgctataatccaagaagaaatagccaatgaaatgtaccgttaagagatttttcttacaccctttaagacctcttttgtgatagttggcaaactgcctctacaactcccattgctattcacttttttcattaatagtgttttccctttacattggagatacatgaaaggtagcatgtaaaagtcagattctactgcatattcagagctaaaacatgaagtctgtgttgagaggagatcatctttttggaagaagattatagttgtttttggtaggagatgtcttcatggaactgacctggtttaatcaagcactgaaaccagtttttttaaaacgccctgtaacgtctgtgaatacgttgtttacatttatacagattattgggggaattaattcaaggactggcatgtgcttttgctggcagggaaatttatctagaaccttagtaaataggtggagtttttgtgttgttgatacttctgcctattattcaggttaaatcacccagaggttccatacagtagtggcgccacatcatccaccaacaatccagaatttgtggaggatctctctcaaggtcagttgcttcagagtgagtcttcaaatgcagcagaaggcaatgaacagaggcatgaagatgaggtaagctgaagtatctccttctgttcctatcctctgaaacttctgaagaagcagtcacaaggaaggtgtgttgatcaaggtgttcatatgaccttcttatattcttaggctgatacctgcaaaattttgttttctatttcttgttttatacggaaccatattaataattttaatgacatagacaggtagactcttttttccctgttccctaagaaatgtatacttacctcatattagatgttgaacaaatacttgttgaatgagtgaatgatttaatcattaataagtaactaatgagaagtgtacatgcccttgctcaaggctctgctcagcaagccctgctgcatggagccctatgtgcccaaaggattcatactacttaccaaatctttcaccctcccatagggggtaactttccttaactcacacaaaggcgtatgagcctgggcagtcatgcccttgttggactttcagtgtttcttacaaataactgattacattgtcagtgttttaaggcactcttttttttttttaagccaataaagagtgccaccattgatttttgtcttttttcttattttaaaaaagctggccgggcatggtagctcatgcctgtaatcctagcactttgggatgccaaggcaggtggattacctgaggtcaggagttcaagactagcctggccaacatggtgaaaccccgtctctactaaaaaatacaaaaaattagccaggtgcagtggtgtgtgcctgtaattccagctgctcaggaggctgaagcaggagaatctcttgaacccggaggcagaggttgcagtgagccaagatagcgccactgaactccagcctgggctacagagcgagacttcgtctcaaaaaaaaaaaaaaaaaaaaaaaaagaaagaaaaaaacaactaatttttttttatctatcctattggcatttttaaagattataatgaatgcttaaagtttcttaaataccttgaaattaaattgttctgttgttttttgtttttttttttttttgaggtggagtcttattctgttgctcaggctggagtgcggtggcacaatttcagctcactgcaacctctgcctcccaggttcaagctattctcctgccccagcttcccaagtatctgggattacaggcacatgccatcatgcccaggcaattttgtattttcagtggagatggagtttctccgtgttgaccaggctggtctcgaaattctgacctcaagtgatccgcctgccttggccctccaaagtgctgggattacaggtgtgaaccaccgtgccagcccacagtagctttaatgtaactaggtttaaaaaaagaaaaacctaataccaaatacataatttgcccagtggtgaattataccattttatatatatttggaggagtagagtactacaattagtatttagatatttttgtccttgtttatttatatttctcttgtctgaaataagaattcttgtatccatgaaatattaactgatacggctgtatttgtaaaattatgaagtaaaaatattatgtaccttacatcttatttaaagggccaagaagaaaggctgtggtgaaacatcagtggtacctcagtccttttcatttctttagtttttttcagaggtgattcaatcttttgatttacctggtaactcaacatataaagacctctgactataaaatgtacatctaggccgggtgcagtggatcacgcctataatcccagcactttgggaggctgaggctggtggatcacctgaggtcaggagttcgagaccagcctgatcaacatggcaaaaccccatctctactgaaaatacaaaaattagctgggtgtggtggcacatgcctgtaatcccagctacttggaagactaaggcaggagaatcacttgaacctgggaggcggaggttgcggtgagccgagatagcgccattgcactacagcctgggcaagaagagcaaaactctacctcaaaaaaaaaattaaaataaaatgtacatctaaaggaacaaattgtcaagccaaagagctcgtcttcatttcagatatattatacttactaaaatttttctgagacttagatattaatttagtatctatctgctatgctatgctatctgctatctgctatgagaaataagctagtctttgaaagttatcaatgagcaactcccattgtgagttatttttaatttctgctacaacttgtttcttcttttgcctggtgcacgtgacaccatcttactctcatctgacaatgtctgcctccctgccacaatgctgcatgtgctgctgtatttcccatttggatactctcctgtcaggaatcaggacctgacagttgtctgtgggacagtcatatgcatatgaaggtcaaagctgagtgatcatggcacctcttattctcatacattgagattagcacaaaaatagccctttagtgtaacattttgtagtgtgatacataaaagaggttgcaagtgaagcatctggagttcctcaaaaattgcattgctgtcatttgtatattacctacaacagatatggagagctttgaatatccagggccaaattgcaactcttaatcctgttttgtttgttgttgtttgtttttgttgttgttgggttattttgggagatggttgttgtttggtttttggttttttattttgttttgttttgtagcaacgaagtaaacgaggaggttggtccaaaggaagaaagaggaagaaacctcttcgagacagcaatgcacccaaatccccccttacaggatatgttcggttcatgaatgagcgtcgagaacaacttcgagcaaagagaccagaagtcccatttccagaaatcacaaggatgttaggcaatgaatggagtaaactgcctcctgaggaaaaacaggtaattgttcctattcctgactctttgtttggttttgattatatctcagaaataacttatataagaaaagcaaagaggatggacagttgattctgcagttttgtcacagtgcctaggagaccagaatagcagggtccatcatagcaattttctctagcctagtgatttttaaactatttgctagaggggtgtgagcagggaaggagtctaggactcccctcaaccaaagcaacaccactttttatacgctgagttcacataagattgttttaagtggttcagtattaagaaatctgtcaataaaatgtattccactgagttaaatgaaaagtcgtgaattaaatgagaaaaagtcacttgacacaattctgcagttcacataagatttttaagaaaaaatgttactgctttaatactttttttaactagagttctggcaaattaacctactattgaaaataaagcaagaacaacttgaattctttctcctctaagacagaaactaacctgatgggcaaactgaaatgaatccgttcattagagagatttgaaaggaattaaggacaagatagccatgagctggttgaagtaccactaaagctgagcagtggtcatggttgtgggagctgctttgggttaaaagttcccagcattcccagcatctgaaagatatctgtatttcttttacgtcttaaactcttttatgacttacactttttaaaaaggattccagacacactaaaaccaaatggagaaatactctcctgggaattaattgaattcagaaattttcaaagagatcagattcagttgcaacttttgaagctctgtgtttgtggtagcaagctagtagaaagcagtgaatatcatccattgttttggcgctactgtataaaaggatagtgggctgtacatactatgctattcttttcttttttttctttattttaaaattaatatgtgctcattattctcttttcagagaatacagaaatgtataaacaaaaatgtaaaaataacagtgcttatttcttgggataaccactattacgtaggacaaaggttttgtgtttgtttttgtttttttaactttttttggaaataatttcaaatacacaaaaagttacaaacataaaaataatacaaagaacatcccaacactctttacccagattcacctattgttaacacattttattccatttctccatttgcatatgcacttatatgctcagtctttcttatacttttgcatgctcagtctttctctctctctctctctctctctgtcacacacacacacacacacacacacacacttgcatgtgtacacccagacacacacaaaattttgttttaatcatgtgaggataaattatatacattgtagccctttacccccaggatatttcagtgtgtatgtcaaagaatattttcttatataaccatagtgtagtcatcaatttcataatttttcattaacagtgctttaatctgtcatctatatgttgactgaatgtcatttctttataacatttttcccttccaaaacaggttccagtctagggtcaggttttgtgtttagtagtcaagtttctttagcttaaactgggatatttccataatctttctttttcttttataacattgatatttttttaaaatacagttcccttctgcttcccccgctgcttttacctttaacagaacattgctcattgtgtatttttcagatgtttccttgtgattagattgaggttgcgcattcttggtgggattacttgcataggtggtggtgtgttctcaatatgtcacatatgcaggcacacaatgtccttttgtttctcactagtaatgttaattttgcttacctggtacattatttaaattctcctttgtcattaataagtaatctatggggagacgatttaagaacatacaaacagcctgttttacatcaacattttcccctagatttagcatccattgattatttttgcctgatttaatctttatcattatggttacaacgtgatgatttttccaactccagcactccctttacatttaccaggtagccttcagcattctaatctaagcaagatcttggcttactgcaaccttgacctcctggtctcaagcacccctcccaccttagcctcctaagtagcacacaccaccaaaactggctaattattttatgttttgtagagatgggatctcactttgttgcctaggctggactcaaacatctgggctcaagcagtcctcctcttgccttggcctcccaacatcctgtgattacagatatgagccaccatgcccgaccccctacccccatttatttatttgtttgtttgtttgtttgtttgttttttgagatggaatcttgctctgtcgcccaaactggagtgcggtggcacactctcggctcattgcaacctccacctcccaggttcaagcgattctctagcctcagcttcccaagtagctgggactacaggcgtgcaccatcacacccagctaatttttgtatttttagtagagatggggtttcagcatgttgaccagtgtggtcttgaactcctgacctcaagtgatccacccacctcggtctcccaaaatgttgggattacgtgcgtgagccaccacgctcagcctctacacccatttattgtatttgtatggtaacaaatcattggtattgtgtctgttataaatcatactaataatagtatgaagttttttctactagtttataatttattactgtacttaattattttggtgcttaaattgtaccagatttggccagttgagtatcccctacatctggctcttacgcgggacaaagtgtttaacataatttctgagtgtgttttctgttcatttagaagcagtatttttatactttcttatacttcattttgatgaatgaaaagggcaaagcattaaacaaaataatcctggtagatcaatgaactttgtttaaataattaatagcacaaagcaatcaaagcatgtagatataggttctctcagagtagtccatttttaggtccataggatgaggtcattatttttatgttctttgtgtctcccagcttcattgctccaacctcctggctcttaaagggccaattgatgtatgacatcatcccctcaaaatgggctggagacagcaaaacaaagtaatattctgttccttcccttgggaagactaagtgtgcctatgtggtgtgcacatctcatgaggatgactctagtggccatatagagttctatctatagagttagaagaataactctaatcatcttcatgaattttttataagaatgatctcaatagaacttgtcttcattaggttagaaaaggcaataaatattctaaaaactcataatgacctatttacttttataattgagaggttatattttattctattcatacaactcttgtttttctgattcttttttaaggcatattccctatattcttttcttcccatgttctaattgtcctgttttcttcaaataggtaatttaattttatttaaataggatctcattttcttgaaaataattctgtatttctttcctagcgctaccttgatgaagcagacagagataaggagcgttacatgaaggaactggaacagtatcagaaaacagaggcctacaaggtcttcagtaggaaaacccaggaccgtcagaaaggcaaatctcataggcaaggtatcaaaaccagaaccaaatgtatttgtagtttgttgtgggtgatggagtgtcataaagccaactgttaagagtggtaactataaaagatgtgtttctgttttttctccactatccagtattcacttacaagcattatcttgaaattttattaaaatcacattgctctcatttagaaatttcaactgggtttccgtgtctattatcaatgattttgacttgtcctccgagacccctgttagttgcctgcccttcttttcctgattcccagtttaggcatttctctgcctgtaagcaagcctatctacaaaattatatcagtaacttgcctttaacacttctaagcctttcatgtgtcatttttgaagcaccatccacaactagcctatttttccttagccattgcatcttctctatacttgggcatctagcctgctaaaattatagatgttgtataagtagtctttggtttgtgtcttctgtccactcttccacccttttctccctaaagttaagaactgtgtctgctgtttctcttatgcctaattatgaattctgtaggcatggggttcccttacttttgttggctgaccgattaataaagccttaaggaaaaatatcatatgttatgagaatctacatatacaagcaggttttatagtttggcagagtcgtatacttgggttttgttattgctttctttttaaatgtaatgttctcttattcttttatatttttagatgcagcccggcaggccactcatgatcatgaggtaattagccatctgtctacatatcatatatatgtatttataataatgttgctttttgaaatgctattggatttttttttttttaatgaatggcaaagtatttcctatctcgtaattcagattaaatgagatactttagcttgggggttcttagcatatggcagacacttacgttgtgtgtctgtcattgaactacagcccctaacctcaatcctttcctgtgatctgagaattttattggctttaaatgccaaagatggctggaatttggaatgaagtatagaaatgagggctagctgaaagctataacatgaccatagtttatcatcaccaaatacttaaatctgactctcagaaaagttgttatttaaagaatccagcatttgcttaaagcgaactgttcaactacaatgtcgatagagcacaagcgacagtatctcaggtttgttttttgttttgttttgttttttgtttttttgagatagagtctcactctgtcgcccaggctggagtgcagtggcacaatctcagcccactgcaacctccgcctcccgggttcaagcaattctcctgcctcagcctcccgagtagctgggactacaggctcgtgccatcatacccggctaattttctgtatttttagtagagacagggtttcatcatatgagccaggatggtctcgatctcctgacctcatgatccacccgccttggcctcccaaaatgctgggattacaggcgtgagccaccacgcccggcccagtatctcagttctcacacctcctttcctattccctcacttcactagcacatgtttgtgtactggcttctttcctcccacttggttcagccccattgttaggatttaggcctgtgtttctgtgtgtgtatgggatttaggtgtgtgtgttgtttcaaattctgttttctccttcaaacttttcttgtttcctctaacttcctttaaccctcatggctctctatacttgtgttatgtgcttagctgatctgacctaggggttttgaggtaattcaagggctcacactctttggttgtaatgtctttgtggacatacacagtctagtttccatctttatatccaaccccataccacctatcatgatacctttgccttgagaaggtattccacaaatgattattttatggaatctattcaaagttgacctgaaataactgagaatttgaacaaaaagaattttctgatgtactcttttacatgtgtttggttttttactaaatcaaggaaatgttggttaccttaaaacatagagaaaagattcagattcacaggtcaaatagacgttattaccatctatgaattataaagtgagaagcatagtaaatatttacattttattcttcagataaatcctatataaatgtaattatatatgacattctatgctctaattaggatgaaatgttatgttgttttgctggagaaactttgtatgtattctttgtattttaaatcataataatattgtaaacttttcatattagcagacatttgtataattacttctctctttctttgcctgtgtgcccagctatcaatatcatgaaattcctgtgcttctttttttctctattttatagcttctctatccttaacagttaccaaagagaatttggacagtaacctgaaacattagatctcacattttctagtcagtcatctgaataggtgtcagtcatctgactcatttcatcactatgaattttgctggccaaactatatgtagcatttttgtcttcagtaaacttgatagttgcagtcagaaaagatgtagatttagtctgtatcatagaacctgctgctgattatttgagaagtgaaggtgtttattcagatacattagtgtgatatgaatttctgtaatttctgtgatttgcaaaaagaagtgagtctctgtatttccctgttacaggattagacacatgttaaaccaaacaaaaaaaaggagtgagtagatggagagccagcagttgtttcttaaaaggttatacagtaggttctgtaaatccatgtgttggtatggccacagcaggataaagctcctttagtaagcgtgttgacccaattaatgtcccttacttcatccatttttatttttcactgaataatatgtttcctaaattagataattttagaacaattgcagtataaaagaactgatttgaaagttttaaaactgtttttaaacactgttacccagtaattttcttacatataacttcttagtataatagaagttcagaaaaatagcactatgggtgaaaagcagccgcagaaggagcccatggaaaggagtaattgaatcaggacttaaaaatgacctaggttttgtgggcatctcagggtgggtaaaatggcttgagcagaggtatgagtaagtttttaataaaagagcaaatatcttgcagtgtctaaagaccatagatcctaaatacatacttatttccctttacttatcctatgaggagtaaaacactgagactcagtgatcctctcaactgaccacctcattttgccagtgaggaaagtgacttgcctaagacagtatatagaatggaaagaatttacccagaatcacttactgaattaaattagaggcagaattgtgacagaaacccaggccttctgtgtcatagtctaacattcttgacagcacagtgccatgctacatagcataaattacagcgttgaaagtaaaaatgggcctcgttgcccaaggtgtcagcaaaatgtgttgccagttaagtaaactatttggtttgtgtatagtaaagaaacctattgtattcctaaatgaaacttggatccctaagtcattgttaccaaggcaggtactggagagggcatattagagctaaagaaatgctgacctgaaagccattctgcatagcagtggggcacttcaggctggtacacaatgttaagagcatttcccaaagtaaaagtctcttgagagaagcacatatcacactctttgaaattctggccctgagcctagatcacagcaaaataggttcagttcaaaagggcctcttttctcttaacctccactcaatatatagaatggaaaccaaagtgaagaatattcttgctcctctcaaatcgaaagccagcccactagacccaagagttagcgagtattactctcaagaaagtgtctatatctcatgtgaaaactaagatagaaacaataattttgtttctcctttaatttatgagaaatgacagaatgacactcagcttgaacaaattagaccctttcagtgaaagggtaatcagatccttatgattttaatcctttgagctatccttggagcagcttaagtacacccaagcccccaggaggatcctctccatgccgtgaaatgtgctcagtaatggaagagcgctgatggtttttattaccactcttccattaagtagaatttctctgttacctttcagagactgaacagtttcattgaattgctttaatgtttcttattttgtgctctgagaatctgtaccaaggggcagtgtgttaatgcacctatgtggtgctgtcctctgcccttacataattagcttgatttggactgctctggcaaagaagagaaaagattaccagtctgaggagagtcaagactttggaggagagggatctttgtaccatggtaatgggagccaagcgtctccactttacccatctaactggcagatattgagacgtatagcttaggtaactgatctcatgtaactgcagttaagttggagattgaataagataggatgataatgtcctaagtctttatgctgtcatctgtggacttatgtttatatctgttatgccttgtgcatgttgggattgtgtgtcattaagttttgttttcctgcagcagcccagtaacagttaaagcatatgggaagccagcaaatttgagagaaagccactgcgaaatatggctaagattccttctggaaccagcctttcttgttcatacattagtttccattgaaatcccctaggaactggctcgaggtagagctttgcatgttgaaacttgggactttcgattgataattttgttgttcattttcaaattattctgggaaactttgctttcttttgttaggaagaaaaatacaagtagaaattaagtgctctgaaattacatagcttttcagtgtctttcttgctcagctgccattggcaggtggttcacacagcccagcccccttactaggcggccaccgttatgaatacaggagctcgggtgtcagatttccctcttaagctgtgaactgcttagcttttctactgggcaccaagtcatttttgtgttcaaagatttaaaaaactagtggaggctgggcacggtggctcaagcctgtaatcccagcactttgggaggccaaggcaggtggatcacctgaggtcaggagttcaagaccagcctggccaacatggcgaaaccccgtctctactaaaaaaatacagaaaattagccaggcatggtggtgggcacctgtaatcccagtgacttgggaggctgaggcaggagaattgcttgaacctgggagacagaggttgcagtgagctgagatcgtgccactgtactccaccctgggcaacagagagggactccctctcagaaaaaaaaaaaaaaaaaaaaaaaaaagctagtggtgacaagagtaggaaagatacattctgtctagctttaaacaattgtttataggaatgaaatctaggtattatgtttgcatgtttttcatgttataaaggtcctgggatcttaagatttcactagcagtttcttcatttctcacttcctgccattttaccacctttgttatggaaaattttgaacattatgccaacacacttaaaattaatattcacaatgctttcaacttcaaattcattttagaaacgacagccaaagcatcttgagttattgactttattcttaaagatcattgtggaatatattttgcaatgatcttgtgaggcttttttatttttaatggcttattggtgaattaattttaggctttgttattcttttgtatctcacataatcgtttgctttctaatttttagagcctggttatttctgatttctcggtctcatgtgtttgtttgtttatttttcctgtgtctaaagaaaatctaaaagaccccaaagataggctgcctctcttaagtaaatagaagtaccaatggaatatcataattattgctcatagcagttacatttctgcttaaaattcttattgtccactctgcaaatttatattgcataatcttatctcagggagcattttacatgcataaccaacaaaagtgactgaaaaaaaactactctttctcaattcccactgcaatcactttcacaactgtatactgttgactattcaaaacacaaggctaagaaatggcttcaaattctccattagggaaatttacgtaactttgttttaaggtttctaattgcacagtagttgtatacctgagagaagtgaatactttacctgcttaagctctgtgaaagttggattccaatgaaaagatgaatacatttccctcacagactcacctggactgattcctgctcaccctattctttctttaaagaagacatgatcattgtcttcaggcactattatttaatttatcttctattaagaattaactgttttgttcctcttgattcacagaaagaaacagaggtaaaggaacggtctgtttttgacatccctatatttacagaggaattcttgaaccatagcaaaggtgattactgaagtttctttttgtgtttctcagatttttgacaggggacttagttctcagaagaaattcattgctcaaaagcaatggtagtgttatccctccttaggactactcaaagaccagtgaaggaaagctagggcattgttgtcaaagcttctttggtctctggatgaaaggaaataaatgcaaatcacaaattcacttgtcttcaaactcttagcctggaaccccttgcacaaataaaaacttacatgggagtccaaaatataaaataagtaagagcaagtctgatcccattgtggtaaagatgggtacctacagctgtgcttggccagtctcccaggatccccctgcaaaacccctcaggcttctgattgtacaatttaaaaagcaaaaactaacaaacaaaaaaatactgggaattgaaactgtttgttgcaatcttatgtatggaatgtgactagctttaagaattaaaatagctctggggagtcaggcgtttcattgctgaaattgctatctggaatgccataatgagaatagggagatgaggtggggtagctaaattagaggcagctaagcagaacttccctgtaagagtcattgggactcctcagagactccttctagtgctgcatgtgttctgtgggatgtatgtcctcagctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggtaagtcctcctgcctgagaactgtcagtgacaggggtgtgtgtgttgtgtggagtggggtgctgtttatgttagtactggtgtggagagattgaaatctcctccagaggaaaattaattaaactacattttttcttctctggatataatagaatgtcagtattggctaaaatcgtccaatgtttcaggctctctggtcattcaaatttttgtccatttatattttaatatctattttcccctcttttaagcttaatttgctattcagaacactggaaactgagtagtaaatcttgagagtgtttcttcttatgtatgtttgtttgctttttagttgtttttgttttaacgggaaggaagggagaatgaacactggtatttcttatatactctttcattttgaagatagtcatagcagaaagctgagcgagtctaaccttctgttacatgcagctgctcatatatactatacagcaattatatagcccatctgtttatttagagtatgtggactaatttcatttctttgagatctaaaagtctctcctctaaaattaaaagcatgtctgtggagcagaccacattagaatcactgtttctttgaaattgtgttttatggtacaactgaatagggaggattttcttactttcttcttatctcacttcaggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggattacattggatgaacaagttggagacttggttaagattcctgttgcatggttgttaaatgtagtaaataatattagaaaagagaatcactgtagtcccagctacttgggaggctgaggtgggaggattgcttgagcccagcagttcaagtccagagagatcctgtctctaaaaataaaagaaaacagactcaagacagttttttcttatgcttgcttcagaatggtttaatgggaaaagcatggtttttgtggcttgacctcatttctagctttgtcacttattagctgtattcttgggcattagtttcccaaaaggttttgaaaagtgagtgggaaacttagaagaaatcatccccaaaacagcactcagaacaaaataaatataacttaatttttaatcttccttttctctggaaaatactaatgataatttagaagtagtcagtgagacattgtatgtatgtgagcctacataagtaggaagcttttatattcaccactcaataacacagtgactgttgtctgttaaatgttgatgtggactcaccatacaaacaggtaactccctggttttgatagattaaaaaataaactcttcagccaggtgcaatggctcacacctgtaagcctagcagtttgggaggtcaaggcaggcagatcgctggagtccaggttcaagaccagtctgggcaacatgacaaaaccccgtatctacaaaaaatacaaaaaattagccaggcatggtggtatgcgcttgtggtcccagctgcttgggaggctaaagtgggaggatcacttgggcttagaaggtcaaggcgaggctgcagtgagccattatcagaccactgcatgccagcctgggtgacagagcaagacactgtctcaaaaatttttttaaataaaaaataaataaactcttggtggggcacagtggctcacacctgtagtcctagcactttgggaggttgaggcagtattgcctgagcccaggagttcaagaccagcttgggcaaaatagtgagacccctgctttaaaaaaaaatgaaaaaaattagctgagcatgatggcgcacacctatagtcctagctactcaggaggctgaggcaggaggatcacttaatcccaggagttcaggtttcagtaagctagggtcacactagtgtattctagccagggtaacagagcaagattctgtctcaaaaaaaaaaaaaacaaaataaaaatataaaattctcaataagcaaaaaagagagagaaaataagtttttaaaaaatatgttcaacaaatgagcagtagtatgtatccttttttttttttttttccagaagagatctacccatgacactttttggtactaatggtcatttctcaaatggaattggtatttattcattcaaattcctagagataggatacccctttactatgccatcccacaaaactggcatccctttgctctattggttaagttattccatacctgcagacatataaactgtgtggaaattttaagattagactctacaatgaggtggccatatatggatactaaaataagagtcaacagcaggatatgttccttagaatggtcatgggtttgaatctttatttgtcctgtgagtacatgagcacactcatatacataatttatattctggtttggtttggactttgagcaacatatataaagataaatgcctagtaaagacaaaggcagaagtctttatacttcttggtgatgcccttggatggtaactgtacaaggcaatgcattatattttagcctcagccatgctctgatggggaaaggattactatccttctagggagtagccagatggaatggactgtacttcttagagatggctggactccctgcagaataaagaagtggcattactgctgctgcttatgaagggaacagcttgtaaatctaggcctgggatattcaggagctcatcatccttcccattttcgtacagtgttttcaattagcactcttgtaggcttgaaaagtgagagctgggagaaacagtgtggaagattgtgaaagaaaacattaattgataacatcgtgtctcttcacatagatacagggcagctaattaagtattgacccaaaagtggttttccattttgagcattttgccagtaagactctcctaaagcttttttcatctcaagagtataaactatattatttgttttctgatgagtctttgaaaacttagaatattactattatccttgattttaacctacaaatattttgcccctgaaaaaatagctaaaagtgtgaactgttatattactacagattcttacagtctagccatgcaaacataactaacaatagatggttccccacacccccaaaactgtcaaaggaaacaattacaaagactgtgattaatactggtttggcctcattatacaaatatgtacagacagcgaggctgatgtccccagcactcatgatgcaattaattactctgacaagagtttggcaaagttttcatccactgtcaggagccagtgagtgaagggaagctaatggtctacaagtttcagaggagcatattagggacctttagaaatctaacattttatatatgaagaaactgaatcccagagaggagaaacatcttgcttgaaaatatctgcgtagatgagtacagaatccaagactagaaccacagatatctaaactctctcattcactgggtttctaaaacattgctctaaggaagaggtggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattcttcagactaaagtagggtactcattttccctcctcaggtttgtccctgatagttgcttttctgtgtttagctgatgattttcctacctcccattgttgctgaactggaacagggccatgtttctcattgaaatgttatgtaaaacatctcaatgaggttgcctgcttacagctttatgagttcttcagtttacatacaccctgcactcactttaacgcttatgaaaccaaagcatttttaaaatccatagcgctaaccccttccattcaatacttactttcttggtgttattttccttgtttgtttttgtttttgttttgttttgttttcctgattctacaggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttgctgtgttgcccaggctggagtgcggtggctattcacagatgctatcatagcacactacagcctccaactcttgggctcaagcatcacgcctagcagtttctggttcctttaacagcaaaaggaaagagaggttctgattcttacctcagggttttttggttgttcattgtttttatttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattcacctgtttcaattttacttgctttgtaacaaaaagtcctacctctggccgggcacggtggctcatgcctgtaatcccaacactttggaaggccaaggcaggcagatcacgaggtcaagaaatcgagaccatcctggccaacctggtgaaaccccgtctctactaaaaatacaaaaattagccgggcatggtggcatgagcctgtagtcccagctactcaggaggcttaggcaggagaatcacttgaacttgggaggtggaggttgcagtgagccgagatcgtgccactgcactccagcctggcaacagagcgagactccgtctcaaaaaaataaaaaataaataaaaaagttctatttctgttttttcctcttaaagactttgtcaactctacattaatcatgacatctgttatgcttttaaaacagtaacacattcattttactaattgctacttcaaaatgtatctttaccggtttgagaagtcagctcttttaatgtatgctgtaacaatacagtgaattctaattcattttaatatagcagtagtattctgaagacaacttacaaggatgtttttaaagtcagtgactctgatgtccccttgatagaagatcatttgatagaagaaaggagatgtgcttaaatgcttgcttttttttttttttttttgagatggagttttgctcttgttgcccagcctggagtgcagtggcacgatctccgctcactgcaaactccgccttccagtttcaagcgattctcctgcctcagcctcccgagtagctgggattacaggtgcacgccaccatgcccagctaatttttgtatttttagtagagacagggtttcaccatgttggccaggctggtcttgaactcctgaccttgtgatccaccagcctcggcctcccaaagtgctgggattacaggcatgagccaccacgcccagccaaatgcttgctttttgaaaataactaatcaaaatatttttaaaggaaatttgtcacctatttctactatgcttttaaaaatcctaggggtgaggcaacctggtttccagagcctgctgctctccaagtagccatttgtgtggcattgggcaagtcttgatttgtttcaactccagtttcctcttctgacataacacgtgcctcagcaatcctgtactattgtaagaaggatagagtaaggtaacagaatccaccttgccttggaggacaggaagataggaagtatctgttacatgattgccagtaactatcagggtatctcagttaggattgagtttggctctacattaagcagaactagcaacagcttaaataagaagtgtgtctttctcatagaaaactatgccaaagttgggcagttaaaggctagtatggaggctcctgtctgttccacaacatgatctttctcaaggtcaccccgtggtccaaaatagccacttgaccatcagccatcactctgaaattcctggcagcatgaggaaaagagggcaaggacaaaatgagcaaacctagctgagtcagggccctctaaagagtcttcctggaaatcgtattcaacactttcacttaatttggccagaactcaatcatgtgactatagctagctataaaggaggccaagaaatatcatttttgcatggacgtcactgtgcccaacaatacaggttttagtaaggaagaaggagaaaatgaatatagagtaggcaactaatgttaatttcataactatgtgtgacttcatttatgcactctaagcccaaccccgccatgctagtgaatggagtgcattatcttgcctttgtctcttggccatttgagaatgaccatgtacttccgtgatacttttttcccccggagagccagaaagccaaaaactggcttccatctgagttgccatttcctgttcccatctagctcttcccctaccctacaacagctggtggccagtcttgtttagtaaaaatcaacataaacaggtggtaat

SEQ ID NO: 14297 - DNA, 56523 bp, Human
tctggtcatattataataatgaaaagtggtcaaacaacttaacatggtgccagttttcctaagcgtgcttgccactgattgtaatgcttttattgtttggcttcttgataagtaagttatggcttacagcggtgagtagtatagtgttctgtctgaaaacatattcattaatattctgtagctgctctggtttgcccttaactatgctgctagtgtgataagctgaaacatcttgtaactggtaaaagtttcagagaacttaactttctgaatatgtaacaagctgcatgtatctgaaagggttcatttagacttctgttagatattagcagattttctcactctgccagagagttaggatctgttaggttgtgggtggaatcctggagattatgccgggtaaatatgtaagtacctgtattgtattagcagtgtttactctgacttggttttaggttctgagagtttggctggttattttttcagaggtgggaggtatggagtagagacgttaagatacagaaaggtacattcgtcttctgaatcctgaagtgttatgctagaggtatctatagctgtggaaaactgaaaagatattatggtatgtacccagcttaaagggggtacagtccgtaaaagtcagaatattagcagccttccaatatgtctgtcggtaggtgaaaaaaaaagtttctctctttcaggagctgtgtacaaaaggatccaaactatactttgtacatttgttattgttttaaaagtggctgtgagtttttagaggtcagctaactttaaacttgccgtttggtttgtgactttagaaggtagagttaactatatttagcaatatgcttaagcgtgtgcatatcacctcatgaaacgtgtgtgtgcatgagaaaagctgcctccagtacacatacatatgtatatacacacatacacacaagcacatatatgtatgtatttcttataggaccaatctcattgtacataatttcaaagcacaggttcctatctccagggatgcataaaaagactcactgaagtatagggagaaaattttaggtctactattatgtttgttgatctcatcactttaaaatttaaaattttgattatgattgataatcttactatattgctgtagaagtacatgtatctgaatttataaattgcatttattttgggtacaggtatgcctagaatttttttgctgataaaggtgagtggtcagaaagctttgcagatccctatatggaggatgatttgagtggggttcaagaactactgtatttgggagggagaactgataagacttgataagagaaataaaagaaacccagtgtgacactggtttctggctaggaggtgctgttcactgaggtgagagggtgaccacaagctgggggtgctggttggctggagcagaggggaaatgatgaccttatgaggccaagtttttttttttaaggtgaccatgggacataggtggagatgtctaaattgcagttgaatacacagattgagagcttaaaaaaagaaaaaactctgagagatttcaatttgacaattcttagtctattgctggttgaagctataggctgtgcatgcaaacaccaaaggagggtgtggagtgaaaaacgggctgaaggaggacctgggaacacttttaatagtcaagggggggtggaggaagaggaatctagaaaagcatttaccttccccagtttcttctctgaacttctaattcctttgagtggcatttttgtgagtgacataggtatttctgggtttttccagtgattggcatgtttgagttaaagacagaaagacttcattggtcacatttctttgtggtaatttattttcagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatgtaagtagagtgcagttctctctccatgagcaactttttttttttttgtatcaccagagagtgtaggcactgtgccacttactctgttaaggatacctgccagcgctgaccagcaacatctgtccctgtcagctctgcatcaggatgtagcttggctgtacattacattttattctatcagtacattgagtaccagttacctgaaaaatgctttactcagtggacatgaatcaagaagttggcatgctctttgatgttgagtctgttgtctaattggaacaagttgtgttcagttcaggaaaacataaataccaaagagtgttttatacaatgtactgtaccataaaatactgtaccatgtaatattccctaacaatgttagaaaaatctcagcattggcttgtgtggttttggaacacgttgtgtaggagatgaggcctgagcttggaatggtatgagcgaaggttggatgacagatggttgtcacattcaaggacagcatgggaagaatccaatctaatttcacagatagtacctggccactttgttacctattaggagttatgtataatatcatatatatcagaaggatatgtgaaggctatataaaatgaaggcctgggttcttgccctccaatactagcctgatgagagacacagacatgaatacaattagttacaatagaagtttgaatagaaataacactatattattaagcatcactgaagatttgtcattcactctgctgggcactatcaaagctgttttggaaccacagagaaggagtagttaattaagttgattgtggttggtgaggagatgaagaggcaataaagacagaaaggaagaagaaaaatcagcattctattttgtgtagggagtatagtttcagtggagtgatgaggaaaatatttacatacgaaattaggtatgtaccatttgaagtatggaagtcacatttttctgtataaatgtttattgaatgaatatgtaaataacttaagctttcgtaatctatgaaattagcaatagattattcttctccatgtacaatattttatggtttatgtatgattttcttcatattatgatttcagtgcttcttttaaaggggtggtacagggtcatgtttgattattggaggaggaaattggagtttgaaaaagcacatttggtagtataatgttatgttagaaaaatgttacaaaaaagtacaatagggagtaagatttatgcttattaaagaagcatggattaaaaagattgagaaacatttattaaagagtcactgaggttcttgttttagaaggccatgattaatgagttggagaacaagaagcaaatttggtaatcatgtaaattatgagctgctgaccacctagaaagatatttgctgataagagctttcatataatgatcatattttatctttccaacaattagatactgtttacagcttactgatgtgtaaaatgagaaactttttttcctatgtttatcatggttttaaaacatttatcatgtatttaaaatactgtatgcactccaccacagacaggatggagaggaagatgtgacaaaagatgtggtcaaaattagttttaatcaaggaagcattttggaatgatctgcttaaaaagtggatataattacgcagtttgagaagataattctccttaattgaaattacggggaataagtcttgctctcaggtgcttattgataccgttgatcatgctggttcttttgctggctccactcacaattatctttgacaacttgccccaaagtaaactttctcaaccaaaaccgttcccaacttctttcctcctcacagggaaaggcaaaaaagtccgcaggcatagagagtggaaagaaggaacagcatactaggctggtttgaaaaacaatcaattgctaggtaataatgtcttaccttttgagtggaaggaggagctgggaagaattaagttcgggcaggttttttgctcattttggatcagcccttcatattatggcttaatagctttgtttatagtgtatttttctgcttttacgttcatcctctgaagtcttgagttaattttgtgcccctttacccccatttgaattaaatgcttcatttttttcccgtttctcacataaagctatttttttttcaggacagggaggggctggtggtggtggtggtgctgtaccagttgtctgtttatgagatcaccattagacaacgtttctcattggcttgaattatttgaattttgtgtgattttcctgttatgttgattctgttcttggtgtctatgagttctgtagaggattccagcctaaattttcttccttagttctgtttacttttcctcgacttttgtggttttgctctttgatcactgtcaagatctatttgagattttctgactttcttgaagagcagaatgagatctagattttctcttatttttaaagaagattcttcactgacttcctttcactttttgttctgtggaagtctttcctaggtgttaagtttccaggctttacctccccctacccccaacgtattatctttaggcattttgtttgccaatgcgtactatatccattatttatctttcccttgcacttgtagattgggtggtgataaaaatcttccatatttcattttcctggagaaggcgggtagagtcactagtgatgaattttatcttcaatctgttgtataattttcttaaagtatctcgccgtgttgtgagctgttctcagatttcaaattgttttgtgaacctatagctttggagcagccaaacctttgttgttagagcttcttagcccaggctatcattatcattgtgtgagaaggggttagtgctctttaaaaagccatttttcttctgggtgggagtggtgaattttagatggttttctaattcagactacttttctgtttgtcaaggagaggagaagaggacttcaaatgtggtgttacatctttgggatcccttagcctcttctctttcatgtctccttttttttcttctctattctttctgcgaagttttgttaatcattaatgctagcttattaatatttgggccataaacacctctgtagtgaccaacacacctcttcctgccagatggaaggaaaaaaagtgttgagttttaattgttcttcctgtaaggggaaaggttccctttccatgggaggaactcatctccacatgtcaccctctcagatggtacagaattcagaaagatttctcagtttcttccattcatgtttttctcgtttttattactctctatgtgggataagtgggaggaacctcatgtctttcaatttggctctgtgttcttcttctggaatatattgatttttaaatactaaaatctgttattggcctatttcttccccttttaaaagcagatacagaaaataatgatggtagaacagacttgggatgaatccaagtttattataatttttaggagacatttatgatatacctctataggtatcagaatcttttctactattaaggtgaaaagatttgagattttgtgaaatcttttgtgtattctttttatttgagttggcttttaggtggcttatttttcaactctgaaatgaacataacatgttacatatgttacatatgttacaatttttttctaaagtgtagttgtttaatttctacaaagatagtccatataaagtttctaaagattgtaaatttaaaaggaaatgccaaatgaattatttgtaaaattgtttaaaaaaattaataaataatgagtgtgtatttaaaagtttgaacatgatataaaaccatacttttatggataaagattagtttacagtgaagattaaaacaattatgcactatttttgacagtggaaacaattgcacatatttgggttaaccactaaaatgagattatttgtgggtggtgtttaagattgtttattgttcagggaatgaattatgaccccttagataaaatttcatatggtaaaaaatgaccttaaggtgaaatgcttttataggaacaagacacaaaacctttgtctgtacttatgaaatatggcaattaaaataacttttcttggcctctattaagttcaaatgcccaagaaataaactcatagaacattataagccctttccatttctgtgccctgagtcagttctaacactagaaggatgttctttgttttaaaatagtgattaagtaggctttgaaaaaattacagtttaatgaagtcaggtcatagcttctggatacagatggtcaggtttcaattccacctgtgcaacttttgattccaccattgcaagttgtttagtctctctggttttgtttcctcatctgtaaaacaaagacactattattcttcacctcattgagttacctggaggagatagatgctattattttatcattattattatcatatccatttgaaggtgctgaaataaaattctaattttttaaagttctaaatgaaataactttttgttacaaattactttaaatcatcaaaacttagtgtattatactcttcttcttgcctgtgcctagtctggccctctcaattgagaagtcagtctttttttttttttcagtaatccacagtgagcagcagtccctgaacgaaatcatattgctagttgggtttgattaataaaacacagaattggtattctagtcctttcaggggggtttgcttccttgtgatgtaagaaccttgtcttagtctttgtgctgctataacagaatgccacagactgggtaatttatgtcagggttctgggggctgggaagtccattatcaaggggttggcatctaatgtctttctgttgcatcatcccatggtagaaggtggaagggcaagagagtgagagaagagaaggaggccaaactccgtcttttatctggaacccattctccactcctgtggtaatagcattaatccattcatgtgggcagagccctcatgaccttatcacctcttaaaagtcccacctctcatcactgttgctttggggattaagtttccaacacgtgaaccttggggacacgttcaaagcatagcaaacctcaaagcttcctccttatttctgtttgtattaggtatgttattccctcccctcaatctttttttaagggtttctgtgatatcagtgttcagagcatttgtattttgtctactatgtttttatgatattagtgttcagagcatttgtattttgtctaacatttactaccttaaatattttgtcagtataaaatatttaaggttttgctgcttttattactttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgttgtacaacggtagatgccacaaatatctgctgtcatgaagctcagtgttttattttttgatacctcagagtatctccagttgtttttatcgttagtttcttcatttattcaatataaagacattgcgctagatacagaaaacatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacacacacggctatatgtgaatcacctggctttagtctttctttcctccccagttcttgccatgattcgagggcttcaagagttcatgcagatgatacttctcacaccttggtctggcagttttctttctttctttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgctggaggtcaggagtttgagaccagcctggccaacatagcaaaaccctgtctctactaaaatacaaaaattagccagccgtggtggcacatgcctgtaatcccagctactcagaggctgaggcaggagaattgcttgaacccaggaggcggaggttgcagtgagccaagatcatgccactgcactccagcctgggtgatcaagtgaaactgtctaaaaaaaaaaaaagaagtctttactataattcttttaaaaaaccttggttcatcttgaaagactgatgaatttttgaaatacctgcagaaaaggaaaataatcccccccccccccccagaaatacatacaaaccacttattggcacttgtgttttaagtacctggagaaaaacaggacagatttttaaaggcaattaataacagcttatacaaggccttgtttcatttgctttagcaccaagtaaagtaagagtaaatatgctgtggaagatggtcaggtttttcctccttctctcatatgccccacttctcctaccaggtcacagtacatcagcagccatccttgttgccccactgaggaatcactttagattccagtatttaaatggctgctcagatgaaaccagtagaattctttccccttaagataaggtggcagtgaatgctagcaggtatcaatttctttgatcaggaacaaagaactccttcagaaaactcacttttttggtctttgttaacctatcctgtgaattctttttattggcacaccttgtttacgaatcatgattgattgctatttatgccaagggaacattccgcaggcatgcctgatctatttactaatgacaaagtatgcttactttacataattccataggttttctcttttatttttgggaggaggggtataataacttgttatttatcagggcagatcatatatttggatcaaaaagagaaactggcaagtagatcctaaaacacatttcttaacccgagtaacatctgaaaacatagatttcaattatattttgttgaaaattcattcaactttggtgcttatccaagaacttataatgtcaatttctgacaaaaattataaccctcaatacatatgtattttcaaaagaagagtcatcttaaagtaatatttttctgtatgttaattgatacatttttatagcaaattgaaaattctgagtaaattgaaagtatgtttaacaacaaaataaatacagcatatatggttagcttatatatttattagtgtaaaggcagcagtgaatttgtatcttacaacaaatctgtgaatccagttgcttttttttctggaattttatgtagtatcaccatgctccacaatgctagaaatgtggcattaatctgcaaaaatttctgatgagatactttccccaaatgacatgtaactttttaaaacttttccaaaaaatatggacattttatcaatcacttaatcttttttttttgagacagagtctcggtctgtcgcccaggctggagtgcagtggcgtgatctcagctcactgcaagctccacctcccaggttcacgccattctcctgcctcagcctcccgagtagctgggactacaggcgcctgccaccacgcccggctaatttttttgtgtttttagtagagacggggtttcaccatgttagccaggatggtctcgatctcctgacctcgtgatgcaccatctcggcctcccaaagtgctgggattacaggcatgagccactgcacccagcctatcaaccacttaatgaacaaaaagttagattactaccaattgttcatttaattttgctctaacgtgttttaaaagttaagacatctctgatggttttgcaggtgactggataaaacacactagatgatttcaaaagattaatcttagtatctgactcgtttggcacatcctcagtatccagaataaaatcagtagaaataaaagtaatataactttcaaagaattcatacatgctggaggtcttaggaaaagcagtttttaaattcaaggaataggaggtttgctcatcttactagttacacacatttctcctcatggagtaatggcagctttctggcttctttgtggaactttagtttgtagaaaagcttggtaatattccaggactggctttgtttgggcttcataagcctttagtcttttgataaccgtctctggtttatcatcctcatgctgaatgagaggatccccagtcagatcatcagtgcccacagttttgggagggttgaattcaatgttgtagactcagccactggcaggatgaatctagcgagcagtaaggcattgtttaatgacctcaaagggcacattcgggctaatcactttgtctgtctaagaagcttagtctagggcttctgcctgtggaagtgtccatggaaaaccacccaacagctagctatactaagtgagatttttcagctcatatagggccagctgagtcatgacatcatctcggatgagtttcctttggtcaatgaaagcgttagctaacacattaatttctgtgccccacagcatgttgatcctggagcaggtctccgctagagaggtgcttcacagtgtttggtgacgcgcgacaactagtgctgttgcctagcccagggcccccatgatcacggctgctgccgcgtagacgcccctttacagaccaaggcccacgccgcacccgaacaagggctttggcccagcctgtgaacttaccttctctgccgcccaggcccagccagctggcagcgctgctagtgggcggggactgtggctcccaggccttccctgaactctggtctagcagttttcttgtctctcaactttagtggccattggtcactgtactggaaacctcgtgtgtctttctcacatcctcttggcctctgattccagctggtgctgctgggaacagtcggtggctcactcctggctgactgcatgctgcctcaggtgcctctcttttgctttttcccctgcggctcctctaaccaactttcttgtctgttccctcttgtctgtcgctgggcacgtgcactgtagttcttagaagtgttagtggagttaatgccctttgaggcgactttttacctatgcaactggagttgatccatttccccgttgactttcactggacagactttctacgtacttctcaaaagttttccacaagatcaagcccccaggtactcagtatggtaaagatagtatctttgtattggctttttctctttttcttggttcactgtcttcaaagtgtctctctcttttcctggggtcaccttccaataaactgcctgcacaccagttctgttcccaggctctgctttggacagaaccctagctaaaacaatgacctggtactgtatttttaatacaggccttttcccccaagactgcctgtctctgaaattgtaaattcttaactgtcgtaggttccagctcttttcacttccttgtttccgtggtcccctctcctctcacctccctgttgtgatgtctggtcttttgactttttcctcttgttaactttttggtagcactgcaccttctttgccccccacccccacctttcctcttgcacctgccctgcacaccagggaatagatttagtgattccaaattggagtctgagggaccatgggaggtattctcagagatttgggcatttctacaaaatttaaaaaaaaatcatgctttcatgttaataataaacatttagtttatctggttgaccatcttataacccagtaatataacttcagaatctatgtttgtacttggaagttaattttggtttcataatgtttaagagctatgagcatgagacattttatatctatctataagttggcttatatacttaaagtaattgaaaatttaagttgtcacttggatgtctatagtaacacttttctgtttagagaagttctgcacattaagtaattctgagacattcttctgagtaatgtcagagaaaaatgtcatacaattcaatatggttcagtgaaaatatttttaattttttaactttttgaggcagggtctcactccattgcccagcctggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccaaaaaaaaaaaaaaaagagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctcaccattgcaggctctcactgtaatcccattgcatcttcctaattttctgcaacccctaagccgtacctcttttcctaggagttcttcctatttcagaaaaaaacagtcatgcatgaatgaactctctttgctttctcacctcctgctctgccttagaagaaaggcaccatgtctctgtttagggtgatccacccccttgggctgcacatgccatccctctttgctccaaggaggcctggcttcatcactttccttttctcttttcctgtgtcttcacctcttcaagtttgcccccagttctcctttcttcctaagtattcttttcatcccaatcacatccattttcataagttcggttagcacctagattatgacaactctcatgtctgtgtctctaactcttgacttatctcctgagatccatactcatgtcctagcttcccaataggcatcttccctagattttgcaataaaacaaacctcattttttcccctaaccccattctccctcgtacatcttctttattttaaagtgatgattattctaaattcctttctttctcccatccttccttctccaagtaagcagcagatccctcatagctaccttctaatcattgtttgttcgtcttcttgtttgttgctgttatctgaatttagacatttgtcacctctcacttgaacctttgcagtaaattctgtatttgtcttccagctcctgtcttgccccctgtccttttctccactgagtttctgccatgtatatgtagaggtattactagcctgcccaaattttttcagttcccttcctatttatagaatggaatccaaactcttttagcatggatggtatttggctctctgtaacgtagctcttcctgcttgcttggtcttcgttcctgttatttccaactcataatttaagtctcagaaatacttcaagattccttttggcctttctgatattttaagattttaagataatataacttatacttacaatagaaaattataaggataaaataatcactcattccaccaacaagatatagttacaaaaacatacatttttctagtctttttttctataaagagagaaaaagtgagacagttccaattttgggttgcagggagctgcccaaatgcatatgcttagaaataagattaggaaggagttattataattcgcctcgggacttcatggctttgtatatgcaggccttttgcttggaatatcttctctccacttttctccacacccatctcctatgtgccttcaggtctaactgaaacactgccatgtgcctgatgcctctgaacttgtccaggcagatttcagtgtcctcagtgcactgtgtccttgtttattactgaaaccatcatatcataataatttgtatttttgtccttgaactgaaagttccctgaagcagtgacccttgtatttcctgatatggctcaaaacctgacagagttgtctgaagaggaacctccagaaaggcagggggaaaccagtagagttcaagggagtagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatatatggttgggcatggacatcagttacacagttatgtgccacataatgacttttcggtcagtgatggaccacatacacgacagtggtcccataagattataacggagctgaaaaacacctgttgcctagtaatgtagtgtcatagtgcaacacattactcacatgtttgtggtgatgctggtgtaaacaaatcgaccatgctgccagtcttataaacgcatagcatctaaattacagtgcataatacttgataataaacaactatgttactgctttatatatttactgcactatattgttaatttttttttttttttttgagatggagtctagctctgtcgccaggctggagtgcagtggcgcaattttggcgcactgtaacctccatctcctgggttcaagtgattctcctgcctcagcctccagagtagctgggactacagatgcgcaccaccacgccaagctaatttttgtatttttttgtagagacggggtttcaccatgttggccaggatggtctccattacttgaccttgtgatctgcccatcttggcctcccaaagcgctgggattacaggcgtgagccaccgcccccagcctgttgttatttgagagagtatctctccttacagaaaaagtaaaacagcctcaggcaggtccaggtccttcaggaagtggtcccgaagaaggagatcttttaggagatgacagctccatgtgtcattggagacaggatatgcaggcgcaagacagtgacattgatgatcctgacccagggcagctgtgcaggctttaggctaatgtagtgtgtatttgtgtccacagtactgtgtatagtaatgtcagtaatgtcctgttcagtgtgtgttctgtgcagtgtactcacttgcccctctcactcactcactcactcactcactcactcactcactcacttacccacccagccatccagagcagcttccagtcctgcaagctatattcatggtaatagaggtgcatcaattttaaaatcttttgtaccatacttttactgtgtagtttttctgtgtctaactgtgcgtagatacacacatgcttactgcagcattccagttgcctgcagtattcaggacagtcttgtgctggacaggtgtgtagcctaggggcaataggctgtaccgtagagcctggatgtgtaggaggccacaccatctcggtttgtgtaagtgcactgtgatggttgcacaaagatgagattgccttcgcatttctcagagctctttctttgttaaatgacacatgaaggtactgggttgaggagagggaaggtaggtaggaaatggagaccagtgtagacaactgtttctaggtctttgaccgtgaagaggagacaagcgttagaattaggacagcaactgaaaggcatctttccctgttatcccctcatactctgttttatatggaatgccattgggaggaaaccccttcaggtccttttctcagcataagaatcacctggagtccaggccccatgctcagggattgtggattttaagcctagggcatccaggtaaacccaatgcagttgttctctaggcccacttagagaagtgctgtcctgggagctttgtggcgtaggacttgggcacctgttccttccccttccatgcgcatgtgcagggggcacccagtaccggtagaagggaaggccagcagcattgaaagcgaggctccctggccctctgcctctcctttcctgtccgggtctctgtggcttgcttccctcaggccacttctaactgtggtctcctctccgccccctggtcctgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaagggtttcagaaggttgactttttgccttgtcaaggtttatagaaggaaaggacagtgacatttaaagtagtgtggctccgaatgttaggaatcattttctgttacctaataacttcatcttagtggtgattgtctgaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttgtcatagctttggaatcgtgataacattatttgacttgcttagaattatagtctaatggatttactacacactaaaccttttagacaggccttgaaaggtgaatttggtaggcatttcacacttctgtgacactcagattttgctggtctcttggatacagtcacaagtgatatgtaagcaaaactgcaagctcaggcataacagcctgctgggctgagcacgattgcagaagtgaatgacttttcacgttacgcttaactcttttctctcgggtgctcagagcacaacttaaagcattctctctgagccaggggaatagcatcctggaatgtaagcccttgaagatggaggtctgtaaaagaaatattcagtgttaacttggaattcagtgaacttttttcatattaaaggaaatttgtcaagaaaaataattgcacagttaaattgtgctacagttgttttcattaagaaagtagaaagaagaccctaacagtttaaaaaacaaatggccctcattgtctttatattgtgcatataactctttgttatcttcagattatatgaaactattagtattatttttatattcttctcatctttttttcttttgccttgagaaagtcacgttcttctcattgtgtactttacatccaaaattattttgtaactctttttttttttttttttgagacggagtctcgctctttcgccaggctagagtacagtggcgcgatcttggctcactgcaacctccgcctcccgggttcaagcgattctcctgcctcagcctcctgagaagctgggattacaggagtatgccaccacacccagctaatttttgcatttttagtagagacggggtttcactatgttgtccaggatggtctcgatctcctgacctcgtgatccacccgccttggtctcccaaagtgctggattacaggcgtgagccactgcacttggccctctataactctaaatgttgctgcattttattattgcaatgactaataagtccctaaacttgatgcagttagatttccctgttattggatataggatatttacatttttgctcttgtgaatatactagagtactatactgaatgtgtgtgtatatgtgtgtcaccttttatatatttaagtatttccttagggtaaattcccagtagctggattattagagggtagaaatttttttatggtttttgatataaattgtcaaattatttcccaaaaagttgtatcagttcacagagctaccagttggtttctcgcagccatctgctatagttttgttgggttaaaaaactttctatttttgctagttcatcttatgttgctttaatttacattttccaataacgattaaacctaaactttttttgtataaatttgcttttttgagtatttcttcttgtggagggacagatacttatatataattattagattggctgctagtccaagagcagtaagtagttaagggatcaagtcagcaaccagtggccgtagccatctttgaccaatcaaagatatagattcatatcatcgtgaaagctttgattcagagaaaatagttatatatgtacctaatggtaggaaattggggtagttgtatttagtatatagaatattacctaattttttggttagaggttctagaagacaagactttttcagtttgtcttatgccctctttttttttgttgggggagaggtggggggtctggacactctaggaaattaaaactgagtattttacttattgcatgcatagaagttgattttcttttcttttctttctttttttttgagatggagtcctgctctgttgcccaggctggagtgcagtggcataatcttggctcagtgaaacctttgcctcccaggttcaagcagttctcctgcctcagcctccggagtagctgggactacaggcacccacgacgatgcctggctaatttttagtagagctggggtttctccatgttggctgggttggtctcaaactcctgacctcaggtgatctgcctgcctcagcctcccaaagtgctgagattccaggcgtgagccagcgctcctggcagaagttgattttcttaaaaaagagagataataggaaaacaagctcaaaaatctatttggggccttatgcaggatgttggccttagcctgaagaaataaaaactgatgaagcgcattgttagcagagggatgacttgatcaggtttttgaaaacgaatgttcagcattgaggtaactgaggcatctggatatgccggtctgggcccctgggagccgcaggagataatggagatagagattctatgggctgagaccattggtaggttttatggtgttgaggaatacttaacactgattttttttttgagcgctgttaattaaatgttaaaatataatcggtttgctttagagaaaggcacgaatggattctggggctctggtatggaagttattttcgcagtgtaggtgcaaggtgagggaaccagctagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttacaaccaattttctggattggactgatcagttcagtttgctgtgtgtttgctcaaacaggtaaaaacaaaaaattttcttagttgtcttttcatttccgtatcttgtattgcgctttgaccagttaggttcatatgagaacctaagtcataatcatgctgctccttctggaagccctgcaattgttcctcttactcagagaaaggtcaagttccttcatggtcaggctcccctcacccctgccacctgggatgatgggaggcaagttggctggtgaagtactaaaatgctagggattgaacacactgcaagaagatcttttgagaacatgagagtgtgtaagtgaacagaaggcaaaagcaagtatatttagaagcaaatgaaataaatgtgtagaatggaggattatgaactgtccattattatctgcaaagactttctagaagacattctcactctttgataaaaaagtctcacaaaatgttggcatcatctaggaaagcagtgaaaataaagctgaaaatgtatttaacccttctataaagatgtggctccacatctggaataatggatacgcagttctgtcctctgaatcttgaaaaactacactgcatagagcagttcgatatcaggattggaaggacttactacaagtagtaaaaatgaagcaggagaccgtaaaagaaagtattgataagttagttacataaaatcaataataacaaaaacattctgtgtcagaacaccgtaaacaagatgagaaactaaacaaaggttccacttcattaatgtgtatagaaatccaataaaaactgaggaacataacaaaaaaatttgcaaaagacataacaaaattataaaagaaatggttagtaaaaatatgaaacaatgtaaaacctgaaattgataggcttcaccaatgaattgatattctaatttacacttatgaaatgagcaacagttttttaacattaaagcacttcggttggaaatgtggtaaaatggtatttgtacactgccgttttgtgggagcttatattagtagtgttgccctatggtatccatggggaattggttccaggacctccttcagataccaaaatccacaaatactcaagtccctgatataaaatggcatgatatttgcatataacctacacatatcctcctgtatactttaaatcttctctagattacctgtaatacttaatacaatgtaaatgctaggtaaatagcttttacactgtattgtttagggaataatgacaggaagaaaagtatgtacatgttcagtacagacacttttttcccccatttttgatccgtggttgcttgaatccactgatttggaaaccacagacacagagggtcaactgtatattacttttggatagaaattagtgtgtatagagaattttagaaatgttaatatgctcttcaacttagtagttaattattcttttgggttttattataaggaaataatcagatgtgtactaaggtttatatataagatcatcagcatgtgtatgtgcatgtagtacagtatgtgtatatgtgtacttggggtgtttatatgtgcatgtgagcaagcatgtgtgaactgtgcacacatacatttggaaacaatctaaatttgtccagcattaaatagagtacacttatattgaaatacataatcattaaaagctttttaattctttttaaaaagaatttgtgatgataagaataaaacacttaggataaggtataaaaaacagtatacaaaactgtacaactgtatatataaagtgcatcctcagtttcatgtaaataatacatgtattaatatatatatgcttgcttccccttgctatttatctgcataggaaaaagactggaaagaaataggcaaaaatgttagcaacagtcctctctcagttaacagattcagtgagttggttctttatgctcttgtgtgttttccagattttctataagaagcatatgctggttttataatctcagaaaagatacgttggagacagtctgtattagcgcttaccatgtagaaggcatactcttccttaggtagatgcaaagaaacctaaaacatactttgaacatagagcctgagaaattctgggattatggattagatgaatatggacttttcagttatttaacatactgaaagcaaagggaaagccttgaagattcttgtgagtatggtaggagttaaatgacaagaaataatactttgcccagttttaagagaactcatgacatttatgacagtcaagaatgataaattctgaattatgtcttgtctttgatacagaagacaaggaagataacttatgtctctctgtggctttcagtgtcaaggtgatccaaaatcacaggtcccaaattttgcattgttctcaccggtttgtgggagctaaaaattaaaacaattgaactcatgaagatagtagaaggatggttaccagaggctgggaagggtagtgagaaggtggggaggaagtcgggagtgttaatgggtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaaaaattaaattaaaaaatcctgctctctttggggaaggtctagtttagatggtaactaggtcatagtattaatatttaacatatgtattgcattgtcattgtgattctgatttttcattattttctctctgacacttcacataaaatgttctgttctttcttctttctgacagatgaaaatagatgtttaaaagcaaatgccaaatcatgtggagaatgtatacaagcagggccaaattgtgggtggtgcacaaattcagtaagtaaggttgctcaagtcctttccatttgttctctggtcatttagtgtggctcagtgctgtatccttcagaagcacatattaatttttatgtaaatcataaaatgaataacctaatggtttggagctatgtggttcaacacagtagccactaggcagatgtggctattgagcacttttgtacaaattagaattgctctaagtttcaaagatatacaagatttcaaagacttagtattaaataaataataatggtgaaatgataatttttgtatatttaaaaataatgttataacagtgttaaaattttctctttttctttttttagtgtggctactaaacaattttaaaatacatatatttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaagcctactaaatgttcagtgagtcaatgaatgaatgaatgaatatatcaaaagagaaggtaaggagaagtcattttgaggttgtatagtttattcacagaatgaataactaatatcagaagatcaaggggttactgattttgttttcatgcaggcatttgggcccaagtttcaagtgcctatttttgtatgcctaagtggtcaagtgtcagatatgtcgtatggtttgaccacatgaaagaaaaaatgagaggttttgttgtttttcaaaaattttctaatggtgttttctaaaagtggtgtgttgggattacattggcaacagtggaggaaatatggagtgttgtgagtttgtctcaggcaaggcttatgtaactgaagctcttggttttcatatctgaaaatgaggatgataatatccgctttatctattgttacaataattagaattgatgaacttaaagcagtttcacttaaaaacttctaaataagtggtagctgctattattgttaacatatccattttatggggactacagtttatctgtagttaaggattatcttagcctttgagctttggagcataatccttaaaattttaaaggctttctgaatatattcagtgaaattgtatttgggtgtcatgattgtaaatttcgtggattgattagtatttagaaatgtgtaattcactaggatcttgtgctttggtaggtagtagtttaggtttaataaatagtgcagctttgaattatctgattcttggtattcccttccagttgttgattacataaatactctcattagtatgatgtttctcttaaaaaatcttatgtaaaaactattgtgtattctttaaatttaaatatcttcacttactgttactttatacagcaccgttaaattgatatttgataaataaataccatatataatgtcactgtttcccccacattttcacatttcttgaaacacctttattcacagtctttatatagatctttaacagcagtgtttttgaattcactaaggcacttttcagttatatgattaaatttttatttctaagttgtttgatgtataccacatttaaaatctctgtcattactagaaattttactactgcaaatatccattcacctgccattaggaactttttttccttttttgaaatttacctgccattaggaccttttacccttgtcatatacttactccttttacccttgtcatatacttactattttgctttttaaaagttttttaaaaacttatttacaataatagctaatacttaaagttttttcaaacctgtgggaatacttatttaatcggtgctaaatttcgtgttgtccttttaaaaaatgcaataattaattgagatgtttttaagctcgtctgttttccctaaacatcgggttgttcagcatattgcgatggggagagtgccacataatatgagacgctttgtaaggacttttcaaagggaaattttggagaaatgatctgatatttgggtgtatgtatacattattagtagccattaaccatgctcaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcatattgtttaaaagccagaattggggtacattagatgtgatttgatgttttgcaatttaattgcttatttgcaattattatgtaaaaaggtttgaccattacaattttcatttatacctatattttatatgtcatttagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggtatggaagcccaactctgtgaatacctgcgtgtttacttgaggcattcgacaccagctttatgcaaactctgaccagtttctgttgaaggctcgtttttacatgtggactggcactcaaaaatgtggaattgtttaaattttagaaaatttttgcagatataacaattgtaagacatatttacttggaataatattaaatgttgcctaatattcaaagtaaattttgttaaagattcagaaagtattaattagctttagtgagttttaaaaatgaaagtgttcatcctctggtctaattacataatatattataaaagcaacattttaacctgttcttttcctttgtatttgtttagtattattaaactgttaaggtttttgtaattatgtctgttagtcccacatctaaacatgaaggaaaaaacaagccctcatcctcgcttttctggtttccgacctttcttgtcaggagaatggtagagtggccctgtcccctgacttccctcccggcccctcctcaaccaggtcagccctctcctcctcatcctgctctagcaaagctccaccatcgccttcagcccgcagacccaggggacccttgtcaggattttttttttttaactcttctgtaccaagtaacactttgtactttttgaaatgctctgtccttgatcaatgataccactcctcggtttttctttgtgtctcttaccattgccttccaggcctctttttgtgtcttttttcttcctccctttttgcagtccacctaaatgtcagttttcctctcgtggctttaaaacccaattgtatgctgcagcaacacagacttttcttgagctccaaacccatttctccaattgcctattagaaatctatatagagaaaactacaagttaaaattttaattacattttcatccaaacctctctcctgtatttcctaagtaaattacattaacgtctcttgtatctctctcttctcctccttcatcatctctctctgggtttcttttgtagattagctagtctctttgcctcataatgataataaaaataaaataataaataataaataataataaataaataattatttttaaagctgtctgccaggctttctaaagtaaagatcggatcatgttattcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatcttttttatctttgcatcctgaaggcctggtgttttaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggtaggaatgttgggaacattgaccattttcattataaagtcttggcaattctcaaatgttgttttatattttattcctttgttactcacaacatacttgtgagataaacaagccagttttttagccttttctgagtggaagttgatattccagtcacacgtttaataatcttttctgccaccttgttcctctgtcactggatgctactgtttgacacagattgtacctcatagataatgacttgcatgcttattttcatactaacttgatcatttatcttatgacttactttattttatttttaagagtttcactcttgtcgcccagactggagtgcagtggtgtgatctcggctcactgcaacctccgcttcccgggttcaagtgattttcctgccacagcctcccgagtagctgggattacaggcatctgccaccacccccaactaattttttgtatttttagtagagatgggggtttcaccatgttggccaggctggtctcgaactcctgacctcaggtaatccagctgccttggcctcccagagtattgggactacaggcgtgagccaccatgcctggcccttatgacttattttataaacatgtgttgaatacccagattttatctaattgctaattagtatgtctgcacctgcccgtacagcctgatctcatcttagacctggatttttcatatgatgatgatctgctttccaaaccttatttttcccatttcatgcatccccagcttaacctcttttttgcctgcttctctccactcctgttgctctagaggtttagcaacagaatattagaaagatttgacagttatgaggcctaagagctgcctttcaaaaattagccctattttagtggaaacatttaaaaatagcacttgcttaaaatgttcttttattctgtaagcataattcaaggaccatggcattagggagctcctatcaaattagtgttttttaaaatggccagaattctagaatatttgtttattcatttgttcagcatgtcattattgagagctggtgtgccaagaaaatgaatgtgagttatttttaaagtagggaggcaaaataaaaagattgtcttaggtcttagtccatttgtgctgctttaagaaaatactataaactgggtggcttatgaacaacagaaatttatttctcacagctctggaggtgagaagtccaagatccaggcagattgagcatctggtgaggtccctcttctgggttcatagatgataccttcttgcgatgtactcacatagcagcagggagacagcagctctctggggcttctttgatgaggtcactgtaggagtctattcttacgttgctataaagacatatctgacactgggtaatttatgaagaaaagaggtttaattggtttacggtcctgcaagctctacaggaagcatggcgctagcatcagcaaggcctctggggaggcctcaggaagcttccaatcgtggcagaaggcaaagtggggagcaggcttctcacatggtgggagcaggagcaagagttggggagagatgccacacaattttaaataacagatctcatgagaactcactcactgtggtcagaatagcaccaagccatgagggattgatctgcccccatgatcgaaataccttccaccaggccgtaccttcaacattggggatcacattttaacatgagacttgggcggggacagatacccaaactgtatcagttactaatcccattcatgagggctctgccctcatgatctaatcaccttccaaaggaaccacttcctaataccatcatgttgggaattaggttttcaatgtaggaattttggggtaacacagacattcagtccatagtaacctacatttggtaacatagatgaattttttaaacaatgcaaatctctgtctttccatctatccatccattcattcatttatgtaccatttttttcttggcaggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggagtaagcgcattcatttcctatcaggggatattgtttctattatgtgtgtgaattttaagtgtgattttactatgataatagaaaaattgaccttaattttcatagatttgattatcttagagaagtaattttaagtaaacccttaaattgcctgtatacataaagtgcctttataaaagcatatttaatctttatgcaaaccacacagttagtttattcatgcgggcttttaaaagacagaatgctaaccatttgaaacagcggggcaacctctctgtactgtagctggtggtctggattttagaaaagcccatgtgtcctaactttctggctttgtactagagatagaattgatgttattatctgaggcatcaccaggaaccttgaaattgctcaaagggagagtgtcttgtatcattttcctttggtcagttttcttctcactgtctttgaaagacacatctttctcctgtgtcttagtaattcaaaaagagagaactttttaagctctagtttttaacctatatgaatagatgtattttgagaagtgatacaatatttgtaattttaattgtaagattttcagtagcaagcccatccctattggttcaataatttgtattttatgatccatgtagcagctatgtattttgagatgacactttaatgatgtggctgaggctgaaactagaagacattgtcatgtcaagtttgtcctgcgtacctactcttgtctcatttttgttccctccagtgcccccattctctagatgaccttctttgattttagaggcctcttagtggttatttttcagtcaatttttgctaaggtgctaattgatgcccaaaataataagtgaaggaatatggatagtaattaagaatttttctatcaccactgatgctgggcaatttactcagcctctccagggctgttttcttctctttaagaagggatcatgatagtatctacctcatagggctcttgtgaagttaaaatgcatcaatctctataaagtaccaatgagcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaacaagccataacacccttgattgtggctgtttttctgtgttggtcatgctgatccactcctctagatgcaaaagaatcagacattccacttttgaaagattgccagtattaataaatgtgattcccaccttaaagtattttactgtcttatgaagatctaaacagacgtattaaataaattaacgaaagcaggtaaattcctatagtcctatgattttataattataaattaccatagtgacaagaagattttacagttactttagattctttattggaaagggcaagaataaagtaaatgagtgcataaacagtactgattgaggagttagaatgggtgaaattatccttaaacaagatacttatttctgttataaaaaaaggaagcctcatatggtgggctgataaagaaggtgcatggcatagaacatagagcagagatgggtggatggggacaagacagcagcagtggggtaaagtaaggataggctcagacactttcatttattcagcaaatgctcatcaagggcttactgcttgccaagcagtgtgctggcttgctagctgctggagatatgatgataagcagaactaaaccaaaccaaacaaaacaaaaaaacagtttttaaaaagaactgagagattgagagatacggatggtcaggcaagatatcgttgtacatgggatggaagagcttcattcagtgggctttgtgtgtttctcagcaagataattaccattgtataaagagaagacacagaaaatacagaattaggttaaaaatacaatggtggcctatatgaaaattaaaggatttttgttgaattactgtgaatagtgttttaaaattgaaatccttttcttttcaagtcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgtaagtgcctggttccttacatagtgaatgtgtttatgttggattttaatgtttaatactaagagcttgtgggtgactggcttggggtttctcagggtttgaggttttgctgttttggtaagtaggggtcctgattgaaagtgcaggaaagctagtgttgctgtttgtgaagatgcagctttgtatttgcttccttctgctcagacaagggcctcactggggtgggaaagggatgcccagatgccactttcactctttgcctcaactccccgcccacagcatttggtagcacagtcagtactctttctaaataaataatttatctagtctcatactctttgttttatacgatttttaaaagcagtcactctgcctttattgaaaataaatattggcaaagcattcaagttctagaagaaatccaaatggtaaatcttggtctttttcttaagttgtagataatagaatatttaattactgactattctttaatttcattgtccttatatttaatatacatagataaacttactatttaaaaccttttgaatatggaattttttattcatacatgaaagtaaagagaagaggattagcaattcatgtatacacacgactcacttcagcagtttatatttgatactgttatttgaaagcagtcttgtaatctagttatatgtatgcaactagatgtaatctagctatatatggattatatatgtaatctagttatctaaagcagtcttgtaatcgagttatgtgtaatcttgcatgtataactagattgaaaaattagaagagattataagggtgtatttaaatactaaattatattacttgatttcttaggattatccttctattgctcaccttgtccagaaactgagtgaaaataatattcagacaatttttgcagttactgaagaatttcagcctgtttacaaggtaaatgtgtgagataaaaagaacaagattctaaacatttttgattgttagaggcaaatcatgtctgaattgaaatgtgggaaaatgccaccagataggcaaaccgaattttacaaaagtggtttatattaatttttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttgagaatactttgtacaaagaaagtaaaacttccttcatacacactttagcgagcccaaagtactacagaaaaacttaaattctgtatgtatctagaggaaaaactttatacatattgtcttacaaaagcaagattcatggcctaaacaaagtgaaaatgtgataaaggcatgtggggagtatttccaaataactgtttgtttatcattaaggaatagatctccttgttagaaagcaattgtaaaacataacttacatttaaacttacaggatttctccaatctttttcctccccaaaatatcctttatagagtcatctattctgatgaattgtgctagaaaagtttttttttttgccaattcttctcttcccatatattcagaggatatgggtttctatttcaggaggtacacactcatatatacgtataccataaaatatataaaaatgtaaatatacatgtgatttgcctatttcaaaaagatttatagtgttgttttcccctcacagatgggaggaagttgaattgaaattaaagaggaattggcttatcctttttgagcataattcagtgtactttaatcacaccgagttagccttcattaataatcatttaaataatctgaaggcggttgtaatttggtaggtaacccttgtgtgtctcgtgcaccactttcagcccccatccccctaaccctttggcagcttgaattttagacatttttacttcatgtcatgggggtaccataacgctttggaaaggccagcctaccatatgaggcttcccttttttatggggtaccataatggtttggaaaggcctgacttggaggggtttttataaaggtttttaatattttacttgttccacagcttttcccattctcccctgtcttagataattttcctaactcttgttctttcaggggtgtgaacaagagatagcttgccattgtacccttctccatttgtcctgaatagtctcatatgttaaacaagccctggcttgaatccttccttcttgggggattttgtttttttttttttttggctgggctacaatggttccttaagcaaatttgttcctagactgcatagttgattgtttaccctagtccatagttagctggagaggtaggactacagaaatgccattttgccgatggggaagacagcatttatttcgtttttttttggggggtttttgtttttgtttttgtttttgttttttagatggagtcgcactctgttgctcaggctggagtgcagtggtgtgatcttggctcactgcaacccctgcctcccgggttcaggcgattcttctgtctcagcctcccgagtagctgggattacaggtgcacactgccatgcttggataaattttttttttttttttgtattttagcggagatggggtttcactgtgttggccaggctggtctccaactcctgagctcaggcagtccacctaccttggcctcccaaagtgctgggattacaggtgtgagctaccacacccggcctattccacatttttaagactcctcctaattagtaacagccctctgcactgtgtgatcctgagtattttaactcagtgattaaaacaggaatactcttttcaattgtgtattttattttaaagatttgatccttattaattaaaacctgtttctctggcctctgtgttttctagttactcaattggatttggcttgtagatactttattgaaatatatttttttctgagcagtttatccattggttttatgcattcaagtagcattttgtttgacttttcctgtgtataattaggcattcttttagtccctttcctcagaagtcattttggaaaacggcaaattgtcagaaggagtaacaataagttacaaatcttactgcaagaacggggtgaatggaacaggggaaaatggaagaaaatgttccaatatttccattggagatgaggtatgttgtataaagcattttctgtagaaaacattggttatttataagcaaatttagtttatagtttgagaaacattaaaataagtgagcaactttttgaaatattttttagtagatttaaattgtttagttggttgttaatcttttttttcccttcaaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtaagctgggtgttgtcagacagtgacagagctacattggtttagagagtataggcaggtcatattttgggacatccagagaatatctctctatttggagcaaattattttttccaaccacggttgctcaccacaagatcagtttgatgatcttgtgtgtgatatttatagaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatggaattatgaagcagtagaagatgtttgtcttgtactacatgtacttctgcattgttggaataatttttaaaaaataaatgtgtgttgtaaaatacaaaagagaaaatggtattttcagtatgtagaatctagtactaagaaaactaacaaaattacttcagattttattttcacactgtggttactttttgtaattgaaaatgaaaaactgagtatacattgaataccgctttctctgtaaaagaataggaagagggaagagtgtttaatccagtgtcagccccaaaagactaggcttagaaggctattgactatgaaagaaatatatggctttagctcactatcaatttttaattgtctgtgctaagtaacaatttaaatgttagagtttctttatcttccatgttgtacatatcctgttttaatcatgcaggtccatttttagtaaaatgtcatttaaccaaaaagattatcttgaaaatactttgcctttctttcctttatatttttaccagatacagaatcagtgcagtcagtgtccatgagcattatgtgttctaaaaatacacagggaacctgaaaagtctgcacatgtaggatatatttatttttaaatagtatactagttatattttaagtggtatacacagtatgttttttttcaacttccatacacttttttgcatgtgtttattgtatttttttaggttaacagaccattgctttaaatttagacagttcacctggaatagtaaatgtaatagcataccatttgaaaatgtaactaacgtgctctttaaaattaagtttattctgcctttccacatgtgtcattcactattcattgctagattacatttttgtcttgaccaaaatggttactttcctgaagaaatttttttcctagactcttgcatatattccgtatgaacttgagtggctggaatgtacatgtgcgcctgtgtatgtttgtccctgcttgcacatgtgtgtacactttactacacgactgtgacttgtggcatggacactcccacctaacagattaggagcttgaagagattttttatagttttattttctttcccagtttttcccttttaaattattattattattattccctccaagatgattcttcttcttttttattatactttaatttctagggtacatgtgcaaaacgtgcaggtttgttccatatgtatacatgtgacatgttggtgtgctgcacccattaactcgtcatttacattaggtatatctcctaatgctatccctgccccctacccccaccttatgacaggccccagtgtgtgatgttccccaccctgtgtccaagtgttctcattgttcagttcccacctatgagtgagaaggtgcagtgtttggttttctgtccttgcgatagttttctcagaatgatggtttccagcttcatccatgtccctacaaaggacgtgaactcatcattttttatggctgcatagtattccatgttgtatatgtgccacattttcttaatccagtctatcattgatggacatttgggttggttccaagtctttgctattgtgaatagtgccgcagtaaacatacgtgtgcacgtgtctttatagcagcatgatttataattctttgggtatatacccagtaatgggatggctgggtcaaatggtatttctagtcctagatccttgaggaatcgctacactgtcttccacaatggttgaactagtttacagtcccaccagcagtgtaaaagtgtacctatttctccacatcctctccagcacctgttgttttcctgactttttaatgatcgccattctaactggtgtgagatggtatctcattgtggttttgatttgcatttctctgatggccagtgatgatgagcattttttcatgtgtctgttggctgcataaatgtctccttttgagaagtgtctgttcatatccttctcccactttttggtggggttgtttgattttttcttgtaaatttgttggagttctttgtagattctggatattagccctttgtcagatgggtagattgtaaaaattgtgtcccattctgtaggttgcctgttcactctgatggcagtttcttttgctgtgcagaagctctttagtttaattagatcccatttgtcaattttggcttttgttgccattgcttttggtgttttagtcatgaagtccttgcctatgcctatgtcctgaatggtattgcctagattttcttctgaggtttttatggttttaggtctgacatctaagtctttaatccatcttgaattaatttttgtataaggtgtaaggaagggatccagtttcagctttctccatatggctagccagttttcccagcaccatttattaaatagggaatcctttccccatttcttgtttttgtcaggtttgtcaaagatcagatggttgtagatgtgtggtattatttctgagggctctgttctgttccataggtctatatctctgttttggtaccagtaccatgctgttttggttactgtagccttgtagtatagtttgaagtcaggtagcgtgatgcctccagctttgttcttttggcttaggattgtcttggcaatgcaggctcttttttggttccatatgaactttaaagtagttttttccaattctatgaagaaagtcattggtagcttgatggggatggcattgaatctctaaattaccttgggcagtatggccattttcacgatattgattcttcctatccatgagcatggaatgttcttccatttgtttgagtcctcttttatttcgttgagcagtggtttgtagttcttcttgaagaggtccttcacatcccttgtaggttgtattcctaggtattttattctctttgaagcagttatgaatgggagttcacccataatttggctctctgtttgtctgttattggtgtacaggaatgcctgtgatttttgcacattgatttttgtatcctgagactttgctgaagttgcttatcagcttaaggagattttgggctgagacgatggggttttctaaatatacaatcatgtcatctgcaaacagggacaatttgatttcctcttttcctaattaactgatgggcttccctttgtgggaatattgttatgtgttatttctttctcctgcctgattgccctggccagaacttccaacactgtgttgaataggagtggtgagagagggcatccctgtcttgtgccagttttcaaagggaatgcttccagtttttgcccattcagtatgatattggctgtgggttgatcataaatagctcttattattttgagacacatcccatcaatacctagtttattgagagtttttagcatgaagggctgttgaattttgtcgaacaccttttctgcatttattgagataatcatgtgttttttgtcttaggttctgtttatatgatggattacgtttattgattgcctgtgttgaaccagtcttgcccagggatgaagccaacttgattgtggtggataagctttttgatgtgctgctggatttggtttgccagtattttactgaggatttttgcatcgatgttcatcagggatattggtctaaaattctctttctttgttgtgtctctgccaggctttggtatcaggatgatgctggcctcataacgtgagttagggaggattccctctttttctattgattggaatagtttcagaaggaatggtaccagcttctgtttgtacctctggtagaattcggctgtgaatccgtctggtcttggactttttttggttggtaggctattaattattgcctccatttgagagcctgttattggtctattcagtgattcaacttcttcctggtttagtcttgggagggtgtatttgtccaggaatttatccatttcttctagattttccagttaatttgcatagtggtgtttatagtattctctgatggtagtttgtatttctgttggatcggtggtgatatcccctttatcattttttattgcatctatttgattcttctcttttcttctttattagtcttgctagcggtctgtcaattttgttgatcatttcaaaaaaccagctcctggattcattgattttttgaagggctttttatgtctctatctccttcagttctgctctgatcttagttatttcttgccttctgctagcttttgaatgtgtttgctcttgcttctctagttcttttaattgtgatgttagggtgtccattttagatctttcctgctttctcttgtgggcatttagtgctataaatttccctctacacactgctttaaatgtgtcccagagattctggtatgttgtgtctttgttctcactggtttcaaagaacatctttatttctgccttcattttgttatgtatccagtagtcattcaggagcaggtcatttagtttccatgcagttgagcagttttgagtgagtttcttaatcttgagttctagcttgattgcactgtggtctgagagacagtttgttataatttctgttattttacatttgctgaggagtgctttgcttccaattatgtagtcagttttgcaataagtgcggtgtggggctgagaagaatgtatattctgttgttttgggatggagagttctgtagatgtctattaggtccacttggtgcagagctgagttcagttcctggatatccttgttaactttctgtctcgttggtctgtctaatgttgacaatgtggtgttaaagtctcccattattattgtgtgggagtctaagtctctttctaggtctctcaggacctgctttatgaatctgggtgctcctgcattgggtgcatatatatttaggatagtcagctcttcctgttgaattgatccctttaccattatgtaatggcgttctttgtcccttttgatctttgttggtttaaagtctgttttttcagagactaggtttgcaaccactgcctttttttgttttccatttgcttggtagatcttccttcatccctttattttgagcctgtgtttgtctctgcacgtgagatgggtctcctgaatacagcacactgatgggtcttgactctttatccaatttgccagtctgtgtcttttaattggagcattttgcccatttacatttaaggttaatattgttatgtgtgaatttgatcctgtcattatgatgttagctggttattttgctcattagctgatgcagtttcttcctagcatcgatggtctttacaatttggcatgtttttgcagtggctggtaccagttgttcctttccatgtttagtgcttccttcaggagctcttgtaaggcaggcctggtggtgacacaatctctcagcatttgcttgtctgtaaaggattttatttctctttcacttaaagcttagtttggcttaatatgaaattctgggttgaaaattcttttctttaagaatgttaaatattggcccccactctcttctggcttgtagagtttctgccgagagatctgctgctagtctgatgggcttccctttgtgggtaacccaacctttctctctggctgcccttaacattttttccttcatttcaactttggtgaatctgacaatcatgtgtcttggagttgctcttctcaaggagtatctttgtggctttctctgtatttcctgaatttgaatgttggcctgccttgctaggttggggaagttctcctggataatatcctgaaaaatgttttccaacttggttccattctccctgtcactttctggtacaccaatcagacatcgatttggtcttttcacatagtcccatatttcttggaggctttgttcgtttctttttactcttttttttctctaaacttctcacttcatttcattcatttgatcttcaatcactgatatcctttcttccactggatcgaatcggctactgaagcttgtgcatgcatcacatggttctcatgccatggttttccgctccatcaggtcatttaaggtcttctctacgctctttattctaattagccattcgtctagtcttttttcaaggtttttagcttctttgcgatgggtttgaatatcctcctttagctcggacaagtttgttattaccgattatctgaagccttcttctctcaacttgtcaaagtcattctccgtccagctttgttccgttgctggtgaggaggtgcatttctttggaggagaagaggtgctcaaattttagaattttcagcttttctgctctggtttctccccatctttgtggttttatctacctttggtcttcgatgatggtgatgtacagatggggttttggtgtggatgtcctttctgtttgttagttttccttctaacagtcaggaccctcagctgcaggtctgttgggagtttgctggaggtccactccagaccctgtttgcctgagtatcaccagcggaggctgcagaacagcaaatattgcagaatggcaaatgttgctgcctgatccttcctctggaagcttcgtctcagaggggcaccgggctgtatgaggtgtcagtcagcccctactaggaggtgtctcccagttaggctactcgggctcagggacccacttgaggaggcagtctgtccattctcagatgtcaaactccgtgctgggagaaccactactctcttcaaagctgtcagacacggatgtttaagtctgcagaagtttctgctggattttgttcagctatgccctgcccccagaggtgttgtctacagaggcaggcaggcctccttgagctgcgatgggcttcacccagttttagcttttttttgctttgtttacctactcaagcctcagcaatgggggatgcccctccctcggcctccctgctgccttgcagttcaatctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtattgtttctagaaccagaacagtgccaatattaaaatatactgtaaataaaatgcctgccatgtggaagcctactctttaattcttaaaagttctttctcaacagctagtatatattacatggtatgaagtgtgtcatgtgagagttgtactattattttgatctgaatgtgctagataattgaatttacatggtaacctttattttggcaattaagatttaatttaatttaatttgtcattaccaatttcttaattactgtcttttgacaaaactaagccaaattaaagatttttcctcttgaaggattattatactagtaacatattatttaaattattatgattttggccgagcacagtggctcacacctgtaatcccagcactttggaaggccgagacaggtggatcacttaaggtcaggagtttgagaccagtctggccaatgtggtgaaaccccatctctactaaaaatacaaaaattagccagatatggtggtgtgtgcctgtaatctcaactacttgggaggttgaggcttgcttgaacccgagaggcagaggttacagtgagccaaggtcacaccactgcactgcctggatgacagaacaagactccatcgcaaaaaaaaaattattatgattttatgttacatatttaatatgtgatagggctaatttattttactatcttttatttcttaatagggttttaatttgaactgtaataaatctttaattttattatggaaattagcatctttttacataatttttctatccacaaatgtaatgttcctcttcatttattgaaatcttccttcatagctgtttgttcaatttggtcacaagagtttagcatgggaaatatgtttaagcaaatatttactgaaataataaaatgtaaatatcataatttgtgttttttgtaacagagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccaggtagaaatgcgatgattgcagacattcttttcatatcttgtatgtcttgtttctgcttatttaggcctaacatccagaaacagcctccagctggaatattttaggtcaagttgggaaatttttcatctctcaaagcttaaaatattatctaattaactgtataagaaataaggaaaagagagttccacttttaagttttctgagtggagagtttgaagattaaatacagtgatttatataagacgcttagtgatttatataagacacttagaacgatgcctgacaccaagtgcatattaagagttttttgatgattgatgattttaaaattagagcttgatttaagcttgaatactgggaaagataatttgttaaaggatattaatataaagtgttgaatttgttcaacttctccggaggtgaaactttttttttttaatcttagttttcctagtagcctttttgtagattctttggaattttctaccatagtgtacatgtttttgtgtgaacataagccttcatttctcttgggtaaatactaaaaatggcattttggagcatatggtaagcatatgtttaactttgttaagaagctgccagactcttagactcccatactgttttgaattatcagctaggtgttttgcaaatattgtctcccagcctgtgtctccttatcatttcatttttttaagtgtcttctgaacaccacaggttttaattttgattaagtacagtttaccaagtttttcttctgtggctcttgcttttacattgtctttaagaactctgcctaacccaagattataaggatttttctcctctgttttttggtagaagttttatagtttctggggtttcacatttagatctgtaactcattttgagttagtgtgtgacaaaaggctcagtttttttcatgtcagtgtccacttgttctaggggcatttgttgaaaaaagactgtcttttctccacctttgttgaacatcaggtgaccttacatgtgtaggcctgtttctgactctgtattctgttccatgtatctgagtgttagctataccacatggtcttgtagctttctttatagctaggcctgaaagcagggtcttccaactttattcttttacaaaagtgtttttgagacacttccttagttccctgccttccatgtaaattttagaagtggcttactgattgctacagaagttctgccaggagtttgagtgggataccattgagtttatagatcaaattgggaagaattgacgtcttaacggtattaggttttgtaactcctgcacatggaatatctctccatttattcagtctgaaagatttctttttatcagtatttagtaattcttaacatgcaaatcttgcatatattttgttagacttatatgtaagtttttcatgctttttcattctgtagtaaatattactgtttaaaaacttatattttcaatatgtagaaataaattatatatatagaaaaatacatgatttttgttcattgatcatgtatcctgcaaccttgtaaactcacttgttagttctaagagctattttatagattctttgggatagtgtgcgttcactctcttgggtgtttattcctgtatgttttttataagacactgcacagctctttgtggtgctcattattaccttcttattttccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggcttttctttttgtatgttaacttcgcgtttagaaagaccgtaaaataagtaatgtgatatagaaacagcagccatgttgtagtgaaaagagaatgtgctttgcaatcagttagacctcaggtcaaatcccacctcttccacttagtaagtagaacagcattgagtcacttcacttctctcaactgtcacagggagtcagtactctgttttgtatggggtggttgtatttggcaaatgcactccagtatatgaaatcagcctgtcagctctaatcctcataacagtcctgtgcctagaatgatattatcctattatcttttgttctttttctgtttatttatttatttattttgagacagtctctctctgtcgcccagcctggagtgcagtggtgtgatatcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacgaatttgttatgagtaaattttagggttggatagtgaaaattgatcatgaaatccaaattgcaaaatagaaaaatataacctactatgatatttgtatggtatgcaactacaatatcattattggttctcaaaagatttgagatcagtttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctggaagatttctgcttttctcactgcctaccttattgtgcagataaagatggtattgggaacacttacataaaaatcactgtgtctcaggcatgattctgaccacttaatctgtgtttaatcttcatagtgaaagttgtaggaatgttttacatatgagaaaactgagacacataagggttatgtaacttgaccgagttcccacggctggttagtcagagagctgagatttgaacccaggcagttgggctccagagtccatgttcttgtctatgacattgtacttggtagcagttatgtatcttcagaagtcccgttacctggttaggaagaggtagatcactctttatagagatttacagcccttttacaatttgttgttactctgtcagagttaacactgctgctgttggcaaacatcatgttagggaaatcactttaatacatggaacccagtgctgttgttgtgttttttgactattgagagtgtgcttacaaactgatcatgaataagagcctacagtacaggaatgtttaatagttacaagtgatataggaagtgctgataacattagaaatcattaacttgtcagatttttatttctaagtagaccgtaagatttttaaagttaaatttgatggcagaaaattatattcaaattcacatatgggcaggttggtacatatttgtattagtctgagacaatatatttttctcgttctcacttagtactttacagaaagtcatttttagaggaaaactgattagccaatgacattgccaggctttttttttttttaatacatatttttttctttagttgtaggtcaaaaatagtcaaatgttgacaatttcatgtggttatttctcacaagagaaaaaatttctgtcctactgaggtgaaattttcacccttgctgtacctttcattgtattttgaaggaaattatcagtaaatgttatttaaacttaatgtttataatgtatatatggctaaaatgttgctaaaataagcattttatgtaattcaggaagcagaagtttggtaaaaatttctctatgcattattgaagtccaggcaatttgatggctacagattattttaagagatgtttttctcaagaaaaagtagaaattaacaattgaaataaatgaatgagcatcaagaaattacatcatggattgtaagaaacttttctgatatggaccaaggtttgccagtcaattatgtcattgaaatttttgaaataatgggcaggcgctaattactttggcagaagactaccatgtaggaacattaagaagaacatgtcacattatcagcttctaactgttggagtgggttaaaaaaatggtctgtcctcatctgctgctatgcgggtttaaatgtggctcccaaatctcccacacttctgcattatgtatttaatacattgtagagatggttctgcagctaccactgtcagccattccagagtgagcacaaagatgacattttactgagcttgagggcttcctttcataatataaccctgttctcttgctgcgggtttttttggggtggggtggtgttgcactctgaatgatggaaactaatttgaattattttagtttaccttcatttaaaatgatgcctaatacagatagtgagcttaattttacctctaaccttgcatgttaaacttttgtttgagtggactttgaaataataaatacaaatgtttgtgtatacgacaagacagatttttctccaaaggtaagttcttccatataaattacactttggactcatctatatagggctttttttctttattttttgttttcttttttttttttgtccttcccttataattcttgagtattaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacccccattttgaaatgtctgctctcacagctgtataatgtattagcttcagttgggactagagctgagagtttgatgtacacagttttgtcatccacattatatgctgtttgtctctgagggatcctgagtttgtccatgtttctgaaacaaccagtcaaggtgtattttgaggagaggggagtgagggctgaggtatgttgtctggttctgattggtatcacatgagctgctgagctgaaatcacagtggtttatttggtgtcttgcaggacccagcctttatatgttaatgtttttccctcattggtatgggatacctacaggatgaagttcagacttcatagcaaggcctctaggactgttcttcctttgtctcctcacctccaatcatatgcccccttaattcttttttttcctcttttttttttttttttttttttgagatggagtcttgctctttcgcccagtctggagtgcagtggtgcgatctcagctcactacaatctccgcttcccgggttcaagtgattcccctatcccagcttcatgagtagctgggattacaggcacccgccaccacacccagctaatttttgtatttttagtagagacggggttttaccgtgttggccaggctgatctcaaactcctaaccaaaagtgatccacccacctcggcctctcaaagttctgggattacaggcatgagccaccgcgcctgccctcccctaactctagaaacttctgaactgtatgtatttctacttaaatgtcccattcttttccctacaccttgactttgcatagattgctatttaccaaccaataatttttctagtcaatttcacaatgaaaatctccttaatcttcttaaagttaataacttttttcttatactattcccagattatgttcataactctattgtaaacttcatcagagtgccttattttcatgtctctcacccaccaaactataccttccttgagggcagaaattgtgccaccaaaaggcagatccaaatacagtctgcaatgaagtgtgaataaaatttaaaaacaaaaattacttttagatcaaaaaatgttttagatgctttctataaatatttttttaaaaatcacctgcagttggttctatagtgagatataaaactgaacaacattccaaaatcttaattttttcttaaaaaaaatttccctggtagttaacaagtattttttatttgtactcactgtaattttctctgattaagtgttatttggtcacacttctcacttggctttcaagcctgctttcaatttataagaacaggagaaaaaagaatgctatagcaagtatttaaatgtagcagttatagtataagagaatttttaaggaaaagggtgatacagtgatatgtttttttctgcttaaaacatcactgtcagtatatttttggatcttgaaagatctcttgtgtttatggcttggggcctgcttgctaggcttgacttcagtactgtttactaaattatagcactgcaataagacatttcaccaatatgatattgaagcataacaagttatttcataaggaatggtaattatctaacattctaagcaaatttggcagtgtgacttggtggggcgcagtgctgtccctgacacaatgacagccttactctctaaattagtaacttccgtaggagaccccagaagcacacctccctcccagcagtgaaagccgaggattcccgttttgattagcaggcgccttctgttcacgataaagggataagaatcaggcagtgatggcagcggagttcatgcttcattaaggcaggcattgcaaactagttcagaggagagaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttttagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcatttctggttggtgggtagttcacttatgaagctaaaacataattctttaaaaaaatgtactagggacataaggagagtggtatggtgaaatacagacttgaagactgtccttgggctctctgaatcatggtggatagatccttacttatcctgctatgctgggagagaggtttcatcccaatattaagcagaattaactttatgaacatcttagagccattagtaggtgctggaaattgtatcattttatttaagatatagataggggattgttaacttttctgataagaaaaattaggaaaaattttacttttatttggctttggtttctgtttgaaaggatatatccataagaactacttgtgtaaagcttattagaagaaatatatgctgctttcttaagcatacaacaaatgtcagaaatatttggaggagaaaaagtttcagccttactagcctttcacatttatacaatcccttcacatcctgttaatcttcttttacttactccatttaaatgtgtttcatagcttagactaaagcatatttgaggtgagaattacacatttttagtagtttgtaagatccatgaaaaaaattatctgtatttattactctctgtcaccctgtttcatcttgttttccaccatccataattccacttagcttaattcatttccctgtgccttaggcataatcaatagttgaattgcatatttctgctccagaactctgctcttataatgatattttaaaaatatattagaacaaagtaacaaagtctatcttctatatgtacataatttttttttccaaacacgtgtttgaggctggaatgtggtgaatttttagattttatattacaatttatagcagacaaaaagattttctataggaatccctttgttggaagttggaggaattgtatacaagtttatttctcatgctgattataagagcctaaaatacttaaatcggaagactcaatttgacatttgagtaattctaggcttgaaactggcaatttcaaaatatagtctgagaaattgataatagtatatctatctctatgtagatacacacaccacacattgagatgctttgactgaagccacatagaacttggtcactaaaatacttattttcccagcagca

SEQ ID NO: 14298 - DNA, 53260 bp, Human
  misc_feature (1)...(53260): n = A,T,C or G
ttcctgttcaggctgattccccccacctgacgctggtgcggggcccacgttggcatatactgtggccatggagagatcatccactttgagggtgagtgcctccagcagaaacacaggcccaagtctgcggagaggctgcccagccaagccacgccccaccagtgagctggctactcggggataaagactgaagtcccaggctgggggtacgtttctctgaaaatggggtttgggcactcagggtccctgaggtctcaggaaatgggggtgcgggatcacagggcataggacctaagcctggctctgatccgcacccctctggcgatccccgcaggcaagaactcaggaggctgtgggctcctgggaagtttctgggctcctggaaaggcatcgtatccaaacaggggcagcgcccgctgctgcgctcctgctggcgcgtgctgcgcagagtgagcgaagcgacggacgcggaccccaccatcctatcactccatgcgcagcaactgtgtgcactttgcactgtgtctgctcgtcccaggtcccagcctggacccccggcaaatagacgggagctccagcaggtcggtgagcgtggcccagctacctgcacaggacccatcccacctcctgagcagactagccaaagcgccttataaacgcgcaactgcaaaatccaggcccttctcttcccactccccacccaggccagttttctccaaattcaagatccacttttctctggcaggcacaaagccaccggaaccaagcggacccacccacttgtctaggttatcccaacagaaccttctcattaccccaatagaaccttaccccagtagaattacccccaatagaacttttctactgagccaagctccacctttctgggccccactccttcccaggtaggcccgccaattctgcccatggagacttcgggatgctagttacagaccaagactcaggccttaggaactcctccagtccccatgcccagctaaaagactccagccacctcaactgatgcccaactggatcctacctcttcccccagcccaattcactactttccatcggatccaagccttccttccttgggcctaggggtcactcaggctcgggagctgaactggagggctcacatgactcaggagccctggtggtcacaccagacccttctcttccttttcaggtgtcaatggacgtggacgtgtccccggattaagcatgaccttggccctcctgggtggacgtggaggcttcagaaagattcattaaactactttccaaagcttaattagatgttcaccgtcctctgtatcctgtttcccatctctctaagcccccaagggctcctcggagctccctgaccttaattccttaaattccgccacctccaggaagctcctcggcttcctgctgccaagccagattttgtaggaaaggtggggcgggaaagggagcgtccttaggtatctgaggccggtcctcgggtgcggtgaccccttcccgctctagaacccccagcctgcgggcacagccttctttccagttcccgctttccctccacggcgtgggtgagcatccgcgcgtgcgtctggggagagcggagccccagaggcccgtcccgccgaggccaggtggtcgggggtgggggcagctattccacatcccctgcaagacggtcccagcgtccgtccagcagactcgcccacctttagatctggagacgagccaagtcgctttaaagggcagaagacgccctgaagagggcatttcctagggatgggcggggccaggccctgacgcaccgcccctgtcgcctcctcgcggacacgccctccgctcggctggcgccggtgcctttaagacctcagcgcgcggccctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggtgagggagcccgccaggaagctcgcgggagggttggggccggggaccgggcgaggcgcgcgggcaccatggacagcgcccggccccagcgccggccccgccccggccgcgccgaccggaagcccgcccggccccctcctgcggcctggagccccggcccagcgcgggcagcgctggcaccccggctccaggggccggcctaggacgcggaggggggcagataggggctggcgggggatgggccagctcagtttcgagaggagaaaccctccggttccaggtgtttctccggtttgcggcgttgcgttaggggttcccttcctttttcgtgctaggcgggttggcttcccaaaaatgtgggggaggggtctgagtcagcgaacttgagcttgagcctggggcctcttcaggaaggcgggccctggatgtacttgcacagcctcccagcttggccctgctgcaaattcatttcccctccctctggtccccatctccatctgaccctcacatccctgctcctggcattgcccctgtagttcagctccaccttcacaccctcccccacctttgattcgttcgtttgtttcttcatttgtttattcgtaaattctgcaacaagcatttatgaaaagccaactgtgtcgagtcctgaactagtcacggaatacaactgtgaacatgagacccttcttgtcctcacgatgctctagaggggagcacagatgaagaagcagtcagggacagtcgagtgtaatgggggcagtgggagcagggagaggacctagtctctggcgccggagagaaggaagacaggagcgtgaggtatgttccaggcagaggaaagggctttcaggaaggttgagagccaggccacaatctgtgtgagccactggactgaccagaaaagagggtggggaggactcctgaaggattctaagcaggcgacataatcagatttatattttagaaggacgtcaggctgctgcattgtggagaagagattggaggtgggccagattgaacaagagacaagggaggtgggtcttgaagttcacaggcctggcatgattgtggcctagaccaggggagaggcagaagatttgaggctgtggaagaggtggaagcctcagacctgatgattaattggatattgggtgggggtttagagggacagggggagaagatgaggattttcacgcacgtccatgtgaagagaccaccaaacaggctttgaacaataaagctttttaatcacttgggtgcaggccagctgagtccgaaaaaagagtcagcgaagggaaatggggtgggaccgttttacaggatttgggtaggtagtggaaaattacagtcaaagggggttgttctctggcggtggggggacacaaggtgctcagtgggggagcttttgagccaggatgagccaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgccttttgaccttttagggtctagggctgtaaagcgtctcagggttgctgcccaacgagccatgaactgggctgggtttttatatttgatgaaaaagagcctaaatactaactgatttggcagaggtcggataaaggaaaaggagcgttaaccttgactatgcctttagctccagccacctctttaagaggaaattgttgggcaggttggggagggctagtcgcagaacaaaactgtaagccggactgggtgtggggagaggaggtgatagaaggattatagggtggaggagcagaagctgagaaagaattggagtctgattcagcctggtggggagtgacctgaggagcattctggggattaggtgagaggtcagatgggtcggtagaaaaggaagattggaagattgaaaagacgcagcgacgcttggggttgggactgaggggacaggcgggagggaaagaaggaggatttgggatgagtcgcattgggaacagagactagggagggaccgatgtgtaaaagaatgcctggacatcaggcacctcagactgtttgcccattttacaacaagaattatctagatcttgtaggatggaaaaatcgaaagtgccgttttctggctatttggaaccattgttgagtttgtattggggttaagcggcattgcaaagaaaataaggcatttaggttttaggtcaggtgtgagttgaagaggttttaagttcttgagaacacaggctaagagagaagaaggaggaatggagggtggaatgttgcccacagtgaaggaggcaagcccagagaaaagagagggtagagacacggagagaaggggtggggggtgctttgccccccaggaaagtggagagaaaagagagggtagagacacagagagaaggagtcgggggtgcttgtcccccaggaacgtggagagaaaagagagggtagaaacatggagagaaggggtggggggtacttgccccccaaaaagtgtgtttgccactaagggtgaaagatcaaggcaggcatcctcgcggtgatcagacaactctgaaacgtgggtgaataatcaagcaggcgtccccgcagtgattaaacaccaagggaagactgtcttcctgagtccgtgatcggcgccggagttttgggttcacagataaaatgcatttcctgtctctaccagaaaaggaaaggaaccgaaattaagagaagggagagattgaaagatggcaccaagattgaaaggagaaagaggttgagggatagtgagagaggttggagaagagagtaaaaagaggccgcttacctgatttaaaattggtgagatgttcctcaggctggttggtctgaggacccgaggtcattaggtggatctttatcatggagcaaagagcaggaggacaggggattgatctcccaagggtggtcccccgatccgagtcatggcaccaaatttcacgcacgtccatgtgaagagaccacccaacaggctttgtgtgagcaataaagctttttaatcacctggttgcaggccggctgagtctgaaaaaagagtcaacgaaaggagataggggtggggccattttataggatttgggtaggtagtggacaattacagtcaaaggggggtgttccttggtgggcaggggcgggggacacaaggtgctcagtgggggagcttttgagccaggatgagccaggagaaggaatttcacaaggtaatgtcatcagttaaggcaggaacaggccattttcacttcttttgtgattcttcaattacttcaggccatctggatatatacgtgcaggtcacaggggatatgatggtttagcttgggctcagaggcctgacaaggatgttactcaggttactagttcctgcaactggatggatgatggtgttattcagtgtaattggaaataaagatgttacaagcaaatttgtggaaaattaatgttgagcccagctttggacatattgagattgtaaactctgagggacatattaccctattaggtagctggatattacgatttgggttccaggagagagattagggaattattaacatatgtatgttaattaaagccacagaagtgaagataactcagggaggaggtataaaatgagttcagacactgcacaagtctgaaccctgaagacaccaacattagaagtgaccagagaacagtggaaagtgtttcaaggtacccaagaggtgaactaaaggctgaaagaaaacaatgtaatttcaagaaggagggagtggtcagtagtttcaatgcccattaaggtcaaatcaaacaaggaaaaaaatcatgaccattggttgacaaagaagagctcaattcctttctactctattccccacctcctgccctgggagataaattctggcaaagtaaggagaacaggagctagattatttctttcccagcattctgttgtggatgatttaaaacatacagaaaaatgaaatgaataatacaatgaacacatgtatatcatccatctagattcaactgtcattgacatcgtaccttatttgctttatctaaccatctattcgtatactttttttggttgaaccatgttaagttgcagagatcatgacccttcaaccccacattctaagtcgacatctaaagccagattaaaatgaataaaggagcacacaggtggtaagtagataaaacagtgaatggaaattttgctttcaagaaatttgactgtaaaagagaaagctgctggaggagaacctcactcagttcaaggaagtttgtctattttgttattttgggttttttttgttgtttcttaaaatgtatgactccatatttttgtttattattaatattaggcgggagagcctagagcaagtttaactgctgatgggaaggagcgattggtgggagagaggctgaagggaagaaaggaagtacagaacactgagtgatgggaggggaggcttactgagctgggtgggaggactagcctgggagcagggaggaccaactctgcccagagggaagagggcaggaggagaggagagtataaatgcagatggagactgggtacagtggctcatgcctgtaatcccagcactttgggaggctgaggcgggcaggtcacttgaaatcaagagttcaagactaacctggccaacatgtcaaaaccccgtctctactaaaaatacaaaaattagccagttgtggtaacgcatgtctataatcccagctactcaggaggctgaggcaggagaatcacatgaacccgggaggtggagattacagtgagccgagatggcaccactgcactccagcctgggcaacggagtgagactccatctctaaataaataaataagtaaataaatgcagatggatgggagtctggggcagggggctgcaggggatttcatctaaagactttccctttttcgggaaccaggtggtgaagccataagggcaaggctgggaatggggacttgagggtcaaaggggtttcaaatacaatgaagaaagccaaccaggccaggcgcggtggctcacgcctgtaatcctagcactttgggaggctgaggcaggcatatcacctaaggttgggagtttgagaccagcctgaccaacatggagaaaccccgtctctactaaaaatacaaaaattagccaggtgtggtggtgtatgcctgtaatcccagctacttgggaggctgaggcaggagaattgcttgaacccaggagacggaggttgcagtgagccgagatcacgccattacactccagcctgggcaataagagtgaaactccatctgaaaaaaaaaaaaaaaaaaaaaaaaaaaaaaaaaaaaaagccacccaccactggcaggccagtggcattggagaccagtgggacaagagggccaaggatgtgagagcagttggagggatagacacaggggttgcgggggagggtgctaggaggaagtagagataagagaaggttgatgggaaggaataaatcaagtattggctctggaaaggcaggtgaggattaagatgcctagggtcagtgagaagagggtatatgagatttctcaggaggctgcagtctaattgtggcagtgggattggagctgaagagggcatctctcacctctctatcaactccactgaccatctagtcccttgcccagagactaggggtaggcttggtctcctgtccctgcccttctttccctctagaggccttgtctctgagcagtgaagaggaaaccggagcctccctccctgccagtgtccggttaccaagttttgggggcgggccatctggtgactgtgacaggagccccagcgccctggccagctcagtccattcctggagaagaacctgatgcagcgattcctgcagctcccgggggccgtggtgaggcctggggtcagaggggcctgcggagctgatcaagaggctgctagccctgtgctggctcccgaaggtgggccccccctccggtaccaggccttggagcctgaggagcttcggtggctgcaggcccaggaggaagacacgaccccagaagcatctctggaaggaccttgcccagaggccagccagagccagagccagccactacggtatagaggaacccacaggaaccccctacccacacagccaggaaggccagggatgggcagttgcactctcagcccagacctcttccggtcccacctcctctgatggaggcttaggctggcatttagggtccaggctgggcggagaaggtggtcaggggcaccgtatgggggctgagggtatgagtgaggagagatgaggggcttaactccctggaggctctgaggggaggaggatagtaaaatatttgagggttgaggtcccaccttgacctctttctccccacaggcccccactggagtgggctctggacgaggtttggggacaggatacagcacagacagggtttggccagccactgcctgccagtggactggaacttaggtggtaagaggtgacagcgaggtgtatatcaagggaggtgagcatgactgacccccagtgccatgccaggccccctggctggctccagccacccccagaagagtcccttaggctaggtcagactaggggtcaggtcagagtgagtgcagcagcgtaaggggatctgactatgggagataatgtttcatggccttagggtgttgtgccttagtccctgcctctgcctcttgggaacagaagttggtgggagtgaggacgagaggcccagggcggtctcacctcaggtggtggctgcggtctgtgtcagtgcatattctgtgtcagtgcatattcgacagtcaatcttacctgtgctggctgctttaggcccagtggtcctgccccctttcattccccttctcctgcaggggcctggaatgtactcactaggctgggtggggaggatgccctggggtgtgtgcatttgacaggcgcatgtggcatttgtgggtgtggtgaggaagggaatacccagagttaaaggagattgggcaaacttggccctccttccacggaagcccagggaaaagccatcccagggtgactcctcagaagatcagaggacccttggggctggatatatttgatcttagaagcctacatttatcatcaaaaatctcaactaggagtccactgaccattttggtgaatgagactggagaggccaagtttggtccaagttatctgtgtattagatgtgatgcggcatgtgtgtgtgtgtgtagggggacgtgtgtggggtgtgtgtgtctctatgagggtgtgggggagcggggagaggtcttgtgatatatgtctgtaggggacatgtatgggatatgtgtgtctataagagggtgtgggagagtggggagaggtctcctggtggtatatgtctggggggtttgtaggtgtgtaggtgagttgtgtgggtggtttatgtgtgtagagtttttctgtgggaggtgtctgtatgtgggggagtgtgtttctctgggcgttgtgtaggcaggattttgtgggtgtgcgtgggtttatgtatggattctactagtgtctgcgggacctgtaggtatgtttgtatgagctgtccgtgaggtgtaggtatgtcgggggacatgggagtgtctgaggtatatgtgggtggtatcaatgtgtagttgtctgtggggtgtgcgtatgaaggatcctgacgtggagtgttgtgcattcatatctcagggaagctggtgcccagctctgtcatttttcctaggccctcggtgctgcccacgcctacccagctcaatggtctgtacctatgaccatgcccctggtgtcctgagctcagcctcctacccactaagaaactcaacagtctggtctgtgtttggcagggtaagagggtgattgtcttctggccctggcctgaccctggaagtagaaggtgtcctctgatttggggggcatccccccaggtgagggagtttcagataacatgatggggctggatattttcttctgtcctcacatgacagatagcgagggcctcagataatgctggaaggcatcatctttctattttgctttccatcaaaaatctctttgggaaagacagtttctaacattcttgggatagtgacttcttagtgcccctcttcttgtctgacgtcaggtactcacgcatttctgcagccctgtgactaaggtgcgtgttctgtctggttcttctcttcctctcagcattcatcacttgtttctcagcattagcagcagtcatttgccactttatgattgttatcatgctctttcctctcctaacagtgctatccccaatttctgattttctgtcatttctaaatgttgcatgtctgtgactaactttgcacacattgattttttttttattttttatttttgagatggagtctcgttctgttgcccaggctggagtgcagtggcacgatcttggctcactgcaagctccacctcctgggttcacgccattctcctgcctcagcctactgagtagctaggactacagacgcccgccaccacacccggctaattttttttaaattttttagtagagacagggtttcaccatgttagccaggatggtctcgatctcctggccttgtgatccgcctgccttggcctcccaaagtgctgggattacaggcgtgagccaccgtgcccggcctgatttttaatttttatcactgtgatatttctcaagctgggttcttgtgcctgggtcaaagctgtgggttatcagagtgtcatctgggaaattagtgtgtgtgagtccccacacacagctgctcaccacattttggaattgtcttggcaacatatgagtgcatcagtttcacacaattctatcagctatatatagacacatttttttcatgggtttattaacaattctctgatcacttcgtgatcaccagttctgcatcctctgagtatggttagccacattgttcactgcacaagggcatctggccaaggaataccagcccatgctccacacacagaatggggagcaacagctcagggctgtgtctatctgtaggggcatgcagattgaaaatgggcttgtagcagccctgacagtgaatgctgcaaagagaccttatacatgtatatcagttccttttttaaatttttttgagatggagtctcactctgtcacccaggctggagtgcagtggcgcgatctcggctcactgcaatctccgcctcctgggttcaagcgattctcgttcctcagcctcctgagtagctgggattacaggtgtgtgccaccatgcccggctaatttttgtaattttagtagggatggggtttcaccatgttggccaggctaatctcgaactcctgaccttaagtgatctgcccaccttggcctccaaaagtgctggaattacaagcgtgagccaccacacctggcctctatttcgaatattaaactttaatttaccatatcccaaatatttttccttttgttgctattatgggctgaattgtgtccctccaaaatgcatatgttgaagttctagcccccagtacctcagaatgttacctttgaggtgattaagttaaaatgaggttattaaggggggccctaatccaatatgactgatttctttataagaagaggaaatttggatataggcacgcagaaggaagaccatgtgaagacagagaagatggttgtaagagacagaaaaacccaaagtgtgtttctcctactctcatacacaccgctcaccagagagtgcttcacctctggccacaaaaatgggtggagatttctccccaccaacaacctgttctccagcagacactaactgggtgttctctaattcaagtcaatctagtgttagattttttaggttaagggctcagtgccacaagactgctctctgcttcagatgccaattccaagtggtaagttgtcagctatacttctgaccaactggctataaatcaggggttcccatgccaccctccttgggttcaactctgtgagtggctcacagaactcagggaaactttagttatatttacccatttattataaagggtagagacaaacaccagatgaagagatgcatagggagaggtatggaaggaggggtgcagagctcccatgccctctccaggcaccacaccctccaggcaccttcacatgttccacagtctggaagctctcgaaaccctatcctcttgggtttttatgaaggcttcatgattgatcgcatctttggccatgtgatcaactcaaccatcagccccactccccattccccagaggtcaaatagtgggattgaaagtttcaaccctcagctgggcacagcagctcacgcctataatcccagcacttttggaggccaaggcgggtggatcacttgaggtcaggagttcgagaccagcctgaccaacatgatgaaacccatctctattaaaaatacaaaaatttgccaggtgtggtggtgggcaactgtagtcccagctatttggaaggctgaggcaggagaattgcttcaacccagaaggcggaggctgcagtgagccgagattgcctcactgcaccactccagcctgggcgacagagcaagactcagtgtcaaaaaaaaaaaaaaaaagaaagaaagaaagaaaaaaagttccaaccatctgataacaaaagatgcttctatcacccaggaaattccaagggatttccatgtcagttgttcctctcactcaggaagttataaaggtcttaggatctctgcgtgaggaactgggtggaagaccaaatattagaacagaagttctcctagcatccctattgtcaagagttttaggagctctgtctcagaaatggggtatagagaccaaatatatatttctttacaatatcacaagaatcatctacaagccaaagaaagaggctatagaagaaaccaaccctgctgacactttaatctcagccttccagcctccagaactgtgagcaaataaatttatgttgtttaagccaccatctgtagtacttcttgtttttttttttttttagagacaggttcttgctctgttgcctaggctggagtgcagtagcacaatcatagctcactgcagcctccaacatcttggtgcaagcgatcctcccacttcagcctcctgagtagttgtgactacaggcatgtgccaccatgcctggctaattttttttatttttgtagaaacaggatctgactatgttgtccaggctggtcccaactcctgagctcaagcaatccttctgcctcagtctcctaaagtgctgggattacaagtgtgagccaccatgcctggcctgtggttctttgttatggtggttctaggaagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacaaaaaatttgccaggcatggtggtgcacacctgtaatctcagctatttaggaggctgaggcatgagaatcacttgaacccaggaggttgaggctgcagtgagccgagattgcgccactgcactccagcctgggcaacagagcgagacttcgtctcaaacagaaaaacgaaaaaaaggcctgggcgcagtggctcacacctgtaatcccagcactttgggaggctgaggtgggcggatcaactgaggtcgggagtttgagaccagcctgaccaacatggagaaacctcatctctactaaaaatacaaaaattagctgggcatggtggcgcatgcctgtaatcccagctattctggaggctgaggcaggagaattgcttgaacccaggaggtggaggttgcagtgagctgagatggcaccattgcactccagcctgggcaacaagaacgaaactctgtctcaaaaaacaaaaacgtaccaattaaacctagccatattgttgctgctaataattttatgaccttaataaaatcttcccttccttcttttgtatttaaaaataattaactgttaagcaaatgcgggatttattttggggtgaaatatgtatacaagttaaattatttgctgctggccaggtgtggtggctcacacctgtaatctcagcgctttgggaggatgaggcgggaagatcacttgaggtcaggagtttgagaccagcctgaccaacatggtgaaaccctgtctctactaaaaatacaaaaattacccgagcgtggtggtgcatgcctgtaatcccagctacttgggaggctgaggcaggagaatcacttgaacccaggaggcagaggtttcagtgacccgagatcgtgccattgcactccagcctgggcaatgagagcaaaattccatctaaaaaaaaaaaaagtgctgcaaagcagttgtcccaatagcatttatttaagtggggcgggggcgggggggtgggggcggggggagattcttattggttcgtaatttatcaagttagaccttttatgaaattccccccatgacctttgaccttctgtttttaacctggtaccaaacagcttttatcatcgtctcgtggtgtttatgttttgaagtccaatagggtgagttgtctatgattgttgccttcttttcccaaaaatattctttggagttcttacctactgattttttttttccagatgaattttgctgtcacttaagtttgacaaaatgttccctttgaaatttcaaacttttgaaatgaagtatgagatctaaaaaaaaaaagaaacctgtgtattggctcagcattacccttattcctctcagccaagtgcaagggatcacttactcaaatctttattcatcccactagagtttaatgacttccttgaatggctgttcaatgttcagtgacaggtctggcttttgttgtgaggccatctatggagtctctgggacccttccagtccctggaatcagtttggtctgagaggtcaggacttggaaacatactggaggcagggcaagggcaccctgctcttgttttggcatctacctcttttccgctggtccttcttatccatccaactagtccttttccctgagccaggtccatactttcccaccccaaacccttcctcttgtttcctggctctctgtttctggctacattcatttcctacactcctgtatcaaaagtaccacaattgcttctcgttcccacagtgcagtgcggctgagcgcctcagagcccgcggggacgctgcggggggattgcggggagggggcgttgggaggtgccgatgttgggctgggcggatgagcgcatctgcgtggtgagccttccaacgtgcgcgagaaggacgtggaagaccttttctacaagtacggccggatccgcaagatcaagcttaagaatgggcactgccttgtgcccttcgccttggtgcgctttgaggacccccgagatgcagaggatgctatttatggaagaaatagttatgattatggccagtgtcggcttcgtgtggagttctccaggacttacgaagtcggggtgggtggccccgtggtgggaggaatgggccttctgcaagaagatctgatttccgagttcttgtttcaggacttcctcaggcagctggcaggacctgaaggatcacatgcgagaagttggggatgtctgttatgccgatgtgcagaaggacggtgtggggatggttgagtatctcagaaaagaagacatggaatatgccctgcataaattggatgacactaaattccactctcatgatagtgaaacttcctacatctgagtttatcctgagagaagcaccagctatggctactcacagtctcggtttgggtcaaggggccgtgactctccatactaaagccggggttccccacaccacttctctcctttcaggccctactgagacaggtgatgggaattttttctttattttttaggttaactgagctgctttgtgctcagaatctgcattccagattgaggatttagcgtcttaggaaattattttaattttttttttttaaagaagaaaaaaaaactacatactttctaccagggccatattagcagtgaaacattttaaactgcagaaattgtggttttggttcagaaacaagttgtatatttttcactcctgaatatgggtaaaaaatcagttccgtctttgtgggttgctctgctatggagatcaacagttactgtgactgagttggcccattctgcttaaaaatatgttttaaacgtttaagaaaaatgctcatcatcactggccatcagagaaatgcaaatcaaaaccacaatgaggtaccatctcacaccagttagaatggcaatcattaaaagtcaggaaacaacaggtgctggagaggatgtggagaaatagaaacatttttacactgttggtgggagtgtaaactagttcacccattgtggaagacagtgtggcgattcctcaaggatctagaactagaaataccatttgacccagtgatcccgttattgggtatatacccaaaggattgtaaatcattctactataaagacacatgcacacgtatgtttattgcagcactgttcacaatagcaaagacttggaaccaacccaaatgtccatcagtgatagactggattaagaacatgtggcatgctgggtgctgggtgcggtggctcatgcctgtaatcccagcgtggctcatgcctgtaatcccagcactttgggaggccaagacgggtagatcacgaggtcaggagatcgagaccatcctggctaacacggtgaaaccccgtctctactaaaaatacaaacaattagctgggcgtggtggtggcgggtacctgtagtcccagctactcggtaggctgaggcaggagaatggcatgaacccaggaggtggagcttgcagtgagccgagattgcgccactgctgcactccagcctgggcgacagagcgagactccatctctcaaaaaaaaaaaaaaaaaaaaaaaaaaagaagaagaaaatgtggcacatatacaccatggaatactatgcaaccataaaaaaggatgagttcgtgtcctttgtagggacatggatgaagctggaaaccatcattctgagcaaactactgcaaggacagaaaaccaaacactgcaggttctcactcataggtgggaattgaacaatgagaacacttgaacacggggtggggaacatcacacactggggcctgttgtggcgttgggggaggagggagggatagcattaggaggaatacctaatgtaaatgacgaattaatgggtgcagcacaccaacatggcacatgtatacatatgtaacaaagctgcacgttgtgcacatgtaccctagaacttaaaagtataattaaaaaaaaaaagtttagtaattgaaaaaaaaaagtacaacaattgggttggttggaacagcagaaatgaattgtctcacagctctggaggccaaaagtctgaactcaaggtgtcggcaggaccatgctccctctgaaacccatagggaaatccttctttgccccttctagcttctggttgtttgctggcagtctctggcattccctggcttgtagacgcatctttccaatcgtctgccttcacatggtagtctccctgtgtctgtctctttaagtggctgtcttttgttttttgtgtttttttaatttcaatttaatctattttttgtagacacattgtttcaccatgttgccaggctggtctcgaactccagggctcaagtgatcctcccgtctcagcttcccaaagtgctgggattacaggcgtgagccgccacacccagcccacatggctgtcttcttatgggaaaccagacatgggattagagacccactctattagagtaggattgcatttaactaattacatctgcaacaactctatttccaaataaggttacattctgaggtactaggggttaagacttaaatatatcctttttaggaaggacacagttcaacccacaatattagctggccacatgtttcccctgatctgtactttacttgttccccctggctctggtccctcctcgggtcaggtcctgcctgagcctcccctggccatgtcccttctttgtgcctggaccctcctgattaataccccatccccacccttgtgccctcagctgacttcttgtacctcccaccaggcatgatgacctgaaggagatgctggacaccaacaaggattctctcaagctggaggccatgaagaggattgtggcggtaagaggggaaggaggaggcctccctccgggcggggcctgggtggccaagagcagctctccttagctccttgtagaccttccctctagttagtgctgtgcctctcgctttgtccctcttcccctaccttgaccccaccacccagatgattgcccgaggaaagaatgcttcagacctgtttcccgcggtggtgaagaacgtggcctgtaagaacatagaggtgagcactacctggtgagggattgcttgtccccacctcccccaggaccacactcaagcttggggtgaggaaggaaatgatttagcccctgggggcccgacctgctgagaaatgtctctgagccaggagaagacactgtctccatgtccctgaactggatgtggatcaaggtaaaggacccggatacactcaggggtgctctcccccactgggagagtttgtccccatggaccgcagctggctggggagatgacatcccaggggtaggggggtgggcacaggtgcctgctgagaagcgttctgctgagaaacgtgctctccccaaggtgaagaagcttgtctatgtgtacctggtacgctacgctgaggagcagcaagacctggccctgctgtccatctccaccttccaacgtggcctaaaggtcaggggtctcagtttgcctcccagggcctgggcctcgttggcgctgtatcggaggagtaggcctggggagaggccatgagcatgggagcgggctctgcagaccccttcctacctgcctaaaattgggagggtcacagtcagaagaggccagccagaccctcagagagtggaagctgggctcagaaggggcgtaagagatgaagtgggtacccagggcccctgtctctcttcccaggagcctgtggtaatggctgcttctagtatgaaccacttgagcccccggagagtggagagtctctagcaatggagaacccctcaaccctcacccccctttgtgtaaaggtgtgaattgtggtccacagccaggtagatttcaacctttagcagtggcctgaatcccccacaccattctcaccttttgtttcattttgcccaaggcctctagttggatttacatatgttaggtgcatgtataagtctcccccctaagggcttttctggttagtctaagacatcttgagggtaaagacagccatttcaaggccattctctccatattggatttttcagctctgattacaaccattaactcctctatttttgcatacctttatttatttatttatttatgagacaggttctcactgtgttgcccaggctggagtgcagtggtgcaatcatggctcactggagcctcgacttccctgagctcaggtgattctcccacctctgtctcctgagtagctgcgactactcagcctgcatcaccatgctcggctaatttttttgtagtttttgtagagatggggtttcaccctgttgcctatgctggtcttggactcctgggctcaagtggcctcagcttcccaaagtgctgggattacagggatgagctaatactcctagcctggatacttttagttcaaatttctgtgagagagattgtgaaaggtccagctcatcttttcatatccagaagttctgtaggttgctgggtagacaggattgctgctcaaatccagggcccaccccttgtccaatctgctatggccagcaagaggggttgacagtcggcttctttggggtgagagtagaaagcatggtcacttgaatatacaattcattcatttagtaaatacttgggtgtctctatgccacacattgtgctagatttctttttataagtcaaaaccatggaatccgtcttagattggcaagtaatctttcggtttgagtaagggttaagtataaaaactaatctgaaattgttgtacagattttcacctatagtctctaccaactgaccctgtcccccttttagaaaaccagagctcatttagttcaactcaatgtgataatttctttctgcaaagtgccaaatagtattttaggttttgtaggccttatagtctcaactatgcaactactcaattttgcccttatggtgcaaatgcagccattgacaagtgggcgtggccgtgttccaataaatctatataaaaaacaggcaatagacagattttatccaagggctgtagcatgccagcctttgctctagaacatgtctaacaggtcatcttttctgatagggacctcactccttcataaggcaacttgctccatctcaagacaactaccactatttggggtgttttttaaaccattctcttttgttgaaacctccacaactataatttttaaaaattgatttcaggctgggtgtggtggctcatgcctgtaatcccagcactttgggaggccgaagcaggcaaatcacaaggtcaggagttcaagaccagcctggccaacatggtgaaactccatctctactaaaaatacaaaaaattagctgggcatggtggcgggtgcccataatcccagctactcaggaggctgacgcaggagaatggcttgaacccgggaggcagaggttgcaatgagccgagaacgtgccactgcagtccagcccaggcgacagtgtgagatccatctcaaaaaaaaaaaaaaattgatttcaggctgtactgcattatgactgcacctgtgaatagccactgtactccagcctgggcaacatagggagaccctgtatctaaaaaataaaataaaatttactacaggttcacaaaaggcataaagaataatataatgaatatccataagaaatgacacatttctcaaatagccaaagcctcctatatatcttctcttgtttatcattcataggtatgtatttattcctgtgctagtaatttgcatattgttaagcaatataaaatgttttgtaaatggtgtcatcgtactacatatgtattcctttaaaacttgttttcttttttgttgtcactggcttttggtctctcctgcatgttggaaccaatcatttcaatccagccttctcccttctttcaatcctagcccaggctagggccgtgttcactttcttaggagatccctcatggaatcaaacctctgactggcaagcagataatccaggtctccctacatcctgtctttgtacagttggtcccttgaaccccctatgaaaccctactctatttcattttatcagtttagcacagggtccaaaccagggtgattctgaatcttaattatgtccctcctgattttgtgtcttctttcaagatactgataagctatttggaccagggcaaaagactgaggcatagcatgtttccaggttgacactgatctgttaataaaccttctccaagtatatttcaccacgttgtagacccacctgactgtacagacagctggcatttttctatcttgttaggaaggatcttattcaatagcaataaataaataaataaataacacctttcatgtgcaaagggttgtgggtgacacagagataaaacagatgtgaattctgctcttaaaaatgcttggctattaggtgaaacaaaaggcctacctaaaaaatagcaatgcaggaaatgctatgagacttccacaaacatatcactgaaatcaagatactaatatccaccggcctagttaccccatcaaaaaggaaaacacattttttttgataactttctgtgaatctataatcatttcccaaataaaatgctcacacacaaaaaaggaaaacaggtttaagcagatgatgtgactatttgtctctaagaaaacagagactccttccttttcaataaatgtttctaacccatctgtttaaaagtcaattccagaattttgtcaggaattagcatcaattttacctgcaattgtgaggatcttgtcttgtctttttccatttcagaaagtcagggtaatatctacccttctttagtgttctattcccgtcattctctaagagtaatagtacaggcacacctcattgtattgcactttgcagatattgccagatattgcactttttacaaattgagggtttgtggcaaccctacatcaatcaagtctatcagtgccatttttccaacagtatgtgctcacattgtgcctctgtcacattctggtaattctcacaatattccaaactttttaatgattattatatgttatggtgatcagtgatctttgatgttactattgtaattgttttggggtgccacaaaccatgctcagacatgaaagtgaaattaatcaataaatgttgtgtgtgttctgactgttcccccatctccttcaccttgggcctcttcattccctgagacacaacaatattgaaattagatcaattaataaccctacaatggcctctaagtgttcaagtgaaaggaggaaccacacatctctcactttaaatcaaaagctagaaatggttaggcttagtgaggaaggtatgttaaaagctgtgataggctgaaagctaggccacttgctccaaacatttagccaagttgtgaatgcaaagtaaaagttcttgaaggaaattaaaagtgctactccaggctgggcgtggtggctcacacctgtaatcccagcactttgggaggccgaggcaggaggatcacttgagaccaggggttcaagaccgtctctataaaaaatttttttaagttagcctgatgtggtggtacgcacctgtagtcttagctacttgggaggctgaggtgggaggatcacttgaacccagaagtttgaggtgcttctccagtaaacacatgaatgataaagaaagcaagacaggattattgctgatataggaaaatttaagtggtctggatagacgatcaaaccagctaccacattcccttaagccaaagcctaattcataggcaggtcttaaatctctccaattctatgatggctgagagaggtgaggaagctacagaagaaaagacggaagctagtggaggttggttcatgaagtttaagtacagaagccatctccataacaaaaaaatgcaaggtgaagcaaaagtgctgatggagaagctgcagcaagttgtccagaagatctagctaagatcattgatagatgtgactatgttcaacaagagatgctcaatgtaaatgaaacagcctcttactggaagaagatgccatctagcactttcctacctagagagaagtcaatgcctggctttaaaaaacaggctggctcttgttaggggccaatgcagctagtgactttaagttgaggccagtgctcaatgaccattctgaaaatcctggggtccttaagaattatggcagatctcctctgcctgtgctctataaatggaacaacagtgccatgacagcacatctgtttgcagttatggtttactgaattttttaagcccactgttgatacctaccgcttaaagattcctttcataatattactgctcattgacaatgcatttgttcactcaagagctctgatggagaggtacaaggagattaatgatttcatgcctgctaacacaaaatcagttctgcagcctatggatcaatgagtaattttgacttttaagtcttattatttaagaaatacatctcgtaaggctagagctgccatagatagtgattcctctcatggatctggacaaagtaaattgaaaaccttctggaaaggtttatagaaaccttctggaaaggtttaccattatagatgccattaggaacattcatgattcatgggaggaggtcaaaatattaacattaacaggagtttggaagaagttgattctaaactccatggatgactttgaggggttcactacgtcagtggaggaagtaactacatatgtggtggaattctacctagaagtagaagtagaattaaaagtggagcctgaagatgtgactgaattgctgcaatctcatgataaaacttgaatggatgaggacttgcttcttatgagtgaacaaagaaagtcctttcttaaaatggaatctgccgggtgcagtggctcacgcctgtaatcccagcattttgggtggccgaggcgggtggatcacgaggtcaggagatcgagaccatcctggctaacacagtgaaaccccgtctctactaaaaacagaaaaaattagccaggcatggtggcgggcacctgtagtcccagctactcgggaggctgaggcaggagaatggcgtgaacctgggaggtggagcttgcagtgacccgagatctcgccactgcattccagcctgggcgacagagcgagactccgtttcaaaaaaaaaaaaaaaaaaaaaaaaaaaaaactcctggtgcagatgctgtgaacattgttgaaatgacaacaaaggatttagaatattacataaacttagttgataaagcagaggcagagtttaagaggactgacttcaatttttttttttttgtagagactggggtctccctatgttgcccaggctggtcttgaactcctaggctcaagcaatcctcctacctcagcctcccaaagtgttgggattacaggcacaagccatcacgcccagcctacattgtttttttaaagacataatgctattgcatgcttagtagactacagtatattgtaaacataactttttttttttttttggagataggatctcactctgttgctcagtctggagtgcagtggcatgaacatatgtagctcacttcagcctccaactccctgggctcaagtgattctcccacttcagcttcccaagcagctgtaactataagcataacttgtatgcaccaggaaacaaaaaatttatgtgactcgttttagtgcgatatttgctttattgttgaggtctagaatcaaacccacaatatctccgaggtatgcctgtaatatatagctgctgctgctgatagtgggaagacagtcctaagccccatgatcacaatacagtgtaaggaatgcttttatacgttctgtataggatgcagtaggaataaagaagaagggcttggggccgggcgtggtggctcacgtctgtaatcccagtactttgggaggccgaggtgggcggatcacttgcggccaggagttcgagaccagcctggccaacacggcgaaacctaatctctactaaaaatacaaaaaattagctgggtgtggtggtgcgcgcctgtagtcccagctacttgggaggctgaggcaggagaatcgcttgaacccaggaggtggaggttgcagtgagccgagattgcaccaccgcactccagcctggcgacagagcgagactccatctcaaaaaaaaaaaaaaaaaaaaaaaaggaagggcctacacccctattttgttttaaacactgtggaagaacagcagcttttgcaatgatttctgggagaaaggagtgtaaggttgaactccggaagggagaccagcttgcatctgctgggcggtcacctcaggcattaaaacaggcacctccaaaaaaacccttacaaggaacaggaagtgtttcaggtgtttcagcaattttaggtgttctgaaagtttttcagtgtttctggaagtgaagctacccattgcaacacctgttcaggtgtcagatttctgcaaccagagccaaaattaagtgtcccccagatacccatcactggcacaccatccaggctccagtcaagcggcagggaagcaagagctagtggtcgctggggacagtgacttccaaaggtgtggcctccccccatcagggcacctggtgccctttcatagctctgcctccacctctgcctttaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacaggtatgccccagccctgtcccacgctccccaggaggctggttcctaagttctcaacccacccctggcctttcctaagtcttgcctgctgcttctcagagggtttgaggagggtagtttgggggactgacagagatggaggagaacaataaggctggggtgcaggaggtgagcatggcttggacagatattgggaaggctggggctgagagtggcaaattcccctcaccgatttctccctcagtttggactctgaccagaaggatcagctgatagaagtcattgagaagcttctggctgacaagaccacggtgcgtgtataggggcgctccgggaggggtggtgaccggcagccggccttccacccttcgcgttcaccctctcgtctttgttctttccccagctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgtaagtgggcccagcccaggcagagcgggccgaagtgtgtcccggggaggcgcccacagacccgtcggtctccccgtccaggaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacaggtgcgctccgcccccagccccgccccctccctcgcctcctgccccgccccacgggctgcccggctccgccccctcacgcccaccagccgcttccacctctgcccacccgctccacactgaccgtagtcctgccctccgcactggtcctctccccgcaacgacttgccccaccttttcccctcatccgctgacccttgccccaaccgaggggcccggggtgctctgacccgtcctctccgcagtgaggtgcagtacgttgtgctccagaacgtggccaccatgtccatcaagcgccgggtgagcctgcgacggcgggctgtcctcgctgtccgagggccgcttctgcgggcactggaggcgttgtcggggctgggaccggggccggggaaagggaagatggaggaataccctggctgtgcagaggatggggcaggggaggctccaaatacagatagggagcagggcctggatcctgaggggccgctgaggggatgtccagtggaaaaagagctagtcagatctgagatggacgagggaagacttgaggagtggagggcagtggtgaggaggcaaggatcctgggcgctgggtcaggataggaggggtgtctctgggcagcgaggcaggcctggggcttcggtggagctccctagctgcctctcttgtgccagggtatgtttgagccctacctgaagagcttctacatcaggtccaccgaccccacccagattaagatcctgaaggtgagtgagggacagaagtgcatgtgcttcccagccctccccaccccatgtacccactcaaataactcacagtggcccccctggtgcctgcctattcctggggctgagcccaggagcccatgactgccccagctggagctgtttgttcagggagctgggctaaggagggtcagggggagaagggaactgctctttgcctagtacctggtatacacctgctactcttcataaatgaagtaacctgatatcacctcataataatcccaggatgtgtacattatattccttttataaaaatatagactctggccaggcacagtggctcacgcctaatcccagcactttgggaggccgagacaggcagatcgcctgaggtcaggagttcaagaccagcctggccaacatagcaaaacctcgtctcaacgaaaaatacaaaaattagccaggcgtggtggcaggtgcctgtaatcccagctactcgagaggctgaggctagagaattgcctgaacctgggagacagaggttgcagtgagctgagattgtgccattgcactccagcctgggtgacaagagcgaaactccatctcaatctaagaaaaagaaaaaaagactctgggaggtaactgccccaggtcacataattctgctgactccaaggttcacacttttctctcccacccacagtgttatggcccccacacacctgccccctcaggctctcctgcaaacattcacggacaaggaaagtggcgggagcccatacctccatttgattcctgctctgctgcctcattattgagtgatttccttcagcaacagttaatcttcctaacccttgtgaacatccactatgttctaggggtacatgatgagcaaactaatcagggaccctgcctttgtggagcttacagatgtggggaggaggagacattaagcagttaatcacaaggcaaatgtaaaagtccacttacaaaatatggaagaaagtgtggagagctataagggcataaaatagggagacctcatctagtctggtgccagggaagttttcccggaggatatgagacttgagctgaagcctgagagatgaacatgaattatgcagggacagaaatgggaagaactgctccacgcagaggaaacagcatctgcgaagaccctgggttaggaagtggagtgggattggggcctggaagacaagggggacagtgatgggagatgggaggtagacagcaagcagatcattcagggacttacagaccatggtgaatacgatggtctccatcctgaaagcaataggaagctttaagttttcaatgcagtagggaggtgacatggtcatactgtaagcatactgtgtagggaatccacttaagaggcaaactggtcctcttgctttttagacaagtttcataacctgtcaattccctcatcagtgtgaggatgatgcagggctgtcatgaggattgttttctggtctatgaagtgtatttggaatgaaagcacagaaagtccactggccaacccacccattttctgcctctccaaccctccctgcagctggaagtgctgaccaacctggccaatgagaccaacattcctactgtcctacgggaattccaggtacaggccagctcccagccagaagggcctgggagaggggcccatcagatccttgtgccctggtgggtaaacctcctcttatgagcccaaggctggagaaactattatcttacattcccgttccaatgtgtttggctggctttgggccaaggaatcactggattgggggtggagttgtcaccccctttcccaagtcttagtcaccggcatgataagccataaaatgaaaggccacagccttcttgaaggtcaccctcaagcctgcagagtcactgagggatttctttgtcatatcccacagacctatattcgcagcatggacaaggactttgtggcagccacaatccaggccattggacgctgtgcaactaacatcggccgagtccgtgacacctgcctcaatggcctggtgcagctgctgtccaaccgtgatggtcagtgtttccctgagtgtctaaccgtgatgatcagagggtgtctgcctgcaggtctgactctgctggccactggatatccaccagtctgcctagacacaatgtgtatccattggtctgtctgtcttgatcagggcccaagtgttcctacacctctgagggctgctagagaactgaagggggttgagagaaagagccaagggcctggggcactgcaggtgtgtctgtccacctgagtgtggccatctgactgtcttggggtccacacactcatttttgttctgtagagcttgtggttgcagagtcagtggtcgtcattaagaaattgctacagatgcagccagcacaacatggagagatcatcaaacacttggcaaagcttacagacaacatccaggtgagggagaagccatattttcactccccacttcaaggtcctccccatgatttcaagactgtataattacatatgctagccttatcaaaagtaacttccaaaccttaggtcttcaggtggaaggagcagagacactggaccatgtgaccctgaccttgttacccctgatttgctttccctttggagaccctcaatgagcacgatggactttactactactcttgttttctctctaaagctctagccaaccatggttgagtgacaaatcttgtgtttttctatcgcactgctaagctgaaacatctaaacaaggcattcccaaagattctggagagtaacatggaaataaagtactgagggtacaatgaatccagaaaatcaatcttttacatcatgactgacttagggtcttgaaagctctatgctaatgaagccctagggaagaggggaaatgctgtctaggaaatgtctaccttttaacctctctctctctcaccacccccaactcccatttccagagaacccataatacaacaggccagcacagatgaggagtgctgtttccctggaagtccacaatcctacccacccactttcccgtatttacccatcttcactcctctcccacaaccacaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacaggtaaagattaagagatgaccccccagatactctggtccccagaaactccctagacagtattcttttggccctccctaggcagggctgaactctagctcctattttggaaaagaagaatcagggaaggtggctggtctgcccacataaccaatgctaccccagtgcccacaaagaccttgtagtgctggtggtcactgttgaagagactctcctatgaagctgtgacctccagtctgctagtacaagagtcctgtctgccaccttggaactctggggctgtgaagaaccacagttgattgggataagggaagggcccaacagtggcaggtactgatgggagaacatgcatcccagatgtggtctgtgcttctttccaaagcttgacaatgcttggccagtctgtgccaaagataagggggtgagtctctgcttgggcttgggtggtgctggtggccactgtcattcccaaggtgaaaggttataagagatacacagccaaggatgaggctcaactaagttgtagtatcagggtgttcagagcctcctagctgtctggcatctcctgagatggttccaggagattctcctaaaatgaagcataatgtgctgagcttttcaaggtgtcagggacatcaaacaccatgacgatttccacactctcccactcagttaagcaggacagggattggcaaactactgcccataggctgaatttggcctattcctgtttttgtaataaagttttgttggaacacagccctgctcattcatttacaaattacctatggctgcttttgtgctacaacagcagggttaactagttgcaacagactgtattgcccacaaagcctagaatagttattctctggcccttttataaaaagactctgccaatccttgaagcaaaacctctggctaggtggctggggtctacagatttatagcagggatatcccctggagactgtagcatccctgccatgtccactgtgcgtgggagtctttggatggtggcacttatctttttcagtggcttctttgatccattgtggccagagtgagccccagaggctcaaggtgaggtaggcagggccaccaagtgctgtgactgtaatcaggagtcaaaggacagcagcaacatgtggaggcaactgagtctgtataattaaatatgctagccttatcaaaagtaacttccaaaccttaggtcttcaggtggaaggaggagagacactggaccatgtgaccctgagcttgttatcagtgttgtgggcaaagcagattggagagagagaagttagagggggagagagagaagttagagggagaaagagcaccatggggaagcgttcaatcgttgaaaaaatatttgtatacttcctttgttcaggtgggaggaaggagcaagtgggaggaatgtttgaaaagatgaagcagcctgggtggggagccacccaggtaggtgggagtcttgacatgctcagcaatgagccagagtcctaaaccccaggatggtgaggttggcatgttttcataagcctgggcctgtccacatgtcatttcccccaagttgtcactgtgagctacatgtgcatttgttcatttatttaacatatatgtaggtgggagtctgacatgctcagcactgagccagagtcctaaaccccaggatggtgaggttggcatgttttcataagcctgggcctgtccacatgtcatttcccccaagttgttactgtgagctacatgtgcatttgttcatttatttaacatgtaggcctactatttgcctggtactgtgctgcgtcctgaggatatgacaatgagtgagacacatttacaggtctccagatactcacagccaagtaggagaaacaggacaaaaataaacattttaaacacagcagtaacagctgtcatcagggttggcacagcgagctgtgggtatatacagctgaaccctcccctaggaatgacccctgtcagggaacccagagtaggctgttcaggcaaatggacactcacctccagggcgcccttcacctgcaagtgagtttttgcaggccccttagaatggttatttgattcaataaagatttttgtcctccctttctttctcctttcttcccagcctcttctgggagtggtaaagaagggggagtccttggggtactaggagggaggtggtttggatgcgcacatgaccatgcttgcaaaacagtagtgatgcttcccatcctgggaccatgagtggcaatctgcccagctaaaaggccacagtaatctcagtcattctctccaatttggacatgggcccacggcatgccagatcctggcccaggatgaggccaaggaaatgaccaagatgaggcctctgccctgctattgatcagcagataatcagatactagaccagaggccacaaaggcataacatgcaggcggcgggggatgggggggttggtaatcaaagtggctattacatccacctggatatagaccctggggaaactgcctagcaggttagtttgcttttatgtgtcaggtgagatgtgtggcaggagggtctgccaggggcacagtgggatctacaaccctcccatgtgaccgcctttacagtgaatagaagattctgacaaattttgcagaattgcttttaaaaacgtaaactttttttaatatgctaaaggtaatacatgcttatcatagaacatttggaaaactcagaaaattataagtttaaactattaataagtccaccatttagaagaccaccattaattatatatttccttattttttattcctatatatagtcattcagaagttgtacatttgtctattgtccaatattttaaacttttctgcttcttttcaatgctttcatatttaatacttttttttccccattcacatttcaattaaacttttcacttagaattttctccaggctgggttcagtggctcacacctgtaatcccagcactttgggagcccaaggtgggtgggtcatttgaggtcatgaattcaagaccagcctgaccaacatggcaaaaccctgtctctactaaaagtacaaaaaaattagctgggtgtggtggtgcgctgaaatctcagctacttgggaggctgtggcaggagaattgcttgaacccaggaggtggaggttacagtgagctgagatggtaccaccacactccagcctgggccacagagcaagatccatctcaaaaataaataaaaattaaaaagaatttcctccaaatttttttctactttcacatttttaaatcaattgtattagttttctgctacataataaattactataaatttggtggcttcaaacaacacacgtttattttctcagtgtctatgggtcgagaattcaggtatggcttagttggatcttatgcaaggctacaactgaggtgtcagccaaggctgagtttttatctggaggctgtactggggaaaggtccacttccaagtcacatggtgccacgatccacttccttgcagttgtaggattgtggccctggcttcttgctggctgtcagctgggggctgcccttgccttctagaggccgtccttagctcattgccataggggcctcccaacacggatgcttaatttctccaaagccacaagggagaaagtctctagagccagtctgctagcaagaccgtcttctttttattttttaatttttatgggtacatagtaggtgtatatatttatggggtatgtgagatattttgatacaggcatataatgcataacaatcacatcagggaatggggtatccatcctctcaagcatttatcttttgtgttacaaacaatcaaattacactctcttagttatttataaatgtataataaattattgttgactgtagtcaccctgttgtgctgtcaaatactagatcttacacattctatctaactataattttgtacccattaactatccccacttcccccacccactacccttctcagcctctggtaaccattattctactctccaactccatgagctcaattcttttaatttttagccctcacaaataagtgagaacatgtgaagtttgtttttctgtgcttggcttatttcacttaaaataatgacctctagttctatccatgttgttgcaaatgacaggatctcattcttttttattctttttttatagtactgcattgtgcatatgtaccgtattttctttatctatttgtctgttgatagacacttaagttgctttcaaatcttggctatggtgaacagtgctgcaataaacgtaggtgtgcagatataacttcaatatgttgatttccttacttttgggtatatacatagcattgggattgctggatcatatggtagcactatttttagtttttgtttgtttgtttgagatggagtcttgcactgtcacccaggctggagtgcaatggcatgatctcagctcactgcaacctccgcctcccaggttcaaacgattctcctgcctcagcctcccgagtagctgggattacaggcgcccgccaccaagtctggctaattttcatatttttagtagagatggggtttcaccatgttggccaggctggtcttgaactcctggccgcaagtgatctgcccgactcggcctcccaaagtgctgggattacaggcgtgagccactgcacctggcctatttgtagtgtttttttttgagatggtgtttcactcttttttcccaggctggagtgcaatggcgtgatcttgcctcactgcaacctctgcctcctgggtgcaagtgattcttcttctgcctcagcctcccaagtagctgagattacaggtgcctgccaccacgcctagctaattttttgtatttttagtagagacagggtttcaccatgttggccaggatggtcttgatctcttgacctcgcgatccacccacctcggcctcccaaagtgctgggattacaggtgtgagccaccgtgcccggcctatgtttagttttttaaggaacctccaaactgttctccagacatttccactaacagtgtacaagggttgccttttctccatgttcttgtcagcatttgttattgcctatcttttggatataagcctacttggggtgagatgatatatctttttttgttttgttttgttttttgagacggagtcttgctctgtcacccaggctggagtgtgcagtggtgcgatcttggctcactgcaacctctgcctctgtggttcaagtgattctcctgcctcagcctcctgagtagctgggactacaggcgtgcgtcaccacgccccgttaatttctgtacttttagtaaagatggggtttcgccgtgttggtcaggctggtctcaactcctgatctcaggtgatccgcctgcctcagcctcccaaagtactgggattacaggcatgagccacccgtgcctggcctttcattgtagttttgatttgcatttctctgatgctcaatgatgttgatcaccttttcatatacgtgtttgctatctgtatgtcttcttttgagaaatgtctattcagctcttttgcccatttttaaattggattattgaatttttttttcctattgagttatttgatctccttacgtattctggttattaatcccttgtcagatgggtagtttgcaaattttttcctcctattctgtggcttgtctctttgctgattcctttgctgtgcagaacctttgtaacttgatgtgatcccatttgtctacttttgctttggttgcccgtgcttgtggggtatcactcaagaaatctttgcccagtacaatgtcctggagaatttctctaatgttttcttttagtagtttcatagtttgaagtgttagatttaagtttttaatccactatgatttgatttttgcatatggtgagagataggggtctggttttattgttctgcatgtggatatcccgttttcccagcgccatttattgaagagactctcctttccctaatgtatgttcttgatacctttgtcaaaaatgaattcacggccaggcgtggtggctcatgcctgtaatcccagcatcttgggaggccgaggctggtggatcacctgaagtcaggagttcaagagcagcctggccagcatggcgaaaccctgtctctactaaaaatacaaaaattagctgagcgtggtggcgggtgcctgtaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctcccgagtagctgggattacaggcatgcaccaccatgcccagctaattttgtatttttagtagagacagggtttctccatgttggtcagactggtctcgaactcctgacctcaggtattctgcctgcctcggcctcccaaagtgcttgctaggattacaggtgtgagccactgtgcctggacaatgctactgattttttttttttttgaaacggagtcttgctctgtcaccaggctggagtgcagtggcgccatcttggctcactgcaaccttcacctcccgggttcaagcggttctcctgcctcagcctcctgagtagctcggactacaggtgtgcatcaccacatccagctaatttttgtatttttagtagagacaggatttcatcatgttggccacgatggtctcaatctcttgatctcacgatctgcctgcctcggcctcccaaagtgctgggattacaggcatcagccaccgcacctggccaatgctactgatttttatgtggattttgtatcctgcgactttactgaatttattagttctaatagttttttggtggaatccttaagattttttaaatataagatcatatcatctgcaaacaaggataatttgaattcttttccaatttggataccctttatttctttctcctgtctgattgctctagatagaacttccaatacagagtcttcttaataaaacataatcataggatcatatatagtcatataccacctttgccatatcctgttggttagaagcaagtctcaggttttgcccatacccaaggtgagggattgcacaaaggcatgaacaccaggaggcagctactggtggggaagaccttagaatctgtctgccacatccatctagagcttaaacttactcatgtgtaatgtgtgaattgaggatatatttcaattttttttaacagccagttttctaagcatgattagcaggcatctgcaaggtagcatgtatgttggcataggttatggaaaggaagtcagtgtttcctgcttaaaattcctctctgacaactggagcctgttggtgagggggagccttgttctgttcttggcacactggagtgtatctcagaggccttcttgaacagcctgtaattcctgcacatcctggctagatgaggtgggggtcttggtggtgcacacaggatgccacaatccacagggaatggccccttggggtggagaagggtaatgaattattataggcaaatcctgcagtgttgaggtggtgggccagccccttcctgtgttggttgttaacatgcagttaaggctgtggacagatggatccaaataccaaacagttctttctagaactaggcaaggacttgaaggagggagtctgtgatcagccagctgggaaatctgtggaggaagacattgtccaaaccaaaagagggatcagcagcctcttgataattgactatgttggtaagggcatccactagccctggccatttagatggtgtctggccaagagaggggcaggttggtgatgaaatctgttgtgatggcatcttattttcatatttttaagtctattctattagcggtgtatgggattgggattgcttatctgtgactataacagtatcgcaggtgctgctttgctggaagggactgagctgaagagggcctgtgggccagattggaggtaggaatgtggaatcatagtggctctctagagtggtgtggggcaattctgccaaagcagctgctcagactctgggtcagcatctgaggggctttgccccttatggacatctgcttgatgtccctgccagattagctgggttaaccatgtccaaggctacacgtaacagtatgtcaccataaacctcaggaagaacagagtcagttccaggctccctcctgccggcccctgatgcccttgggcattctgcttgttgaccacttggtggttttgatcttggtcacaagtgatggaaacatggagacctgggccagggcaggctccttatgtcagcaggtaggcagtgaagggaagcagatggggtgcagctccagcagatgcaggcctaggtgcagtactgatgggctccttggcctgggaaaagccccttaatgatcctgcttcttttctgtaaaatgggggcaataatgcctacttctcagaaggcttggggagattagatgagctagtgtggagcacctagcacagagttggtgccagaaggcacttgataagtgatggctgctaccgctgttgccatgttaaggcaggttagattaggccaagatcatggcagaaatggagatattttaggtctgcagttgtagcttccctgactgcagactgtgaaccctacatgaccttggcaaatgcatgggcagctgcagtttgccctgatgtcattagaagcttccagggaaggataaagacctctgagacccctgggctgctcagaatctactaaatgggtggatagggcatgagggtggcccctgccaaagggacccctgtttatctgccctgtctttttgttgtctaattccccctgggtggtggagcctggaaactgtgaggtccagcagagcattccatacttccacataccctgctgccctagagtaaagaggctggacaggcctggagtggtagggaccacaaatctagggaagaatggagtccagagccaggagtggggaaagtccaaaaggaaaacctcttttgttggcccaaggcagttgtcaaagttgggatcatcaggaggcatggccagagagatgagagaaaattctgagcccagaacaagggcaggtggggagggacagctgggtggaagcgccggtcctaagcagggagaggagacgttctgcctgaaagtgtcggcttaaagaatctgtttctgagcctcctgtgtccccatccccccgtcagctgacccacctcttcctgttcctccagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaaggtgggagctgaaatcaagggtaaccttcctaggggaatggaaaggaactggccagagtctctgccccagaccttcctgaggcccctagccaggcaccaggcttctgtggacagtcctgctccctggctcactccttttgtccctcctgtggcaccaggaattactctttcaccctcccataaccactgccagcatcatctcacctgagggtctgccttcctggccaggatggacttgtgcctcctctcctctcaggctcccttttccatctccctccctgagcagacactaggctttggaatacataccaagatcttaaataccaaggacccaggaaggcagaaagcaaaacaacacacaaaggagaggtgtatatttttataaaggtcctgagaaagcagttgcctgcattctgtgagcttagtcactacagtcagtccaaatcccaggccccagggcttcagccttgcctctgttcctgggcttggcccttaaggcctcttttcccaagacaacggccttgagatgggcctgggagggaagggtcctcccgctgcttctccgggccccaggagtggaagccaggaacctacacagaagagagcctccttcacaaagctcagttcttctgggtatcttttcgttctttttctcttccctggacctcacgaatggggagattctgagggtgggcacagctttgaaattctcccaggaagaaggcaacagtccctttctccccgacaccatcctcactcacaggcctgtgctgccctcctccagcagtgcctcaactctgatccagacttctacacactcatgctctgactgttcatccctccctgctgagtccagagcctgactagacgtgcatgctgagcagacaggtcggcagcatctgtgggcccagagtctcctcctgcccacctctgtaggctgcctttccctggccctcagtccctgctctggcctggccagacagccttttcttccagcatgtgggcctaaaggtgcagtcagggtggaagagccattagggcacacatccatctccttcccctacccacctgggaagtcccgaccagaatcaccacccagccccacctggaaaacagctcccagagctttccctcactgctgctacctgcctgacctctaaacctatccctagaccgggaccacttccagctgggctcactgtcccacctgcttaatgccaaggccacaggctaccaggagctcccagactggccggaggaagccccagacccatctgtgcgcaacgtggaggtcagcggggtggagggttgaagtgtgtgtgtgtgtgtgtgtgtgtgtgtgtgtgttggtgggggcagcagtagggagccctgcagtgccggcccagccctcctaacaccctcccccacacacacaggaagaagatctctcccttattgagactcacgtgggcctgttgggcgaatacactgaggtcccaccttcgtgtgacgtgtgctctctcccctgccctgtctgtgtccctcttcttcccctgtgtgttgtgctcctgggccttcccatactctgtttccaccttggtttggcagtgctcctctgtgagcagcattccctcccctccatggacagtgcccctttcttcctcctctgttattccctttgtgggacagaccaggtagggcctcacaaagaggtggaataaagggtaagggcttgtgcctgcctgccttctccccaaccatgatgaaatgaccctgcaccctacccccatctccaggtacctgaatggaccaagtgctcaaatcgggagaagagaaaggagaaggaaaaacccttctactcggactctgagggggagtcaggccccacggagtccgcagacagtggtgagcagatggcagagctggggtcctctgtgctctgcccatgcatctgtgtgactgactatatgaggggtatatgtatatggttgtgtgtctaggggtgtgcacctgcttgtgaattgtttgtgcacctgagggattcatgttccaggtgtgtgtgcttgtgcaggtttctatccatggagtccatctgtgtttctgtcagttccagctggcatgtagggctgggggcaggtcagagaggtttgagggttcagtactgaatgtgaaggtggaacccaggtgtctgctccagacccaaggaggcctgcatatgagggaggaggcctcatattgttcctccacagaccctgagtctgagagtgaatcggacagtaagagcagcagtgagagcggctctggggagtccagcagtgagtccgacaatgaagaccaggatgaggatgaggagaaagggagaggcagtgagaggtgagaagggagctagccagatggctggtggggttcagggggctttcctggaaagagggctagcattgagctttagccagtctcctaagagcccctgagcccctcgtgagctgggtggggctgtcagctcacatgacgcctactttcgctggctgcaggagatctctgaggcctcatgggctggtgtggagaagcaaccagagtcctagagcctgagctggcacaagctggcttcaagctctcacggggtccctgctataggacctcaggtgtgaaccctcctggctcaggctccccacaccactccagcttttcagcatttctcctgcttctgtgaagcaaggagggagtgtccaggccaggcctgagccaacctttcccactccttcagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacagtgagagccttggggcagagtcagggtgtgctcatgggccagggccctccccaacctctgggccaggcccagacatctatctccctaccatccagaacagaacatgacatcttctacccaacccagaacatgccaaggtgctccccttccccacacccacatcccatttttctctttcagcctcccagcagcaaaagtgctcctgcaaccaaggagatctccctgcttgatctagaggattgtgagtttgggtggtaaaagtcacaggggaaaggaggcctggggagcatgaattagaacagcccatagggactctggatcgggttcctcaggtcttgtgggagcaggggagcagacagaacatatcttcaggcctgagagggcagcagggctgacctcctcaggtctggggttgaggtctaggaatgggtattttgcgagagcctccaggcagccatgtgccccgctgtccatggtgctgaaatgcgtgctccttgatccctaggctccctgctcaacccaagccacctccactttgcctcctcatagtcttatctactcccacagtcacccctcccagtgtccagcctgtgtctcccccagcaattgtgtctaccagtctggctgctgacctggagggcctgacactcacagactccaccctggtaccgtcggtgagtgggatggaggaggggaccgggctggggcagggacacatccctgtgctgcatcctatggtgtggatgtgtgtggggggtgggtgtgatggaggatgtgatagctttgagtcccagctgctggatggccctaggggacaatgctgggacaggctctctccatcttgctcagttctgtccttccctacccctccactctagcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattggtgcgaagggctttggatggggtggaggaggaggctcctgggcagagtcagtctttctgtggttgctgataccctccttgtgccaggccaggggccaagctataggggcacagagatagcatctaacatgatcaacactctggtggacaagacagatgatgaaataagcaagttcacatcagggcgggaggtgcttgcagcagcagatttgggccttggttgtttcaggactaacttaaatgtggtgagggtgagtgggggaaagggtgcttagagttcaggaggaaaccaggaacagtctccagcagccaagaaagccaagattctgtagagggctggtcagctgtgacagtggagaggagagtagggctaggctgggttctagacctatcaggtgatggtggccctccctctccccttcactgccttataccacttcagagtccctggcacctggagaatctgccactgctgtaatgggcattaatttctgtgactcaacccaggcagccaacttccagctgtggtatgtgcccaactcgaggtgggggtgagaggatgggctggaaagggacagggtaacaatgaactggaaatggaggtggtgcttagtggggatacatcatgattgggtgggtctggaagccatctcaggccctcattcctgacctcactctttcactgcctccaagctgtgcctctacacagggtgggaagtgaggggagagatgacagccttaattcttctccgtttcctcccacccctcccagcacccagacccgacagttctacgtctccattcagccacctgttggggagctgatggcccctgtgttcatgagtgaaaatgagtttaagaaggaacagggtgagtgctccctgggagtgggcagagagggaagtatagaagctgactccagaatgtccagcttggatggtagggagaatggtggtgtccttcatctagaccaggggtcagcaaactttctgtaacgggccaaagataaatgttttaggctttgagaatcatgtggtctctgttgcagttacaacacgactgtggctgttgaaacatagaaacatccacagacagtatgtaaatgaacgagtatggctgtgttccaagaaatttccatttatatttatagatactgaagtttaaatttcatgtaattttcatgtgtcatgaaatattaatcttttgattgctcccccaacacttaaaaaatattaaaaacattgtgggccatataggtggtgggctggatttggtctggaggctgtaatttgcaaaacctctggcctagaagaaagaagagtggcttgggcaagggaggagggaagatcatggttagttttggataagctgattttgaaatgcatttgggaaattcaggaggagctatttagtatgcaactgaaaatatgggtctatgcccaggaaacactttgaagctggagtcatgaacatagaggtggtaatggaagctgtgaatatgaatgagatcactctgggaggtgggagaaaataggaaggccaaggacagaaccttgggggaaaacctgaattctgcagaagaaagaggaggggagggataagagaaggagcacagggagaggtgggaggagaaccaggagagacaacaaggcagaaggtgtctgcaaaccacagttacctaagaccttcagagtcagcatataaaaggctactgccaacctgagggagagagggtcattgctaaaggagggacagaggccaactgcagtgggttgagggagaccacggctcaagtacatgcagtcctctttggaggactttagccatgaatgaggagggagacagggcattggcacgatgaaggatctcacttctggaaaggattttttggagacggggacacttgaacatgaacagattgaaggaacaaaaacaagaaaatgttattagtcatgaatgaaggggatagaagaaacaggagagggatgtcagtttctaaaaggaggtgaagaataggggaagcagtggagggaggaaagaggctgaagagaagactgctggtgtgcaggagagcagacggaggagctcccatggggggcctggatcatgtgagtggagagaagtcagccttgcagaatgaggagttctgggggtgctgtgaaggtttggaggcttcaggagccctggctaggtctggagctgctactgcagaggtacaattaaaaatgtacctgtgaatgctgcatgtgactactggattctggctgagagatcacagcagccacctgtgatctttttgtgagggcttagcttccaggagctgagtgggagttgaatgtgggttggagggccccccaggaaagatcaaagggtgtgaggttcaggatgggcgaacctcttaagaactgactggccactctcaaggggctggtagcccagatgtctgatggaggaagcgccaaatcagtctttggtaacaacatggataaaggcctgggtgggaggggtagagaggctgacaaaggcttcctgagggagggcccagtctgagagggaagtaccttctccccaagactgatgatttaaattctgacctgccctttgcatgataccttcccagcctgggagaacttgttgctcagtaagcagacccaggtgctggcctctgtacccaccatggcctctgccctcatcacgacctctacccccaggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtactaggccaccagtagaggggaaatgatgagcatgggggccctggtttgaagcaggagccccagctgctgatccccttccaaacacagtcacccttagcagctcttcctcaccccttctattcccacctcaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctagctgctggctcacctttccttctaggggtttgttaggaacaactcttgttgaatccccaaggtaaccatctctgggtcaggatgcctaggagtctgcaggcatctctgtggaagagacatctgggctggggtggcaaggcagagctggaagagcaccttggtcctttttatagcctctgcaaaaacaagtcctcttcaatggctggcagacccccttagttcttcttacggtcccttgggaaggaaggactcataacatggggacttccccaaacacaggtgctcagttcaacatatgtcaactactccagttagggggcctggaggccccacctggctggggtactgacccactggtcatcttagtggaagaatagaagatgcataactgtacttctcaaaccactttgtggcaagtcacctggggatcccatcacatgcagattctattagtaggtctagggtggggtctgaaattctgcattttttttttaagtgaaagcagccgggcgtggtggctcacacctgtaatcccagcactttgggaggctgaggtgggccaatcacgaggtcaagaccaacatggccaacatggcgaaatcccatctgtactaaagatacaaaaaattagctgggcatggtggtgcgcacctgtaatcccagctacttgggaggctgaggcaggagaatcgcttgaacccaggaggcagaggttgcagtgagctgagatcgtgccattacactctagcctggacgacagggtgagactctgtctcaagataataataacaataataataataatgtgaaagcaaatttattaagaaacaacagaatggcgactccataggcagagcagcagattctgtatttgtaacaagacaccagcatctgctcacacctggaacaaacctggtgggtgcagtgggggtcagggctctccctgacaccttttctggtgaagaaagaggctgagtgagcagtggttctaaaacgtataaaaggtgttccattaggatgtgttctgtaccctcccgccccctgcaaagtctatgatcaaataagtttaggaatcttggatttaagtgaaataaattcatttcctacaggtcttctcagaacttttactatgctaatgtacactgtgaccacctctcagcctgcagtgttactcaaacttggttttgattttggaacactttcctcacaacatcttgattgactgggttacaaggaacacactccagttagtttgagatgttgaacctcagcctctgatcctctgtgaccaagactttaggcccttggccatactgtccctcagccctgccacttaggcatccctgagcatgtctgttcatgggtaagatggggtgaagcaggtgtggctgtcctctcacagaaggagaacaaaggcagtgccaggggacagccctgcctctggctccagggacttgctgggcactgtgacaccagagagctgctggagctgctgcttccctgagagcctggggccccaaagtctccctgggatcactgtttttgtcactgcagattctgagatggtcctccagtcaaaagtaagattcagtcttacttttgcctctgaatcagcactacccacagcactgagagagggtgagggtgattttctaagaaatttgaacaaggaccatcagagaatcccttacccacctttattctatatcaaaagccccagagtagagctgggcatgtgtctgtagtcccagctactcagaaggctgagactggagaactgcttgaggccaggagttcagggctgtattgcactattattacacctgtgaatagcactctatcctggacaacctagca

SEQ ID NO: 14299 - DNA, 9391 bp, Human
gggatcccagagccccatcctccctccggatttggagctgaatctcagcctgtcctccgtcctctctgcagtatggtccatcttctcatccctgagcttggggcctgtgtggcacccggagggaacttgattgtggaattagcccggtgagtcagtggggtggagggtggggaacatcctggctggggatcaaaatctgggtccctgacagggcgcttcccatctgcaggtacctggtggacgtgcggcaggagcagctgcagggattcaacacccgggtcagggagctagctcaggcagctggatttgctccacagaccggggccaggccttcagagaccttcgcacgtttctgcaagtcccaggaatcagctctgggcaacactgtcccagctgtggaacccggaactccgccccttgacatcctggcccagcctcttgaagccagcaacccagcccttgagggcctgacccagcctctgcagggtgggaccccacactgtgagccctgccagctgccctctgagtctccaggttcactctcagaggttctggctcagcctcagggggccttggctccgcccaactgtgagtcagactccaaaactggagtctgacccaacccctagacaccccttatctccaacttccaaagtcaggttgtaggatgagaacccgctgataccattctaagtccgctgctagagtcctcaattttattctaatcattcccactcagtacccgccacccccaccccgggagtgttggtagactttcaaattccatttctgagattctatggtctattcctagaattctagattgttctctcagaattccaaattccacttctgaggctctaagcccagcctaggatctgacactgagtctcaggcccttgactttggcccccttgttcccaggcaccctgtggctgactaggggctggggtgtctcctcaccagggcctggtcagcacccagatggttcaagtaaagcaagttgtgtccacccttctgtgtgtccaagcgtctttcctgtcctatgtccgtctccagggctgggagagaaaggcccaggagtgctggacagaggaagccagaaaccagattcctgggtttccaagtggacgagggatggatttcccagtgctattgactgagagctagccccgagcacagctgcatcctcaaattaatcaacaacatttattgagtggcctggactcctgggtctgaggggagagggattggggtcctggactcctcggtctgaggggagagggattggggtcctggactcctggtctgagggaggaggagctgagggtgcagactcttgagtctgagagaggaagtgtgctgggggcctgcctggactcccttgtctgagggaggggctgggggcctggacccctgggtctgagggaggaggggctgggggcctggactcctgggtctgagggaggaggggctggggcctggactcttgggtctgagggaggaggggctggggcctggactcttgggtctgagggaagaggagctgggggcctggactcttgggtctgagggaggaggggctgggggcctggactcttgggtctgagggaagaggagctgggggcccagacacttgagtctgagggaaaagggggctgggggcctggactccttgtgtgagggagtggccagggtctcccagggtcctgggactgagggaggaggaggttgggaggtcgggcattctctgggtctgagggaggaggggtctaggactccaggatcagagggaggagggtccggattcctgtgcccggaggtggctggtgatccagctggagcagggcccaccccgcccctcacgcgcccccgttatctggcatagtgggcagggggaggaggaggtgacagtatatttagtctgtgtcctcgccctttatctcagtgtcctcggggagtctcaagcagcccggaggagactgacggtccctgggaccctgaaggtcacccgggcggccccctcactgaccctccaaacgcccctgtcctcgccctgcctcctgccattcccggcctgagtctcagcatggcggatgggtgagtgatgccccaaggcagtgggagttgggggcgacctcccgggttcccaagaggggtcgcagctgagaggctggacccttggcctgcgaggtaggcgtagggactcttgggtgaagagaggaagtgggtttgcgagtcagactcctggaacccaaggaaggggaagcgcggtcccccgacctcttgttcagaggggactccaggggtcccttaggagacaggacacagcccaccactaacccccctccttggtttctctccttccaggagcagcgatgcggtgagagcagcgggctaaggcgtggctgggacccccagggccagggtgggcgctgcagtgaggggtctggggcgggaggctgcagccctagcagagggtgcggtacggtaagggctgggtggggtcttggtggtgatggggtccccactcctcctaacccaggctagggaacctcgccctgcaccagccccaatcagacgccgctcctccaactaccgcgcttatgccacggagccgcacgccaaggtgggacggggcttcctgggggcagagtacaggcgccggagggatccaagaccctgggagtggggggaggagccagggctgcgaagggggcggggactacgcggaggggcttcaggggcggagttttgcagagggtcatgctcggattggtgacagcagcctgcgggcggaactccgttgccctcggacttgcttagggatagatgggaagtgcctatccaaaggaagagacccagattggtggatgggaatgaggggcgtggcctcccgtagactcagggctcaagttggacgtgggcccaaatctggaccggctgggtttgctgggggtgtcttgaggtcccctccaccgtcgtctccgaatccccctccatgatccttccttgctccatctcaccctggcagaaaaaatctaagatctccgcctcgagaaaattgcagctgaaggtgaggacgggcgggactgggaaagagcaggcaggtgctcagggggcggagcttgagaatgggtggggctttcggggtaggtgggcggaagtgggcggggtttggccgctcggggcgtggctttagcggggagtactgctcggggtgggacggggccttggaacagtggagaccaaactggagggtttagaagggcagaggcggttccccacgcctggtctttatcctgaagccccgggtgggctgcgcttccctcccacccctctgcagactctgctgctgcagattgcaaagcaagagctggagcgagaggcggaggagcggcgcggagagaaggggcgcgctctgagcacccgctgccagccgctggagttggccgggctgggcttcgcggagctgcaggtaccggctcccaaggatgcgaggtttctagtcccggaattcagcagtacagcctctatcccctcttctgctcgggacccaggcgtccaatatggctgtccttacccaattatatatggttcgtgggactcctggcccctaacaccctttgtgtgcaggtctgtggagtcttggctccaacctactccttcaggaccatgtggccctcctatcccagacagaagcccaagccccagcccctcctccctcagaccctggaagtccaggccccagcccctcctccctcagacccaggagtccagtccccagcccctcctccctgagaccctgaagtccaggccccagcccctcctccctcagaccctggagtccaggccccagcccctcctccctcagaccctggagtccaggccccagcccctcctccctcagaccctggagtccaggccccagcccctcctccctcagaccctggagtccaggccccagctcctcctccctcagaccctggagtccaggccctcagcccctcctccctcagacccaggagtccaggcccccagccccttctcctccctcaaacccaggagtccaggcccccaactcctccctcagacccaggagtccaggcccccagccccttctcctccctcagacccaggagtccaggccccgagccccttctccctcagacccaggagtccaggtctccctgtttttggttcccccaacaacacacaccacgttcctcctccaggacttgtgccgacagctccacgcccgtgtggacaaggtggatgaagagagatacgacatagaggcaaaagtcaccaagaacatcacggaggtgggacgcatgggcagctcgggtaccttcggggtagggtgagatggctgggacttggtctctgcctgaccccttgcagctgcttttggctgcacatcccaggagacccaggacaactgtgagcctggcagggctggggcagaaggatgagtacaatatagtcaaggaaagctgttctaggcagagggaacagcacatgcaaggccatgggttgggaaacagaaaataagttagtgaacatgctcagggcatcacatgttggtaaattagctcaggcactggccagggaattgtgatttgcatgtagctggaccaggttatgccagtggttttgagaggtgaggctggagcatatgaggagggggattcagttccaggattagaagcctagactgggagcctaagccgggaagagactggtaaggcctcggtactggaagacgagataaggagaataaaaaaggagtgtaggatggaggagttgggtgtgcgggaaatggaaggagaagtacccaccccctcgtgtgcccccagattgcagatctgactcagaagatctttgaccttcgaggcaagtttaagcggcccaccctgcggagagtgaggatctctgcagatgccatgatgcaggcgctgctgggggcccgggctaaggagtccctggacctgcgggcccacctcaagcaggtgaagaaggaggacaccgagaaggtgagtgtgggctaaggccaggaaagaggatgctgaggggaagggctgtgggtgccaacaaccctaggcctgagggcagatggtgcttggagttggaggtagaagcagctagtaaggggtcctcagaaatgcaagaggaagacaggaagtagaaggggaagacaggaagtgcattagggctacaggaagtccatgtaagagcaaagaggtacatgaaggtccaggtgcagtggcttatgcctgtaatctttgaggtttaaaaaaaattttttttaaatttccttttttttttttttgagatggagtctctgctgtccaggtgcagttgcttatgcctgtaatctttgaggtttaaaaaaaaattttttttaatttccttttttttttttttttgcgatggagtctctgctgcccaggctggagtgcaatgacaccatctcggttgctggagtgcagtgacaccatctcggctcactgcaacctctgcctcccaggatcaagtgattctcatgcctcagcctcccgagtagctgggactacaggtgcacaccaccatgttgttgttttaatttctacaaatttcttttttaaattagccagtcacggtggtggcatgcagcttctcaggaggctgaggcaggaaaatcgcttgagcccatgagatcgagggtgcagtgagctatgactgcaccactgcactccagcctgggcaatacagtgagaccctatcttaaagaagaagacaggaaagataggagtggatgcctgaaaccatggattgtactgaaccctatatgtaattttttttcctatacacacatacatacctatgataaagtttcatttctaaattagacacagtaagagattaacaataaataacaacaaaagaaggttgggcgtggtggctcatgcctgtaatctcaacactttgggatgctaaggcaggcagattgcttgagctctggagttcgagaccagcctgggcaacatggcgagaccatgtctctataaaaaataccaaagttaccgggtgtggtggctcgtgcctgtaatcccagcgctttgggaggccaaggcgggcggatcatgaggtcaggagtttgagaccagcctggccaacacagtgaaaccccacctgtagtaaaaatacaaacatttgctgggcgtggtcgtgggtgcctgtaatcccagctacttgtgaagctgaggcaggagaattgcttgaacccgggaggcagaggttgcagtgagccgagatctcaccactgcactccagcccaggcaacactgggagactccatctcaaaacaaaacaaaacagaacaaaagttagctgggcatggtggcacacacctgtggtcccagctcctcaggagtctgaggtgagaggatggcttgagcccaggaagttgaggctgcagtgagccgagattgcacgactgcactccagcttggatgaggcagccagaccctgtctcaaataataataataataaaatagaacaattataacagattgtaataaaactcatgaatgtggtctctttctcaaaatatcttatagcactgtaatcacccttcttttccttgtgatgtaaaatgacagtgcctatgtgctgagatgaggtgaggtggatgacataggcattatgacctggcgttaggctactattgacctgagaatccatcaaacttatgaattgtttatttctggaattttccatttaatatttttgggccatggtttacctcaggtaactgaaaccacacaaagtaaaattgcagaaaaggagggactactataataagaagagaaggaaggagacaggaagggcataaggcagacaggaagtggaggggaaagataggaagtgcaggaaggagacaggaagtggaggggaaagacaggaagtgcatgagggagacaggaagtggatggggaaagacagaaagtacatgagggagacaggaagtgctggggaaagacaggaagtgcatgagggggacaggaagtgcatgagggagacaggaagtgcatggggaaaattggcagggattatcttgaaaagacaggaagtgctccagaactagatacttaggcatccagggtagagtggccccacaggctggagggaagacagggattcttgagagactggagaccaagaagagaccctaacctctgactcatcgccatcctccaggaaaaccgggaggtgggagactggcgcaagaacatcgatgcactgagtggaatggagggccgcaagaaaaagtttgagagctgagccttcctgcctactgcccctgccctgaggagggccctgaggaataaagcttctctctgagctgaaagtgactccatgtctattacccagggcttaggcaggagacagatgggaagactgcaggtggggctcccccaaagccacacagcaggttggggaccagatgggtctcccatgtgaagcactcttggctgtgttattgaaaagaatcccggggttcatgaatttggagagcggagctttgtttcttaagaagcggatcacaacctgaagaccagaagcatggcttcttgccaaaaaacaaaagcaggcactttaagggagggaagggcaaggcaggaatttatgctgagtgggttagctaagtgcacgtattcaactggttatagaaggagctatgaatattcatggacaggtggacacatggacacacgcatgtgtgacaagcaaacactcatttttttttttttttgagacggagtcttgctctgtcacccaggctggagtgcagtggcacgatctcagctcactgcaacctctgcgtcctgggttcaagccattctcctgcctcagcctctccagtagctgggattacaggcatgcaccaccacgcccagctaatttttgtgtttttcgtagagacggggtttcaccatgttggccaggctggtctcgatttcctgacctcgtgatccgccctccttggcctcccaaagtgctgggattacaggcgtgagccaccgcgactggccgcaaacacattttacatgcatcccaccttcacttggtggtggaggcttaacatttaagtgcattccattgaatgcattcgtatcgaaacacgaagcagggatatgaagacactcagtgcacagcctctgtcaacagccagaaccagtccgtggtctgcggcatcttatcaggagaaagttactgaaatcagtctcttgttcaactaatgctgtagttatgccttgtggaacagggggttcagctagtcagcatctggcaatggatggctgcaatggttgtaatattgcttatcttgaggccggtgcttgtttagctgctagaaaaaggaaaagccttgtggcagttggaacatagtcgattatataagtgtagggatgcgtggcttaacccttgcctggcatggccttaggtcttgtttataatttggtatcttattgccacaaacagttcattccatcagtcttctgatctctattgtcacagctcctctggcccatgtggagtgcacagagatgccaagactaaaggtcaaagagagagagacacagagaaacagacaggcagagagacatgaccgacaacagagagactgagttgggagtagagagagtaggagccaggcaaagacccaaagagagagggagaaaataccacaagatgcatagaaggaagtgcaaagaaaggagaaaagagagacagagatatactcacagcaaggtgcagagacatggagaccctataagagatggaaatggagagccacagagggggaactgcgggcactaagagagacatggagagaactagaaagatagagacgtgaacacagacacagagacccagagccaaaaagagacagaaatggggtcataggtggacagaaatgcacagagagactgtgagcccccacagacacaaacgctgagaggggcagacatgcagagacacccacagaaatgcagagacaaaaccacccggagacacatgccgagaaacacactgaggggctcagaaagcgacagatgcagagagagcccaagacagacccagcaaggggccccgagaaatgcacagaaacacaaagaccgagaccaccagagacagaggtacggagaggcggggagggtgaggaagcctgctctccagggctggcttgaacctagaactcaaggtcatggcttggctgggaagcgggagggggataccaaaaaagatcagcgttagatggaggtggggagggagggtaggtttcaccctaattgacaccccaccctccccctccccctccccacacctgcttcccggctttag

SEQ ID NO: 14300 - DNA, 23260 bp, Human
aaaacaaaaactgaattcacgatcattcccctgacaaccccccgcccgtcccttggccaaagtgattatcttccagggcccttggtcagggaatagtgtcattattccttcagttatgcagctgaaaatcttgacacttctacctcccatccaacccaccatccagccctgtcaactttacctcttaaacatgttttcttaatgccccttttttactctctctgtctccttctttctcttcctctctctctctccctgccaccctttttcaagctccagcagttcttgcctggagtattgcaacatccaactgttctgccctaatccactctagcaatccccgctatagagggaccttttaaaatgcaaatctgacctggattcacttctgcttaaagcttatgactggtttcctttaattcttggataagcacaaaacttctcggtatggctaaggctctgcttcctccggctccagcttcaactcacaccacactccattcaggtcgattagctcaaacccctcagatattcctcagcctttgtactcactgtgcttcctcctgccatccagcctttgcacgcctgattccctctgcttagaggagttccctcctttctttgtaaaaggcatcagatctcacaccaagctctcattacaaaagcctttcctgtcctacctctcaagatctcgttattgtaaatactcaaagtatcattaacctctaatgtttcaatttacagcaataattcaacatttgtttgttttggagacggtgtctccctctgtcgcccaggctggagtgcagtggtgtgatcatggcttatcatagcctccacctctcggcctcaggtgatccttccacctcagcctccagagtagctgggactacaggcacgcaccaccacgcccggctaatttttagtagagaagcggtttcgctatgttgccaggctggtctcgaactcgtgacctcaagtgatccacccgcctcggcctcctaaagtgctgggattacaggcgtgagccactatgcccagcccacatttgtttatttgattaaaatgtctgtgcccctcttccaggattgggctgtgagcccaggggaaggaaagaaccttgtctgccattgtatcttcagggcctagcggtgcctggcgcacagcagttgctcaactagactggttgactaagtaaataaataaagcactacggtctattatatccgaaggcttggcttcgggaggggcaaaagacaggtttcgcgctgaggtagggttcatggtgccgacattttttttcaagatggaagaaagcggagataatacgcagccctcaaaggaacttagtctaatcggggggagcagacgatcgttcactgtgggaaaatggggtacgatttcccccagtgaggaaatcaactaaagccgagctttgaaaaggggagcagaggagcctgaggggaagcgggggcgtgtcgcctggcgtgaccagcgcggcagggaaagcgggcccagggacccgggcctgtcacgccgcttccgcgcgtccccaaactctccctcggctcgcccacccacgcggcggggacccctccggcccctccccggccccacggccacttcttcccccacaagccggcctgcggtccgccttaccagcccgggccggacggggccgcagctcctggcagaccgcacagccttcgagcccggaatgccgagacaaggccggcgccgattggcgacgttccgtcacgtgaccttaacgctccgccggcgccaatttcaaacagcggaacaaactgaaagctccggtgccagaccccacccccggccccggcccgggaccccctcccctcccgggatcccccggggttcccaccccgcccgcaccgccggggacccggccggtccggcgcgagcccccgtccggggccctggctcggcccccaggttggaggagcccggagcccgccttcggagctacggcctaacggcggcggcgactgcagtctggaggtgagcgggatgcagcaatggagtcccaggcctggcctgggcacaggcggggagcaaggcctccgggcgcggaggtcagggcgtctagcagcagggcacgggccacgagtggagatttgggtcacacgggaagaatctgagccagggtgcaagttttttctgcgtccacctcctggccgtggccttctcactgcttaaagcgccccttggccttccctggaagtctgacctccgcaccctgcccgcggcctcgggagggctggggtggcctaccttcttaggccgactgtggctgagatgaagactgagattgtactacattgagtcaaagaccaacctgcatacacactcccctgctcccaggctgtctcaccactaggcaacaccgcctccatcttacttacccttttgcagggcccttttcctggttcttgagaatgtagcaagatttccccgctcaggatggggatgggtcggaggagccactctggaagtttcccgggcaagaaagtgttggcaataataataacgggctggtcaggaagtagaagagaaaattaagacttagatatcctgtggaaaaagaggaataatatctactgattgatgcggggagagagggaagcctggaaagatcggaggtgaaagtaaaactgagatttgaaggtagaggtgtggagggcctgtgaactctatgcagatgacaaatgtcaaaaaagtgcagttgcttttcagggagagaataagtgtcctaaaaaagagacagccaattcctctgtcttccaaagttccgtgaaatagaattacacaattttgcttaatggtagaatattccatgtatctattaaaatcaacaaaaggccgggcgcagtggctcacgcctgtaatcccagcactttgggaggccgaggcgggtggatcacctgaggagttcaagaccagcctggcaaacatggtgaaaccctgtttctactaaaaaaaaaaaaaaaattagctgggcatggtggtgcatgcctgtaattgcagctactcgggaggctgaggcaggagaatcgcttgaacccgggaggccgaggttgcagtgagctgagattgcgccattgcactccagcctgggtgacaagagcgaagctccgtctcaaaaaaaaaaaaaaaattaaaaaaaatcaacaaaagacttaaaaaaaaaaagactacactgttagcatttcagaaccaccttagtgtaatgatgatagctcattgtggtactaagaagacaggggttatagtcttatttctggaaaagaaattaataaagtggcatgcttagttaaaatatatataaccacatgcaagtactaaaatgccactgtataaatacaatacaaattgtaaaagaaaacatgctttttaaattagagcaagtataatagcctgtgaaataaatgtcaccctctagagttgttcagtgcacaagctgcacaactttacatgggccttcagtagaggtttccattttatgtgaggttttgtaaactgggagatgatttttccagtagtgtggcaatagtacaatctgcctttcttccctgattctgtgtgcactggtcctatttacaaagtaatataaaaatcaaaaggcttggccagacgcggtggctcacgcctgtaatcccagcactttgggaggccgaggcgggcagatgacctgaggtcaggagtttgagaccagcctgaccaacatggtgcaaccctgtctctactaaaaatacaaaaactagccgggcgtggtggtgggcacctgtaatcccagctactcaggaggctgagacgtgggactcgcttaaacccaggaggcagaggttgcagtgaactgagatcgtgccactgcactccagcctgggtgacaaagtgagactctgtctcaaaaaaaaaaaaaaaaaaaaaattaaaatcctttgtcttgaatggattatgggatcagagtttcttcaggactcctaattaccatatgctttcctattctagcatcttccatttctgtccatacagtcattgcaagtgatctatttatattatagtaggcaattatagagatttccacatatttgtagctatcccatccatttctgtagccaaatattctgaagcttcaaggagatctttgtcttatctccaacccagtcccatttttgccctttgaattgcttctgtctgctgtaattttagccttcttttgtcagtaaagcttatctccttattatctgaggtctttacaaaagtccatggaatgtttacctgggcctttaggctcatgttcctggtcatataaagaggagcacctttctctaaaaggacctcttctcagcctaaacaatctctaacatcttgccactatttgcattttccagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtggtatgtggtcttccagggaaaggggtgagggagcccagcctttcctctgtagtggcaaggtgtgtagtcagtcttgatgcttacaacagtcaggcttctggccgagcacagtggctcatccctgtaatcccagcactttgggaggctgaggcgggcggatcacttgaggtcagcagtttggactagcctggccaacatggtgaaacccgtctctactaaaaatataaaaaaactagccgagcgtggtggcacacgtctgtagtcccagctactctggaggctgaggcaggagaatcgctgaacctgggaggtggaggttgcagtgagctgagattatgccactgcactccagcctggccacagagggagactctgtctcaaaaaaaaaaataaaaatgaaaaaagaaggggtctcaaaaataaataaatgaagaaggggtctcactatgttgcccaggctggtctcggactcctgagctcaagggatccaaccatatgggcctcccaaggtgctgggattataggcatgaacgacagcgcctgacttcattttccttcttttttttttttttttttttgagatggagtcttgctctgttgcccaagctgtagtgcagtggtgcaatctcagctcactgcaatctccaccttctgggttcaagtgattctcctgcctcagccttctgagtagctgggattacaggcacccgccaccacacctggctaattttggtattttttagtagagacaggggtttgccatgttagccaggttggtcttgaactcctgacctcaggtgattcgcccacctcggcctcccaaagtgctgggattacaggtgtgagccactgcgcctggcctcattttccttcttgataaaggagaaaactgaagcaagaggaggaaaatgactttttctttagagatgcggtctcgcactgtcacccaggctagagtgcagtggcgcaatcacggctcactctagcctcgaatgcctggactcaagccattctcccacatcagcctcccaagtagctgggactataggcatgcaccatcattcccagttaattttttttttctttttgcagagatggggtcccactatattgcccaggctgaaaagtgacttttttggtgtgcatatctcaataattcttttgtaagcctgccttgattgatctctaaggctcagtgtggctcagcttgaaatgcaatttgaactatgctcctaaatttttcctgaaatgcataatggggcagagtaacttagagccacaatagattcagcatgtgttctccgtccctaaaggcagaggtcttggacaagtgatccctagccaccaattctttcttttttattttttatttttctgagacagagtctcactcaggctggagtgtagtggcgcaatgttggctcactgcagccttcgtctcccgggttcgagcaattctcctgtctcagcctcctgagtagctgggactacaggcgtgtgccaccacacccagctaattttgtatttttagtagagacgaggtttcaccatgttggccaggctggtcttgaactcctgacctcaggagatccacccgcctcgccctcccaaagtgctaggattacaggtgtgagccactgcacccggcctgctagccaccaattctgatggacacacctgggcatctgatgaggcagctaagtggggtgttggattattttccctctagcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggtgaattgttccgtccctcactaaagaaatcagatccagtgtagggaattcctaggtagggaaatggatcaagtggcctgatggaccagaatttccaagttctggtattagctctccacttcatgctattctgcataacttttgagctatttttctgcctgggatcttttctctcccatctgtgaaatttccttgagggcagagtcccttggtcactctgtattccagccagcactgggtttagtattttgtccttagtaggtattcaggaaatgattaagaggtcttcattttgggaatccacctgaactttaaagatgcttcccaacagtatgaacagtatgaattgaatagaatacaacaagttaattttattagaagatataatattaatagcagataaagtcagttatatatatacacgtatatatattttttttttttaagacagcgtcttgctctgttgcccaggctggagcgcaatggtgcagtcatggctctctgcagcctcgacctccagggctcaactgatccttctacctcagtcttccaagtagctgggacttgccagcttggtgcatgccaccatgcccagctaatttttgtattttttgtagagatggggtttcgctatgttgcccaggctgatttcaactcctgggctctagtgatcctcctgcctcagcctcccaaagggctgggattacaggcgtgaaccaccagcctggcctagatacgaattttaaatacttctctagcaatcaaaattgatctaacccaattgtgtagtctgggtttttttcccacagttaccaatataacacatctagattctattgtatatatgtgtaaatcactcattcaacctttattttcttttttttctcaacttttattttaggttcagggggtacatgtgcaggtgtgttacatgggtatattgtgtgtcgctggggtttagtgtacaaatgattttgtcacccaggtagtgagtatagtacctgctaggtagtttttctgtctccccctcctcccactctccaccctcaagaaggccctggtgtctagtgttcccttcttcatatccatgtgtgctcaatgtttagctcctgctttttttttttttttttttttttttgagacgtagtctttctctgtctcctaggctggagtgcagtgctgcgatttcagctcactgctacctccacctcccaggtcaagtgattctcctgcctcagacttctgagtagctgggattacaggtgcccgctgccacgcccggctaatttttgtatttttagtagagatggggtttcactatgttggccaggctggtcttgaactcctgacctcgtgatccacctgccttggccttccaaagtgctgggattacaggcgtgagccactgcgcccggcctctttttttttctttttgagacggattctctctttgttgccaggctggagtgcagtggcacaatctctgctcactgaaacctctgcatcccaggttcaagtgattctcctgcctcagcctcccgagtagctgggactataggcgcccgccaccacgcccggctaatttttttatttttagtagagatggggtttcaccatggtggccaggatggtctcaatctcttgacctcgtcatccacccgcctcagcctcccaaagtgttgggattacaggcgtgagccaccgtacccagcctagttcctacttataagtgagaacatgcaatatttggttttctgttcctgcattaaatcgcttaggatcatagcctccagctcaacaatctttaaaagtgaaaatttggccaggcgcgataactcatgcttgtaatcacagcactttgggaggccaaggtgagtggatcacctgacgtcgggagttccagaccagcctgaccccgcctctactagcaatacaaaattagctgggtgcagtagtacatgcctataatcccagctactcgggaggctgaggcaggagaatcacttgaacccaggaggcagagcttgcggtgagccaagatcgtgccattacactccaacctgggcaacaaaagtgaaactctgtctcaaaaaaaaaaaaaaagtgaaaatttacatgcgtgtatatgtaagtaaatattaattgtgctatatacataaaatttgtgtactttagaaagtaatatctccaattttaaaaatgtgaatgagaccgggcatagcggctgacaattgtaatcccagcactttgggaggccaaggtgggcagattgcttgagcccgtaagttctaggccagcctgggcaacatagcaaaatcctggtctctactactaaaaatacgaaaaaaaaaaaaaaaatcgccaggcgcaatggctcatgcctgtaatcccatcactctgggaggccaaggtgggtggatcacctgaggtcaggagttcgagactagcctggccaatatggtaaaccccatctctactaaaaatacaaaaaaagtagctgggcgtggtggcaggcacctgtaatctcagctacttgggaggctgcagcaggagaatcgcttgaacccaggaggcagaggttgcagtgagccgagatcgtaccattgtactccagcctgggcaacaagagtgaaactccatctcaaaaaaaaaaaaaaaattagctgggcgtggtggtgtatgcctgtagtcccagctacttggaggctgagacaggaggatcacctgagcctgggaaggtcaaggctgcagtgagctgtgatccagccactgcacgctatcctgggtgacacagtgagaccctgtctcaaaaaaagaaaaagaaatgtgattgatcagctctttgcctaaaacttagctaactgtgtgctttgcagacattgtctgactcatagtcttgagaatgtttctctcatacaaacattgaaatgagatgcgtttattcacagcacatcaggaacagaaatgggactaagacctaggtttctagacccaaaagtctgaaaaatgggcgtggttttagtgtaacatcaatgctttgagaatcaaagtacatactcaaactttcctaagaaatttcaactggaagggactggattttctccaaattcaacaaaatgatggatgacaaaaccagtttcttattggctagggtctaggctagatcatctccaagattcttcccaactctaaaattttattctatgagatagtggtctcagatgagtttgtttctagaccgtcctatgggataaaggtttctctagatgttcttcaagggcttgggttgggggtgcttctcatgaactctttcatgtcattccctgtgtcataaccctcaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaaggtaatgtgtcccacagcaaccaaaatcaaggtcagcccagcctgacagtctctccagtgctgtactgcaacttgtatctgggacagcagttaagtgcaaaggacactagaatgataaacaaatgtatcttttagattgtgactcaatcttattgaatccaggcaaaatcattaagaagagctccttaactacttcatgtgttactacctaaagtccatggagggtcttcaatgtagcactcaagcccacttttctgctacactcaacagccgtcctagatgccagcagctagagtggctaagtagttttatgaaaatgtcttgattaaaaaaaaaaatgctgtctgtgagcctcatgacccaagatgtcatctcctgtagcgtcacatagcatttctagtgggcaggggttttcctttcacttcattcatggaaagaccgagatgcctgtgagtcaacatagctcacgcagttggtcggtgtcagagccacaaatgaggtcttctgacgggtgctcaattccaagtcaagtgtgctttgttttcctcatggtagaactctttcttttttttttttttttttttgagacagagtctcgctctgtcacccaggctggagtgcaatggcagatctcaggtcactgcaacctcctccgcctccaaggttcaagcgattctcctgcctcagcctcccgagtagctgggactacaggcatgcgccaccacgcctggctaatttttttgtatttttagtagagacagtgtttcaccatgttggtcaggctggtctcgaactcctaacctcaaatgatccacccgtctcgacctcccaaagtgctgggattacaggcatgagccaccacacctggcccctcatggtagaactatgttttttttttttttgagatggagtctcgctctgtcacccaggctggagtgcagtggcgcgatctcggctcactgcaagctccgcctcctgggttcacgccattctcctgcctcagcttcccgagtagctgggactacaggcgcccgccactacgcctggctaattcatggtagaacttttaattttactcccttccatcagcttactttcctagttttttgtttgtttgttttttgagacagggtctcaccctgttgcctgggctggagtgcagcctcagccccctgggctcaagctcttccctcctcaacatcccaagtagctgggataacaggtgcaccaccacagtccgctaattttttttttgtagagacagttgcccaggctggttactatgttgcccaggctggtctgaactcctagtctcaagcactcctcctgccttagcctctcagtgcactgtgattacaggcgtgagccaccacacccagccttaatttcctagtttcttgtttgtttgtttgagacggggcctcactctgtcacccaggctggagtgcagtgacatgatcttggctaacttcaacctctgcctcccaggttcaagtgattcccctgcctcagcctcccgagtagctgggactaaaggcatgcgccaccatgcctggctaatttttatatttttgatagagacagggtttcaccatgtttgctaggctggtctcaaactcctggcctcaagtgatccactcaccttggcctcccacagtgctgggattataggcgtgagccaccacgccgggcctaattccctagtttcttaatttctctgagccacctttcttgctattgatcactacctcacagccttactctgcttttctagcccctgacagctatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccagaactccatccgccacaacctttccctgcacgacatgtttgtccgggagacgtctgccaatggcaaggtctccttctggaccattcaccccagtgccaaccgctacttgacattggaccaggtgtttaaggtgaatgccctgctttcctctaaatagggcctaagttggaggttgtcatagccatctcaaaaggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaattctgggaatgcttgctctaaaaaaagcccttcctgctgggtgtggtggctcacgtctgtaatcccagcactttgggaggctgaggcaggtggatcacctaaggtcgggagttggagaccagcctgaccaacatggagaaactccgtctctactaaaaatacaaaaattagctgggtgtggtggcgcatgcctgtaatcccagctacttgggaggctgaggcaggagaatcccttgaacccaggaggcggtggttgtggagagctgaaatcgcaccattgcactccagcctgggcaataagagtgaaagtctgtctcaaaaaaaaaaaaaaaaaaaaaaaaagcctgccttaggctggagaccagaagctgagctaccagaacgtcttttcagaaagaagttattttggtttttcagagtgcccataaggctgctggtagctgtaaccattctcctgggaggggcagttgtctggggtgtcttttgtcatcagtcaggaataagtgtttttcccaatccggtcaaattgaccacgttggtggtaacttcatctcatttctctcccacaatgcctggccgccaccagccactggacccagggtctccacaattgcccgagcacttggaatcagtaaggttctttccctctggctcggggcttggccttgttttcctttcactgctcagcatggctttagtggacagagacaagatgtgatgtggggaagggtccctatggccatgttttgtctaggtgccagccctagacacagaacaccctgagggtcaggcacacacccacttccctccccttccatgggcatcacaagggcacactgagcagagcagggcacagcaggggagcatgctgcagcagccacaagcgcatggcaccagcctcaggggcggcagttcgttcgctcacttttgtgcctagcttttctttgccacgcatatagctacctgctctggcatcccccaggggtgttgaggacacgtgggtgaagcggtagtgccactctgccatcatgtgtctgtaggccacccacctgcccactcatcacagttttggagactgctcgcctacgtccatcccctcaggttggcctcctctctctgggctgtcattaactcaagcacacaccaccagagcagctggtggggttttgccatcccctctttaccttattgtgttaacataggtttctttctctccccatctgccacaagcagcagcagaaacgaccgaatccagagctccgccggaacatgaccatcaaaaccgaactccccctgggcgcacgttagtatgggagagtgggccttgggcctggtccttgttctggggccatatctttagggaaccagactctgggattctgttcccacctcaaagggatctgagcccagagaaggagagcaaagctcctggggctgagaaggggtgtactccagtccccctgctcctgatctctcgtgtttcctcctagggcggaagatgaagccactgctaccacgggtcagctcatacctggtgcctatccagttcccggtgaaccagtcactggtgttgcagccctcggtgaaggtgccattgcccctggcggcttccctcatgagctcagagcttgcccgccatagcaagcgagtccgcattgcccccaaggtgggtgtcctattttcctctgaagagagattctggccaattaagaatgttggaccttcagcttgcaaagcactctgataagtgttccttgagagcttataaatctagttgggtagaaaaggcataaaaacatagggaagtgtaatagcattagaagagctaaaaaggtatttggattacaatgtaagtggtgtcagaaggcccataaatacctgatgagcttgtaagaattcagacaaaagtgattgtgatagatgggctaggattattaaggaagatacacaagggaggcaggccttagaaagagatggatttggccgggcgctgtggcttacacctgtaatcccagcactttgggaggccaaggcaggtggatcatgaggtcaggagtttgagaccagcctggccaacgtggcgaaaccccgtctctactaaaaaatacaaaaattagctgggcttggtggcacatgcctgtaatcccagctacttgggaggctgaggctggagaatcacatgagcccaggaagggaagttgcagtgagccgagatcactgcactccagcctgggtgacagagcgagactctgtctcaaaaaaaaaaaaagaaaagaaagaagtggatttgaggctagacgctgtgggtctcacttgtaatcccgacactttgggaggccgaggcaggggtattgcttacagccaagagttcgagaccagcctgggcaacatagcaagaccccagtctctgctaaaaatgcaaaaaaaaaaattagccacggtggtagtacatgcctgtggtaccagctactcaggaggctgaggcagaaggatcacttgagtccaggaggttgaggctgcagtgagccctgtttgcaccactgcactccagcctgggcaacagtgaggccctgtctcaaaaaagaaaagaaaaaaagtagatttgggtaagcaaacaggtgtagagagagcatgctaatgggcagtgccatggaggcgggaaatgcagttcgtacctggcagtagtaaagtgactgggtcagactaactcagggtttctcaagtactattcacgttgacagctggagaattctttgttgggcgtgggagggactgtcctgtgcactgaagggtgtttagcagtatcccttgttttccccactagacgccagtagcacccaccacaggcgcggcaatccaaatgcctccagacattgccaaatgtcccctggcagggagggaatcacccctgcttgagtatcactggtctagcttgaggggaaggtgagaagggtaaattcagagccaacttggatcagccatcagatctgcacttaacactgttaaagggttctgtgagtacgggctgacatgtaaccaaagtgaaaagcttcccccatccccttcagagagatgaaaatagcatagagtctggagtttagagcgacttgggtttgctttttttttaatatataaaatcttttaggccatgcacagtggctcacacctataatcctagtattttgggaggccaaggcaggaggatcacttgaggccaggagttcaagaccagcctgggcagcaaagtaagaccctgtctgtaacaaaaaaaaaaaaatttttttttaattagccaggcattttcatgtatacctgttgtcccagccacttgggaggctgaggcagaaggattacttgagctccagagctggaggctgcaatgagctataatcgtgccactgcattctagcttaggcaacaaaatgagaccctgtctctaaaaaacattttctttaattataaataaaacatattacacacaaaattataccacacatacataatttagcgtaaattcattcatgtggccgtagcatgtgccctgtttgggttttcatgcagtgggtttttctcccctttcctttttggctccctctccaccctaccatcacccacatcacccctactcccaagataactggttgataatttatgatgctttcttgcatattttatcaatgctcttagttatactatacatgtatagcgatagccattttatatgtacacatacaacacacagaacattgataatgtaatcatgttgtgcatacttctctacatgtctctttttttttttttttttcctgagacggagtctcactctgtcgcccaggctggagtgcaatggcatgatcttggctcactgcaacctccgcctcctgggttcaagcgattctcctgcctcggcctcctgagtagctgcgatcacaggcgcacgtcaccacgcccagctaatttttgtatttttagtagagatggggtttcaccatgttggtcaggctggtctcgagctcctgacctcatgatccgcctgccttggcctcccaaagtgttgagattacaggaatgacccaccacgcccagcctctacatgtctctaactcaacaatgcctcatggaatttcttccaagtcacttggcatagtcctaattcattattttttagtgtccatgtaatattccatgatgtggctacaccacagatttttcagccattccacttttatggacagattctgtttctcaaattttgcccaatgaacgacactgcaataaatatgtttgcaaggatctctcttactagtgctttcatttctctaggatagagtcccagatgtgagattgttgggtgagaaggtattttaaattctactaaatattgctagattgctttccaaaaaagctatgataagtcatgtttaaaccagcaatatatgataagatctatatctttgccagcaattggtattattagtctgtttaatatctgccaatctaatatgtataggttatatcttcttaattttttaaaatgttttatttatttatttttaaattttttatttccataggtttttggggaacaggtggtgtttggttacatgagtaagttctttagtggcgatctgcgagattttggtacacccatcaccagcttgtttaattttatctttctttgtttatcagtaagtctgagcaccttgtcattatgtttggtgacttggaattgtcctctatgaattggttatttatgaacattgcccatttttatataggttttgttatcaatttgtgagagctctttttttttttttttgagacggagtcttgctctgtcacccaggctggagtgcagtggcgtgatctcagctcactgcagactctgcctcctgggttcaagcgattctcctgcctcagcctcccaagtagctgggattacaggcgcccaccactgcgcccagctaatttttgtattttttagtagagacagggtttcaccatcttggccaggctggtcacgaactcctgacctcatgatccacccacctcggcctcccaaagtgctgggattacaggcataagccaccacgcccagcctgtgagagttttttttttttttgagatggagtcttgctatgtcacccaggctgaagtacagtggtgtgatcttggcaacctctgcctcccgggttcaagcaattctcgtgcctcagcctcccgagtagctgggattacaggtgcatgccaccacgcccggctaattttgtatttttagtagagacaaggtttcaccatgttggtcaggctggtctcgaacttctgacctcaggtgatctgcctgccttggcctcccaaagtgctggattacaggcgtgagccaccgcacccagccccctgtgagagctctttgttgttaaaataatcttctttcttttatgctgaagatatttttctacttctattgtttatctctttactttcctttcttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacccgcaccctcagattgtatatgtagtctcctagattctctttcaggatttgtatgattttaaggttttcattttttttttaaagccagtcaaatttagcagttgggggttgtgtaccaactttagtgacaataatgtcactacccgctaccatcagagcagcctaaggttcttattttcatgcattaaatctttgtatacagtgtaagacaagcatgcaattttatttcctctcggatgaatgctattataattatgccactacatactacatacccgcatcttttacccccagaattgaactaccaacttcaacatacatcgtattctcatatttaatagattttaagacttcaaaacgacacaaagaggatcagaacccgtatgtgatatttttgtgcgtcctgtctggtgaccgttggttcaccttatctctgtttccctttcaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatgctgggctctgtggtttattggcgtctgattcctaaggcaccaggagaggctggaaaagaaagagggtgttgatggagacgatggtgatagggaagaggcaaggcctgaagttcacccaaagcagcagttggagcacttgcacaggcacacacttgacaacacaaattgccagttttcccagtgctagtcctgcacagctcacctcttttccctggcgtctctgaccttgttccttgggacctttggacctgctggttaacttaggccttttgagggttcttaataagacaagctcacgaggggtagggccccctgaacattagggcaggaagggcccagttacaggtgcttcattcccactgccatccccaccctgaggcctgggagccagcctgccctgcttttcttctgcccggcagcagctcctgttacagttttttgcagtcagaacttgaagaaagtgctatcccctgcctgtctaacctgaaaagtagccaggggcccaagggtcacaagaggctccagggacaggtgagggcctcttctctgcatcaccactcaagcagcatcaccatagcaaccccaggagtaaacaatggtgccagaaagggcttccccacaaagccgcccctcctggctctgaggcccagaagaatggccagtaaccggcaaagatcactcagagggcccagtcacccatctcatatggaagaacctttcctgcaggtagggggtggcccatctctgccgcctacctttttgtaccccactgggctacaggctgtcccttatagtgggccaggctttcttctgggcagcagactgcctggcccatacattttctgctgtcttccccttttcatcctatgacactaggaacccagagctcagaacagagaggagatgcctggctagtgccacatctcccagccccacccactggggtgatcctgtagaaatgacttaggggcccaagctcaagaaacaggtgggtttttgcaatcagaaaagtcctgggggccaggcacagtggctcacgcctgcaatcccagcacttcgggaggtcgaggggaacggttcacctgaggttaggagtttgagaccagcttggccaacatgatgaaaccgtctctactaaaaataccaaattagccaggcatggtggcacgcgcctgtaatcccagctactcaggaggctgaggcaggagaatcacttgaacccgggaggtggaggttgcagtgagccgagattgcaccattgcacctccagcctgggtaacaagagtgaaactccatctaaaaaaagaaaacatccctggggatggataggagggcgaagcattttaaaagaggcacatttttgttgcagtcaggcactgtgctaagtaaggccatttcatttcacccagcatggtatgccaagcaagagcacagacagagggcttaagtcccagctgtcactcaggcaccagcaccctgtgtgagtcacctacccttactgtgtgttgctttctgcatctttgagatggggacgatagcaatacttgctcatagagttgtgggggttcaataagatccatgtaagtatttagcacagcatcaatatgtacttgctgctgtttatttaatggggggcagggtgcagaaaggggaaggagctgccattctagatgctttctatactagcgttttaatgaggagtgggaggaaagcgtcagtgacggacaaatgagtattgagaggagtctgggatgggaaaacccctggccctattttctggaggactttcctggtataccgccaagaccaggagcaagtgaaggtgggctgccccccttggcatggtagggagcatttcccttcatgatttcctgaggcctgatgtgccctctaaggagcaccagttcctgggtgggaatgtggggatgccagaacggaggagggaggtgaaggtaaagagtgaaagctgagtacagagggtgggaagtcaaagccaaaat

SEQ ID NO: 14301 - DNA, 33109 bp, Human
tgctcactaacctctaactcctggactcaaacgattgttctgcttaggcctcccaagtagctagggctacagggacacaccaccaagcccgactaattcctaaatttttttatttgtagagatggggtctccctatgttccccaggctggtcctgaactcctggcctcaagccattctcctgcctcgccttcccaaagtgctggaattacaggcaggagccactgcgcccggccagtgctggagaatgtaatggagatgatcctgcctatccctgagttccagtctagtttactgtcagagaatacttatttccatttttcctattttgttcttgagtctctttcctcagaatttacttttccacttaaatgacgtacgcagcttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacatacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaattgcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctctttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtactctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacattcgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcaggaggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattcttttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgatgcgggtggatcatgaggtcaagcgtttgagacctgcctggcccacatagtgaaaccccgtctctactaaaaatacaaaaaattagctgggcgtggttgtgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaaggtttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaagataacagttcaaattttgatggaaaaatcaacctatgcttgtgtgtgtgtgtgtgtgtgtgtgtgtgtgtgtaatgtgtacagtgtgtgtggttgttgagataagcataattatataaaaatatgtgtgtgtgtgtgtaatgtgtacagtgtgtgtggttgttgagataagcataattatataaaaatacataaaatatgtacacttcaatgtgcagttgtaaagttaacattcacttaaccacaactcaattgtagaaagatcatttacagacccttaagaacttcctatatgcagtctcccaatcacaacccacttctttcccccagaaataatcacaaaatagactttggtgataatcttttccttcgtgtgttttagagtgttctcagctatttatgcaaataatatcatttagtttatgtatttttaattaatatggtttttattaacgaactttatatacattttgctgtatttttcatgtgttgattttttatagccatgcttttgtgcatattgaattcattaattttaatttttatataggatgtatttatgaacatcccactaactattctgctgctaattgatatttggattgtgtacagttcgatgctattataaaattcttctaaggacattcttgtacatgttcatttgttttgctaggtcctagagtctaaggtatatatccagaagaggaatagc

SEQ ID NO: 14302 - DNA, 12768 bp, Human
ggtcttgaactcctgacctcaggtgatctgctcgcctcagccttccaaagtgctaggatcacaggcacaagccactgtgtccagtcttattttatcttctttccccgttcattgctacaatccctcatttaggttattttgaagcaaatttacatagggaatttttaaaaacaattgttttcagctgaaagcatcagctctccagagcccactgtctgtctttctatgttctaagttagggtggaatagatagcacctcttcccttctactaatttccactgcttctatcaacaaaagtcagacccaaggctcatagctgttcttccaaactcatcctggaggaaaagaattattgatagcatgctctttcatacctttctctactgtaaaggaacctgcctgaggctcagaaatcctagctttatcctctaactcaagtcaagtaacttttgatccctggtgatcttgctgtcttcaactaacccagaaccttaatccagattctcttctatagattctcttacatgattctctataaattctcctctatgaggcagagagaggccccaaaaggtaactcattccttccttccttcaggaaaagcttaggcatgctgctaggtactgggactacaacaatagtcaagacagggtctctgcattcaagcttagagtccaacggggagtacaaacatgaaacaaataattataacagtgataaagtgttagtccaaactgcaccatttcgtaacccccaccgacccccgccattttgcagaccttggctaaagtgaagcattccacgggggtttgggcccttagaaacagcctgtccaactgcctccctgactttatcacactctgctgggaaaaagtccaaggaacatcagcatcacattctgcgggaacaagggccaaaatgcctcattatgggaacatcttcccaggcagcaagccatactgcccagacccgtcctgctcatacctacaagtaccccaacctgtacgaagcagtgggcactggcattaagctagtcccccacctctgtaggtcttatgctagacagaaagcctggatttgatgtagagccgccactctctctttctttaaccctcaccttcctttcaaaatgtaacaataagtacatctattctagatttagcattcagtggtatataaaacaaagttgttcaagagagctgagcagagaagcagcgagaaatggaagctaccagatctttgccactcaatcctccataagttctagttttatatcaggtggatgcctcactgcatccatcttctcagcttggccacccccttgctaccaagttgcagctcaaaacgcagctttctactgtctcttgatctctttactctgcccatatctgtgtaaactctcctcagttacccatttgagtttgccacctgtttcctgctaaaaccatgttgataaaggtctgtatgaaaagactatttacagaagtgggcaaggttaaggaaacaaacaaacaaaaaaagagataagtttgggcatccagattttagtaacagcaggaaaccattatcatccctaggcctaagagggcagggggagaaaaacatattaccatagcatggatgagagctggagccatggaagagaggacacccaacagaagctctgtcatgtagactcagccagtgtcaactgtggcaggaagggaataggaagaacaaatattccagtctcgctctctttctccccattcctcccttccctcttcctctctctctttctctcttctcccctccaatcctgtataaacccaatctgaagccaaatccagccagcattcaggtgataaagtcaacagaggtcaaccttccagggtacagatcagagccaagaaaggctgatttagaaagccaaacagaaaacaatcaacaattacatctcattgtcaaaaacacttttaaaagacagtagatatcttttaaactttattacaaaaaatatgtgctttttggtaatacttttttttttttttttaaagatagggcagatagccccaacacactaccctgcacacagaaaataatcattggtcttcactagtgaaataagcagtgggttgctaagggccaacttgcctgaacaggctacacaagaacctcagagcccaacccattgtgaagaaacatgggttacttctgaggttctagaattcccagaagctctgcttcagcactggaagcttttgctcgcagtttgcttcatagctctgtgaagaagctgtggcccacactggggtcccctcttttcctaaatccagatgaacaggtttctcttgctaatgagtctttatctgcttggatctgccagaggtgagtgtttgatctaggcttcaggtaaatacaaaaggggtctcccttaagacatttcaggccttgaagaaggaagaccagtctctcagtcacccaaaccaatctgagtcagaatcaagagcagctaaacaagtccaactcggagagctcctgaaccagttgatttctctagtcatagctttacagtcagagggtcccactggcttggcacagtctggtttctacttattttagccactcaacatttatacctgatgctgcatgagatgaaaaagtaggcttaggggttctgtagaagcccaatgaaggtttgtcccaccaattaaatgtgagggatccttgtgtggttaatgtgccaaggaaagatgggagatgggaagatgtaatgtgttcagaaaacaacctcagaacacgacagagctataggccagagacttcataagcctcttcttcatggctgtgttatatcaatcaggttttctgtatcatctcttcttttgggatcccccattcatggtgtgctgtgttccctcctgcctcctacagcagaaagaggccatgagctctgagcttttagtgaaaaaacaatgtattttctataatgtcgactgtcagaggttttgctttttgctttgttagaccttcaaaagttgactcaaaaatgtagatacacagccaccaggtgatagtatgtgccagtcacatggtgacacgagtcataaactataagatcaagaaattagcatgctttttatgtctcctttctatatcagaaacatctctttatcaaaacttgtgttaattattgaaaaaccagtcaagtagatagtatttatgtaataagtttaaaaaataaaaacctcctaaaagctttactaaatcttacctttcctttatcaacatattctcaccctagtcatttagaaagtcactgattgtaagtactgcactgtgccaagaaaatatatctatcgcaagattcttagagttttgagtactctggggttttagactacctcagcctcaaagatccaataattcctctcagcttttggctagaattaaataacttggttgttgtagtctacttgtcttcctctaggtggctcagtttaatcaaagagtaataatcaaattatctgttttgtgcttctgttcacttaaaatatacttaaggaatatttgtctgacagtcaatgatgagatggattggccagacacagtggctcatgcctgtaatcccagcattttgggaggctgaggcgggcggatcacttgaggtcaggagttcaagaccagcctggccaacatggcgagaccctgtctctactaaaaatacaaaaattagccaggtatggtggcatgcacctgtaatcccagctactcgggaggcagaggcaggaggatcacttgaacccgggaggcggaggttgcagtgagccaagattgtgccactgtactccagcctgggcaacagagcgagactctatctttgaaacaaaaaaaaaaaaagaaagagacggattaaaggtagaagagactggccagaaaaaaataaccatgtaagagttttgtaattcccagtgtaaggtgggaagaaaagaaaaataaaattgagtactaggcaatggtgcacttcacaatttatcttattaagtactcaggacaactccatgaagtgaatgtaaatggtatgtcacaaggatacaattcatatatgtgtgtgtgtctatatatatatatatatatatataatatgcctagacttttttttttttcccttaatagcttatagcaactttgctctctgaatccccaacccacatggattggggattgagtgtgagaaaatacttgacattaccaaatacaggcggcttaatcccttctgataatttttgtgggctcatacttgtcatccctgtccaaaggttaactcttccgcccttaatttaggttacaaatactcaggtattgaaaactacttgctttctctctccctcttctatctctactcttcttgtctttcacccatagaggaatgggagggttggtggcgaacttctgattctatcagggatggtatcctgacttcctgatgctgactttgtcagggaggcacattcattttccttcaggggttttttgtacatggatgagtggattctcctaagtagttcttaatattggggaacttaagattcttcccttcaatcccagaggtggcctctgtttgtttcactaaacacttctgtcctccatggccttttgggatacttagttgatttttcccaacatctgcagtcttcaggtgcccaatctaggcccataggaaacctaggagtctcataacattagcctaactccataggaagatagtctttatcccattctgtcagcttcaccaactctcttctgttccttctccatcccaggaacatcaagtcagcctaatgagctttctggctccatagatcatcaaacttcagttcagcaacttccaggtgagttcttttcacttgaaaacccttctgatgctgaggctttatatgagacttcttcaggcctgaacactttaagtgagcatggttccagtgagcatggttcaagcaagcacactgtggccgagcacacttctggagaacatgctgagagtgagcatgcttcaggtgagcccgctgcgactgaacatgctgaaggtgagcatactgtaggtgagcagccttcaggagaacagccttcaggtgaacacctctccggagaacagcctttgagtgagcttgagtcaggtgaacagccttcagatgaacagccttcaggtgaacatggctccggtgaacagccttctggtgagcaggcctcgggtgaacagccttcaggtgagcacgcttcaggggaacaggcttcaggtgcaccaatttcaagcacatctacaggtgagccatgtttggatgggtgccagtcattgacttcaggtgggaaatggggaacacatcaagaaaacccaattttagggaaggagtgcagaagaaagaattgttaacacttcacaaacagctctctcaaagtctctctagttctcgtcacaatcataccaagaggcatgtgggagcctgaaagctaaacaatatggagggccctctataagaaaaataaaacaaatacaaaatgccagtacccctccaacttcactctccataagaaattatgaatacacagcccttccgacttccctagaaggggatcatgaaagtgcagagttctgaagactaaccttcattagctttatgctaaccctgcctcttaaaccatgttagaatgctataactttacaaattctgtaaagagatgtgtgcagctggtggttctttttgtttgaacatggaatgtaaagctattttcttttagatccagaaatgagttcctaggacaactgctagtctgtggctcttaattaaaagggtttgttctgggaaagaaaacaagacccaaagtttgatgcctcaagttattaccagacatagttcacatttcactctattgtttaaatatcattattctaaattttcagatgaaagaagtgaggcaaatgtaatatgtccaatgtcacatggctagaaagtggcaaactttggattcaaacttaggactgtgcaaagcccataatctttccacttctttaggcttcccaaactgggggattagcagtagagacagtaaaagaggcaacatggaagtatttcaaagatagtgctgttagtgaccttcaataaggtcaatttgaaaatggagaaggacacactcttcacagggtttgcaatgttagagcattctaacatagcttattaatcggtcaaatatgactccaagtgtttgtgccttgtgggtgagagtatgatggggagtacaaaagggagatgaaaatcacacatacattttgctcctatgctgtcacatgacagaagggtatctaatgataaatgcccaggaagtcaatgcagatatggactggagtaaaaatattagagagagaaatttgggattcatcagcaatgagggtcagagatgaagaagaatgaaggaatttcctctggcacaggtctatcagacacagggcccagatccccaaaaagaactaagaaataaatgtgtagtatccatgctacctattgcccattacccctcccagatgtgaatcaaggctacacatctggtccacaaggaaatgtcatcaggcttatcttaaattttcaggcacaatattaaattgctacacatgtgcttatatgaatgatcaaggaaaatgtcttcgtggagagggaacctgcatcactcagaattcccagcagtgcatgttaaagaagatctttgaaggtatatggggacttcatgaggcaatttctgcctgagaacacatcaacttacttctggtagggggcagttggaatgacaggggcccaggaaagaatcaaggaacttgaagattcagaactttattttttcaaggactaagaacagaatcccttgccaggcgaggtggctcacacctaaaatcccagcactttgggaggccaaggcaggtggatcacttgaggtcaggagttccagatcagcctggccaacatgaaaaaaccccatctctactaaaaatacaaaacctagccaggtgtggtggtgggcacctgtaatcccagctacttggaaggctgaggcaggagaatcgcttgaacccaggagacggaggttgcagtaagctgagatcatgccattgtactccagcctgggagacaagagtgaaactccatctaaaaaaaataaagaaagaaagaaaataaagaatagaattctttattctaccaccaggtactgatgaagagatagatgcccttcccattaggcctaagagaaggcagagagactagctgtctcttcccattaaagcaatgtgttgattgccccatgagccattgggacattgactgtaagctatagctatatattcctgggacctagcacaatgtcaagcatatggtaggcatttagtaaatattgaatggataaactaataaacaactgtctacaagtctgtgttcacaggttaccagaccagtctgagtatattcccacacctctttacccttactctcagttcctcatccctaaaataagggatactggttatttccatcccaggaaccacactgcctgactcctcttgtagtttttcttcttcctcactagaaatgtcattttcctatttctacatgcagacattcatccaccatcactcggaaaacattaatgacacataccatgaactacagaaagatgactcaaatataaactgtgtacaaagagattatgttataatgtaagaaataagaaacaatatcacaagggagaaaattgtgtcttaagaaaggcacatataaagtgcagagagttcagggaaaggaaagattagaggtgcagagaagtatggggagaaggtggtattcagaaaatgctttgagggaacatttacgatttgggccaggagttctcaatcttgtttgtacattacaatcacctgagcaactttaaaaaatcctaatgttcaggttgcaccaaagcaattaaaccaggatctctgggaatagaatccaggcatcagtatttttttaaaggctcctagacaattccgatgtgcagtcaagattaaagagatactgatttagtcatacagcaatggttgatgggtattccagagacagggaatgaaagcaaaagtcagaaaagtgcaggatgtaaataggaaaaagagcaaagagttttttgaggatggtgagcagagacatagaagataaacttggaaaggttgactggagccagctgatacaagagcttcagtgtcagttaaaaagagtttgaatttaatagttctcctttatttattgcttccagacagtatgatatgcattttaaaataccctttatcatttaatcctcacaaagtaggagcttgcctaaagacctgttactaggaaaaggcagagccagtagcccatccaggttggtcaaagcgcttcttcaggaagattaccttagaagcaagttacagtggacacaagagaacctgttaaagggctattgtaatatttcagtaaaaggtaataggagtgactgatggaaagacttattaacatctctcccatgtcttttcactcattctgcatccctgtttacactctacacttactccagctacgcaagtcaccacttcctgaacagtttcatgttttcatgttttctccagttatgcttcagcctgaaattatcctctttcctttctaatcgaaatgctaacaattcttcatagcttagttcagtctcacttccttcctaagaatttccttgatactatgccccccttaatcaaaataccaaaattaatcatttatttgccagcatagcatataacatggtttttccattgcatgtaataattggctatttttatctctctcagctcttgacatcaaatgatgttattaatctttgcattctccagagtctagcatagttccttactaggtccgttaattttttttttgagatggagtcttgctgtcacccaggctgagtgcagtggcgcgatctcagctcactgcaacctctgccccccagcgattctcctgcctcaccctcctgagtagctgggatcacaagcgcctgcctggctaatttctgtatttttagcagggacagtgtttcaccattttggccaggctggtcttgaactcctggcctcaagtgatccacctgcctcggcctcccaaagtgctaggattacaggcatgagccactgtgcccggccaaatgtttgataaatggaaaccgagtgacagaaacaaactagattgcaagtagaactgacagaccttcacaacaaattggatggaaaaagcaaagggaagaatcagagatgacagaggttttgaaggtgtggtacaggaagtatataaaggaaactcacaaaaacaagcaggtttggggaggaaagtaatgagtttcattttgggcatagtaagttttagatgcccttagcatattggcatggaggtgatcatcggttagttggtaatgtgacagttcaacttgggagagcagaaataattggatccagaggagtagatgagcagtggggaagaccttgtcagaagcagagagtatcaagaaagggtgtagtttcaggccaggtgcagtggctcacgcctgtaatcccagcgctttgggaggctgaggtgggcggatcacaaggtcaggagatcgagaccagcctgaccaacatggtgaaaccccgtctctaataaaattacaaaaattagccaggtgtggtggtgcgcctgtaatcccagctactcaggaggctgagggaggacaatcgcttgaacctgggaggtggaggctgcggtgagctgaggttgcaccactgcactccagcctgggcaacagagcgagattgtctcaaaaaaaaaaaagaaaagaaaagaaagggtgtagtccacagtatgatgtgcaagcaaagaggttaaaaaagtcctgagaaaaggatgcagaatttgatgagtagatctctatgacttttgagagaggtttcggcatagtagggtcatgattcaaactgtgaggggccaaggtgaggaggataggcagactctgggaaggctgtaaggaaaggaaggatagtgctaggggagtagcacgattaagagaaagtattttaaatttggggtaacctgagcatccttgtaaaccaaaaaaggagtccatagaaacggactgacaatataagaaaggagtgggcaactgatggggggcaagttcccagaggaagcaaatagaagagaaagagaagggataatggacaagtggaggtcttgaccatcctgcatggagacactgagcatcacagataaaggctaaggttggaggacgaagctttctgctcactagtctgtctctgctcctttcaggtggaaaactccaattcatggttcaagggtgtgagaacatgtgcccatctatgaacctcttctcccatggaacgaggatgcaaattatatgctgtcgaaatcaatctttctgcaataagatctagaagcctgggcccttgcttgttttgactcaggcagtaaaaagcctccatcactctatttggctcattttatatttagttccttccccagtcaacaactgaccacatctgcctctgcctgagcattaggatgctcaaacatcctatctttcttcttctattcatgcttttatccattcttctctgtcctgtcttccctgctccaactctttctctcaatattcctgatttttttttcaataaatttcacatggttaaagcacacaggctcaagacagacctttttttcccccattaatctagttgcagggtcaacatgagcttccttccacaccgacactaaactgggtgcattgtttaagcattccatatttatgaaagtaaaggagtctccaagggcagagacaacaaagaggaatgcaaagtaggtattaatcttttacagggtgtaaacgtgcaggtacttctgacacccccccttttccatccctacacactcttccatttattatggcatacaaaaactcaactcttctttggctcttgagagtttctagtcttcagtagtccactactaacataatgataatagtataatgattccttatttgctatatattgcagcagttcataatgcttaaatcatttttttcacacacaatgttactgaatcatctatacaggataggagggcaaatggaaatactaaacggtccctcatataagtgttatgttcttcaagatgttttcacatacacggtctcatctgatcctcaggaaagatcccagagtggtagacaggaaagatggcatcatccttttttgcaaataaggaaatgtgacacagagatgttttctttattcatactccatgttgttccaaatttaccaaggttacagagctacagagagctataggcagattccacaaccaaatctgcaagatctaaatctgagctgtttccaccacaatgaaagtagccagaatggttctaagaactcttagaacagtacaacaagaagtcaattttactgtatataaaatttaaaatttcaacatatatacacatcatgaccccttccccaaaatatattgctaacaagctcttcactggcaataatggtaagctggaagaaaatggaacatcttcaaacttctgaaggaaaattattttgaacttatactcatacccctagataaaatagtatacaaaaataaaatccccaaagcaggaactaaaatcctaaatgaattttcaacttggccagaagggaaatgaaagcctgccaacattgtcaacactaataacttttttttttgaagggagaagataaataatagtctactaggtataggtgttgagggaaaaatgtaagttcaaatatgttgttaaaatttaaggagccaggcatgatggctcacacttgtaatcccagtgctttgggaagctgaggcaggaaaataatttgagaccagcttgggcaacacagcaagaccccgtctctacaaaaagttaaaaaattaactgggtatgatggctcatgtcaataggcctacctacttgggaggctgaggtgggataatcacttgagcccaggagttcaaagacagcctgggcaacatagtgagactcatcttaaaaaaaaaatttaagggtaggaaaattctggcttccatttatagtggaataatttgaagtaaccctctcacaggtaacaattatatgttctggacaaaacataaaaaaaagatttgaaagctcctccaaaggaactgaagagaagtcaccactaaaaagagagatttgtgagcttatgctggagggtacttctcaatccatgcatcacaggctggcaaaaagccacaggctcactggtttgaagtttcagagaacataggttgggactagcagagcagctgcaaaattagggggtactcctgaaaataagacagccacagagaagcccctaaatttgaggataacctctgaccaaattattgtctggtcactgactccaggaggctcaaaaacaataacatctgaaagctgaaaaaatagggcagtgattttagcttctgtccacattgaaggagacagacctaatagaacaaaagtcaatactcttcagaggaacagaagagtacagaatctctacaattcctcatttactatgtctactatgtaataaaaaattattacacatagaaaaagcagggaattgtgacccatagccaagaaaaaaaagcagtctatagacctt

SEQ ID NO: 14303 - DNA, 12768 bp, Human; identical to SEQ ID NO: 14302

SEQ ID NO: 14304 - DNA, 12768 bp, Human; identical to SEQ ID NO: 14302

SEQ ID NO: 14305 - DNA, 12768 bp, Human; identical to SEQ ID NO: 14302

SEQ ID NO: 14306 - DNA, 12768 bp, Human; identical to SEQ ID NO: 14302

SEQ ID NO: 14307 - DNA, 12768 bp, Human; identical to SEQ ID NO: 14302

SEQ ID NO: 14308 - DNA, 12768 bp, Human; identical to SEQ ID NO: 14302

SEQ ID NO: 14309 - DNA, 12768 bp, Human; identical to SEQ ID NO: 14302

SEQ ID NO: 14310 - DNA, 12768 bp, Human; identical to SEQ ID NO: 14302

SEQ ID NO: 14311 - DNA, 12768 bp, Human; identical to SEQ ID NO: 14302

SEQ ID NO: 14312 - DNA, 12768 bp, Human; identical to SEQ ID NO: 14302

SEQ ID NO: 14313 - DNA, 12768 bp, Human; identical to SEQ ID NO: 14302

SEQ ID NO: 14314 - DNA, 12768 bp, Human; identical to SEQ ID NO: 14302

SEQ ID NO: 14315 - DNA, 12768 bp, Human; identical to SEQ ID NO: 14302

SEQ ID NO: 14316 - DNA, 12768 bp, Human; identical to SEQ ID NO: 14302

SEQ ID NO: 14317 - DNA, 11558 bp, Human
gcaagactttcccgctgtgtcaagagatgggaataggccaagtctacaaagctgacctgaatccatttgtccaattggtgagcctgtctggcctatccccaggggccagaccctgccctcgccccaagcagtagatgcaagagcagagaaggatggtcaagtctatctaaggagacaggctgtatagaagtgttctgattgcatgggagcaaattttaagagaagtaccatgcatggataacaatgttcaagccacagtaaccgcacactggtaaactgtggttaaacttggtgcaaaagtaattgtggtttttgtcattattttcaaatgggtcttaaaaaggagtgttgggggccaggtgcggtagctcatgcctgtaatcccagctctttgggatgctgaggtgggcagatcacttgaggtcaggagttcgagaccagcctggccaacatggtaaaaccccatctctactaaaaaatacaaaagttagctgggtgtagtggtgggtgcctataatcccagctactccggaggctgaggcaggagaattgtttgaacccaggaggtggaggttgcagtgtgctggaggttgcggtgtgctgagatggcaccactgcactccagccggggtgacagagtgagactctgtctcaaaaaaaaaaaaaaaaaaaagattgctaggggaaggctggaagcccagggaggaagcaggtgttccctgcccagcagtgattgctccctggttgctggaggaacgatggaatcagagtcacccgaggaccaaagctccacacctcttgctatcccagactctctggaacaccaggaagaaaacatatttggacaaaaattattctttgcaacattagaacttttgattctggaatgagacaaggaaatatgtatgtatctcagagagacaatgaatttttaaaaggaaattgggaccgtttctcagggtgagatgtcttatccggttaactgcgagcccccagggatttctactcagagtgttcatcacatcaggtttccattctctacaataaaaacatggctagggagaaattacccagcactggcaagaaagagctccaaaatagaagcagcttttgaggaatttggagggataaaacggaatagtatgtctgaaagttggcaacatgtaaaaaggctaaaaatgacaattctgcctgtgatactatgtctagtgtgcaacgcttcattcaaaaggcaggcacgtctcccctccaggcgggagtgggaatctcagtggggaaccgggaactgcgtttgagctgatgcagactcagggtcaactcgacaagggagcccggcacccagacacagcggcgttcacctcaccttgcaccgtctttgtcggtcttacaggcatcagctttcccagcctcatttgagccgggatctgagttgcatttctttctgggtcaggccttgccattagggagagatgaagtcaactgatgagcgtgccagccttgaggaaggacagagtgcgggaagcagagtgtgggaagttggaaaaaataatctgcaaggtaaacaccttcaagtcaatttcaagaggctggctagaaaccgccaggacttcagggggccctgtctcgcgggtctccctgcgccctcagcactttggcttggtataaggccaccttgtccctgaagagaggcctattttaagctgagcaagaaaaggtgagaaagactaaaatcagctttgtgcagagacgccaatttctgctgcacacatggaaacgatgtgcacatacagcgagctggcccagctcccggccacgtggctcacactgtccgtgctcacccacccgttgccttcacccccagcagcactggttgtgaaaagggtaactgcctgagccaccccaccactgcgggcctgccaaggacaggcaggaactcagccatgccccgcaaggagcccaggggcatctccagggacggctccccagcctatgggctcgctccctgagaggccgtgctcgggctcgcctgctcagctcactccgaaagcctctgctcagacctgcacccagtcacagcagcacagatgtgcaggaggagaccatttccacggaccctccgactcctaggaggcaggtgaggagagggggagggaggggaccagcgctggtgcttcaggtatgctctggccactgcgattcactctgctttgtgcttggggtttcacacgcatctcggcgactgtgtgcggaaggtacagtcgtgaccatgcgcaggtgaggcctggaggaggtcagctaaactgctctctctcaatggttctgaaccctgagagtacatcagagtcacctggaggacttacgaaaacacacactgcagaatttctgacttggtcgatgcaggttggggccaaaaatgtgtatctctaacaggttcctgggcgatgctgacgccgatgctgtgcgtcctgagccacacttggggagctactgcgcaagctcgcacagctagccgaccgctgagctggggctcagacctgggtcagtcctggtccacaggccagcccctttctcacgtcccctggtgaacggcggcatggtggcctcatggacactgagcagggcccctagggaagcctgtatggaggccacttcactttgaatggatctgggatagaggaaggacgcgagctgtgggagcctgggtcctgggcacagcgggcatgtcatggcagggttcaccagcctcctttcagcagttccctagttctgccccagctacctgtggttggtggtgggaggtttatttgttagttccttcagcagtgactcaccacacttactgagagcttaccgtgtgccaggactgccacaggtatggggatgcagagtgtccacagccccccagaagattgatgatagcaccctccatgtaggaagggctgtgactgcagacagggcatggggcggggcacctgtgtttgccacaacctctagagggtcccttcatattcacgtctgtgcgtggggccctcctccacccagatctgcttccgcagcacagccacacaagtctacagctggtgactgtggctggcaagcaggggaaggtgggtgggggcggcagccgtgggctttccactgggtcccagcagaccaagtcctggtacaaggaagcacgggctggcactggcaaaccctcctcagggagcagcaggccaggaacctgggctgggactaattattgctgaagagagaacagggccaagtgtccctcatgtccccccagcagccggggcaagcagagaaagaaatgtcggaaccggggagaggcccctgcctctgcacagggctaaacatcatgccagctggcaagggagaaatgggtacagggcccaggggcattatcacagaagaaggcaatgaaaggtgcgttgggggctgaggcaacccattataactgcacacatcacacaccagggatccactaatttagactacaatgtgaatggtcttttgaaactgagatgtgtgggggcccagagggagggatccacccagctgggaggaggttagggaggtcttccttaaaatacttcctgttccgtctcagagaacccatggacactggccaggggagggagaggaaacacgtcgcaggtggagagaatcgcttgtgtgagggcacagagcggggcaagaagacagtggtgggctttccccaggagctgttcggcagagggaaagtggatgctgagctcttcctcttccctggagcaagtcccatttcctcagagaacacggcccccttgggccaaaaggacatgaagaagctcttgctaatgccagcctggctctcctcatcccgccccctgcacccctgcccttctggctgccctcccttctcctagctctgtcccctctcacttcaggagtctcaagtccttcagactactccaaagtcgggggatctctggatgggtaggaggtgatctcaccgcctcctctcttgcccgggcttgtcgagatgaacttcctgatgctggcggcgctgaagctgacactagcgggggcacctccctgacatgaacgcccctcgagactgggccagtgctcctgatgcctgggcacctgcggaaaggcacccagcgtggccgccgtggcatgccttgagtgtgtgggtggggactgttgcaaactgacattccagctgtcccagtccattttgtgctgctctcacacaaccccggagagtgggcgattcacaaaggacagaaatgtatcttcccacagctctggagccaggtgccagcaggttctgtgcctggtgatggctccagtctctgctttcatgatggtgccttgctgctgcgtcctccagaagggacaaaggctgccgtcctcacatggctgaaggtggaagggcaacgagtgaatgtactccctccacacagcacctacatcaggacacctgattccattcatggcctaatcccctcttaaggccccacctcttaatgctagcacattggcaacacctggattttgcgggggaaacacgttcaaaccataacaccatctaaggctgcttctgcctgagacaagtgtgctcatgtctgcctcagagacggggccaaaagcagcttgctctgccctgccctggaagcaggacagaggatagctgtcatctctcccttccaatgccagctcattgtctcaaacaaaacttggccccttgtgccctctaaggagtgggttcctgtgcaggggctccaaggttctttgtgataatagaccagggagggcaagttggttccctctcatgcttggcatccaggtgtttgagggtagctgcccagggccctgtgttgagggcactatggtcagagctggagcaagggggggctgggtgcatgatgagtttgcatggcagctggaagtgtcccctctgagtggctccctggatatcccgggaccactggccgtgtgcaacctgagtcccggcatgaactccgctgggaccctccttcgtgttaacgcttcacttttcaaacaggaaatagaaggaaaacaaagctgctttctaacaaacactttgattttaaagccagagtatgagtcagaaacatcatccattgcagccagctttacatgggaatagcccagttcttcaaaagaagcagctgtcatttcatggcaccgaggcatcgtgtttccagaagagccacagtccctcttgcattaagatgggttgtgacggacctcttagagaatccgacagtttcgggttggaaaggggatcccttttgttctgtctggacagtaaggcagtgcatcatctacaggtgcatccgctgcatggctgctggcttgtggcctgacaaaatgcccagcattgaaccagatgcataggtgtgaactctggagaatcctgttttcagtggctggaagacggaggtgtaggcaccagctcaaactcttcacctcacgccttctatcctgcagaccccagcaggccacatggtgaccttctatgtccatctgggacagcagtcagctgcccctgcctctgcggggagtgagcaatgggccgcaggatcacttgtcctgggcagctcttctgggggtggctttgcattgctgctgggatttgggagtccagggcctgtggtctcctgggggctgcgtgcagagtgtcttccccagaaccagatggggaagggagccgcagggaaagaacgtgacctttgggctcaatcctggtattgaagccgtgttcgttcttttacattttcgtaacgtgcagcattgggtaaatgccttctgagtttggttagtgcttgttaaattgggcgagaacttcataaggttgcaggaagtattccgagaaatggtacatgcacagtacttagcgtggtcaccgcacatggccagcatgtaccaaactggtccgaattgactagaatggggagggtgggaagcgacaatctctacgttctctttaacctgaggtgtctgatgctacttgctgggcttctggcctgtgatgagtgctcccactccctgctgccctgagacctgtgtggctttcagggtattcttttttctcagtgcctttgtgtggagagccgctgtctccctccattctgtgggtgatgcaggtggcgctgctgtgagctgcccctggaggtcatggataggctgtcaaggacggggcctgccattccagagctcccgccaccctggggaagcgatgtgggcagtagctcagaatgcagcttctccctagaccctgggccaccggggacttgcgagagaaagaacagggacggggaagactggatggtcctgaaagctgagaggggccacagaagcccagatgacacaggactatgggagacaagtgagggcaccagcttccctgggttgagggaccgtgatacccaggagggcagagagggagacagggcccggctggcaacctctgagcaggtgagtgggagagagagcaggacagagaaggcagctctgtgttctgctctgatccgtctgactccacacggatgtggagttctctgagactcctttccctgaatctgagagcttactaacagaaggccgggcctctgagatagagatcaggcatgtaatgaatgaatgtgaatcatgaatacagctggagcacccctcatcagggtagcccacaccttacaaccgtggacacagaggccttgttgcttccccgaaagtctagttaatgcctagttaatatctaattaatgaccagttaacgacaacgctcctaactccatcatcccaccccctttccccaaattcagcacaaatggcttcagtttgagtttcccaaagcatctcctcaggtgtgtggttacagcccagccctagggtctctgggtgcatcggcttccccctcccagatccaagtacaactgaaaccctaacagtagaaatcatcattgctggcccagcgctgccaccactgcttctgttcatagcctgttttgtttgtttttagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtaagtccctgcagtgaaaaccgagacggtcttttgcctgccacagccccgggcagactctgctctcaccgtggtgccgacatcccaagttttcagactcaccaggacccagtgacagcatctgggtcctcagagctgcatgcggactgtccccagttcagagcattggacagagctgggaactgacagccctgatcaatagtcccaagaggaaggccagccctcctcctcctcggaatcctgggtttctaggaggcagaaaggttttctgagaaacaaggcttttggaaggaaggtggtgcctggctgcatccagaaagtgagagctaaatggagaggctgaacaaaggacgcatgtggagcgcacggggagggaaggctggggtgcagggctccgggcctgctcttctgcgtccaccccggatcctgcttttgtccagatgggcctcggagcaccagtcacttactccaagaagtcgtttcctgtggccaataatgaagatgacgcactcggaagcttgtgggctctgaggagggggtaaggatgcaggggccatgcattcatcccagcacaggcagcgcatggctccggaagcagacacaggccaggcctgggccaggagtctgccaggagccaggagcgcctacacctccctggaggcccacacttctctccccagaagctcacacgcagcgtctgaggtgcagggcccaggtgtgctggggtgacaaagccccgagctgtggtgatgggagggaggaagcgccggtttatgtctgttctttgggctgatttgctgtctctgtctttgtctctaatgtcctttgcaccactgaccttgaggagccttttgttcctcctgtcccagtttggtttccatgggaacctgagtggcagcgtcatcactttgctgaggtgaaatgcccctggatgccatgaatacctaggggaaaacctgccagagaagaataaaccatccaagagacggcgctgcagggcctcacagtctgcttccatttcctctcaggtttcagatcccttagttttgggtgcccaagttcacggagggtgccggggaatagaagctctgtcagtctcgtctggatcttggtcctcagcaactgtctggatcctgacaggtgtgtgataattacttagtgaattcatgggtgtgggccgtgatagaattaagtgatttgatgtcctctcgataaatccaggtaacgacatagggttttttgagtttgaccctctcctgaaatttgccatctgacaaaatgacatcatggcagagttgtaaactgctgtggatgtattttatttaatttctcaaattaaaataaaaggtaacggtacacttaagagtggtcactacagccaagctaattgacacccactgaactttctggaatgggccataggatgctggacaataggacagatttggaatgagcagtcttccattccaactttagtttctgcaaagctgttgagagcatggagccaggctgcggggtctgggttcaaatcctgactctaccacttaggagctgtgtgtacatgggcaggacaactggcctgcctgagtctcagtgtaggtgtctgtaaaatggaatgataatagcttccatctcacagattcactgtgtgggtaaaatgatagatatgaaatgctaagaacagcacctgtacgtagtatgtcctacatatcttactgttatcattagcatattttgtttattccaagatacatttttgttggcccatttgatatctatgaaatctaaagattttttttcctgtcttgggagatagaataatgatgtgccttacaatggattgtgttttagattcactgaaattcattattgttgtttttatccctggtctgtaacatgatatttggtaaataacaaggactccatacgttttgcaaagagtaaattctctccctccctactgaggccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctggaaaaaaattcttgtgaagtttgcattccaatctataatatccacttgctaaaaactaaaaacgatgcatctccacaaaactctgcaaggaaaagtatgctccaagcgttgtctcacagctatggcacgcccgagggcactcccagtatgcacttccaaggacggtttgagaagtgcgggtttgatcatctatagcagatgctgctgatgccaaccagcaagccccgggcccccgctgggtgtcccccagctgcagtggacagtcattcctgctgacacgttcctaccacaagccccggcattgatagcttggttttgttttgtgtttttcagtgcagtaagagcttgcctggcctgtgtgcagagctgcctcatcctgaaattctgggagttgaaagccccagggcaacccttaaccaatgggggaaaagcattggtgtgtaaatcccccagcttccctgggtgggctgcagctgagccatattctacatgacacttccgaggatccccagtgggcatgacctcaatcgcccacattggatgccacaacctgcactggcttttctcccttccctgtgggtctctctctgcacttcctcccttgtgcattctaggttcaccttccaaataaatgatgtgcactcagggccttgtctcagtctctgacctcggggaaacctaaactaagaaagtcgataccagaagcagccctgcggagtagcccctaaaatgaaattctgagctgggatcgcttgctggacaccctttggctggtggtgtgcagggtggtgagatcttactaagcctgtggtggcttgagatgaggtccaggtataaaaggacacactggctcatgcagcagccctggcaacaaaaaggcatggaggcagcggggatggtcatggccgtgaagtgggctggtttggctcattgcagtaggaaccccatggagacagaaagatgggcttaagcccacaactatcaactcagggctcgctttgaggccacaggtctccatagcagtatttaaaatgactctcatctgctactgacagaggacaggctgtactgaaaatgaggtctggagttgatcacatgtgtagtggagctaccagacgctgaatgcagagccccagctaactccccacgctaacagcagggccctcataggggaggatggggccctgagatgggatgattcatcagctgggtcctcaggaagaatatgccaagatgtcgttagacgtgccagagatttacaggggtaatgcctgtgaacaaaatggggaactaagcagaagtaggcagagggagcctcaggtcacgatgcaggtctgacacctacgaaaggagagggaggaggaaggagggtcaggcaggaagatcctcagactgcaggctgctcagaaaacttttggtgagtggcacaggggctccagcccaagactgcccgtagaggagcccaccatggcagtcatcatcagctgggctctgcctgggaagcacatggccttgatgtgcaggcccctgtcactggaggctgtcagctcattgcattccttggggctgggtctgtcatgaagggagaccattatctgtattttgcaaaggaggttaagtaaaggacatgaggtcactgagcaagctgtagatccaaggcttgcttctgggttagccggctccaagacacatgtgctgaatctctgacccttgtggctttggagagtgggccggcagtgggcaagaccaggctcttgataacagtagaagttaaagtgcacttggagtcttggctgcaggtgggacagtgccaaaacctggagatgccagcttgactccagatggcagtgagaagtgcaggacacatctgcaagggcagcctgaggccatctgtgtgggggggacattgcagagctctgtgagctcagactggtctccctcaattccctctgctcacatcagtatccatgatcatttccaagaatccaggcccccagtgcggctgcag

SEQ ID NO: 14318 - DNA, 5482 bp, Human
cgcagcctcccaccttggtctggagccctgaggccctcactgtcattgcagatcccgaggttcctctcccacctccattcagtggtggaaaactccattctaattaccccttgaaggtcctgggaccctctggcctctgttctttcttgtggatccacctacacttgggaacttcctcacctctttttctgctcatgacattgatgctctgggtatttcagaaatgcctcatgtacatttctccattagggtcagatgtgagatccagagtggacacatcaatcatctacacagactggggggtccaacatcgagatcctttcacatcccaaacagttcaggtcttaccctggtctggaaatcaagcacaaatgagcccctccgaatgtcccaggcaccactgacccaacaaccactgtgaccagtgggattcatgacaacaatctgcaaaggaggaaactgaggctcagtgatgggacattacaaaccaaggtcatgtaggcagcggatgataaccagtcatcaaataaatatcaactccctcccccactccccaaatcaaagctcaaacataagtcattgttctcaaaacgttgaacagggattgaggtgcagagggatggccaagtaagcaaagggcaccgaggaggcaggaaagtctcagatgtttgttcccagcgggtgggagtggacactgtagcaaaatattttaaaaaggggaagttgagaggggactatttggttgaaagaaaacccacaatccagtgtcaagaaagaagtcaacttttcttcccctatttccctgcatttctcctctgtgctcactgccacacgcagctcaacctgagctacacagccagatgcgagatgcttctctgctgatctgagtctgcctgcagcatggaccttggtcttccctgaagcatctccagggctggagggacgactgccatggtaaggaccccacaacgctgagctgatggatggctgaaggagggagggtgaccatgtgggaggctgtgagaaggaaagggaagcctccgttaccctcatctggaagggcagacgcagaaagcaccagttctatttgctgctacatcccgtctctcagtgagaagaggagaaaccagacagacagtggctgggggtcaggaaagaccccattacagtctgaaatgtctgcagagggcctggttcctgcccccacctcagctctaaaagaatgagagtcaggctcctggtagggtagttctgcttcctgtgtggctgcagatgacaacaccccatgagaaggacccagcctccgagtgtccacacagggtgggaaggaggggaggctatttctctctgtgtgtctctgtcctgccagcaccgagggctcatccatccgcagagcagggcagtgggaggagacgccatgacccccatcgtcacagtcctgatctgtctcggtgagatttgaagagagaggggagcttctaacctaggagggacctcaccccacagccgacctctagtccctaaggagaccccaggggctcacaaagatcccagggaggggaggacctgcccaggcttcaggggcaaattcctcacagggaactctcttccagggctgagtctgggcccccggacccacgtgcaggcaggtgagtctgtccccagctctcccaggtccctcctcctcactggggacaaggggccacccccgtgcagctggggatggggaatagcagttctggactgactgatgggggcatctggagggtcctgggctgagagctgagatatgttgggtgggaaatgacttagaatctgaactctgatttccttccagggaccctccccaagcccacactctgggctgagccaggctctgtgatcacccaggggagtcccgtgaccctctggtgtcaggggatcctggagacccaggagtaccgtctgtatagagaaaagaaaacagcaccctggattacacggatcccacaggagattgtgaagaagggccagttccccatcccatccatcacctgggaacacacagggcggtatcgctgtttctacggtagccacactgcaggctggtcagagcccagtgaccccctggagctggtggtgacaggtgagctgacactgagggctcccagccccaggctctgccctcaggaagggagtcagttctcaggggcatctccctctcacagcccagccctggggatgaagtgggaggtgtgagccccatttaacatggtgcctccttctctcctaggagcctacatcaaacccaccctctcagctctacccagccctgtggtgacctcaggagggaacgtgaccctccattgtgtctcacaggtggcatttggcagcttcattctgtgtaaggaaggagaagatgaacacccacaatgcctgaactcacagccccgtacccatgggtggtcccgggccatcttctctgtgggccccgtgagcccgagtcgcaggtggtcgtacaggtgctatgcttatgactcgaactctccccatgtgtggtctctacccagtgatctcctggagctcctggtcctaggtgagaaattcacagcattgcctggagttccctgagtctccctgagtctccaggcaggtggggagcagccacgtctcagggcagctccaggtgggatgatgttggggcgagagggctcagggctcctggggccggagacacaggaagatcagcagtggtgaggccccgggggagagggaggatatgtggggaagcctgagggtcggctcctggaaaccatgagcaccttttcccaggtgtttctaagaagccatcactctcagtgcagccaggtcctatagtggcccctggggagagcctgaccctccagtgtgtttctgatgtcagctacgacagatttgttctgtataaggagggagaacgtgacttcctccagctccctggcccacagccccaggctgggctctcccaggccaacttcaccctgggccctgtgagccgctcctacgggggccagtacagatgctccggtgcatacaacctctcctccgagtggtcggcccccagcgaccccctggacatcctgatcgcaggtgaggagcccagcgggttcagtcagggacacaggctccgcacaggccctgccaggggagcccaggtggtgatggccggaatgaggggtgggggtcccaagggagggagagacagacagagacaggggatgggcggggcggggaagactcagagaaaacagagatagagactgagggtcccagatagaagcctggggaggcgtcagctcagaacaaggtggggcagcctctcacccatccttcttctctccaggacagttccgtggcagacccttcatctcggtgcatccgggccccacggtggcctcaggagagaacgtgaccctgctgtgtcagtcatgggggccgttccacactttccttctgaccaaggcgggagcagctgatgcccccctccgtctcagatcaatacacgaatatcctaagtaccaggctgaattccctatgagtcctgtgacctcagcccactcggggacctacaggtgctacggctcactcagctccaacccctacctgctgtctcaccccagtgactccctggagctcatggtctcaggtgagggccctgaccctgtcctctccgagctcaaaggatcagctcaggccctgccccccaggagagctctggacactaagaaaagaggggagttggctgggcacggtggcttacacctgtaatcccagcactttgggaggcccaggcgggtggatcaggaggccaggagatcgagaccatcctggctaacacagtgaaccccgtctccactaaaaaatagaaaaaattagccaagcgtggtggcaggtgtctgtagtcccaggtactcgggaggctgaggcaggagaatggcatgaacctgggaggcggagcttgccgtgagctgatgtcatgccactgcactcaatcctgggcaagacagcgagactccatctcaaaaaaaaaggaaaagaaaagagtggagtgaagggggaaggtctgcgggggagggtcgagcccatgggagggtggaaatagacggggcctcccacccctggctcccacccttgtagtctcagtagggtaaagagcagggaaggctgggaggagatgggggtgaacctcagaggagatgagagtagactgagggtgaaagacagaggccccacctgctcccctcctgatgtctccacctcagaatcagagcctctggggatcccaacctctaagtcctgaccccatgggtgacaaaaacccagtcactcccagctctaaagaagtttctagactcatctcaatgctacctctaatattcagggtctgatttccagggcagcagaggggagggtggacagtaagggtgtggtctgcatggcttcctggtgctccagggatggggcaggtgttccctccgtggtgttcagaggggagagaggtgtctgaggttcagcattgatgagtggagcagcggggtctttccccctccccgagcaggattccaggagacatcacctctggttgagactctccactgtctcatgtacataacaaaatctctccaattttctactgaaagcaacacgtggcacagctctgcaggaccccacaccccgaccttgtcctgcaggatgtgtgacgagtagaagagggagaacaggtcgggtcagcaggatttggggtccagcctgacttggacacgtggaagatgctggggctgatggaggaggaacagaggcgggcgagttggaaagaggacagacagacggtcccttggcagctctcatttctcatttccaagggcccctgaggatgaacccctcacccacacctgtagggtccctgggccatctcaagacaagagaggaggccttggtgggatctgactgtgatgagggtgaagtccaccccgagcagaaatgagtgatacacaacacgtgctgtgaataattccctaacttgccagggagcaagtgcacggcccctccttagtctcaggggtgccctgagcccaagcccaccaggtgagcacaggaggggccgtgtgagcggcacccacagctggagtgcttctctctaaaggagcacgttttgggtggactcaaccctcaccacagtcagatcccaccaaggctctgtgctcagggcacccggagactaaggagggaccgtgcacctgctccctggatgagttagggaatgattcacagcacgtctcatatgtcattcatttctacactgtattttctgtacgtatgctttctatatgtatgctctctcctttactaaaacttttaaagcaatacttcaatatataaatttatattttttatttcaattatatgaacctattatttaaaaacatttaattttactttgcctttcattggggcttgatttaat
